United States Patent 12,569,549 (FLAVIVIRUS VACCINE) - sequence listing, part 53

SEQ ID NO: 18938 - RNA, 9879 nt, synthetic construct
  misc_feature 1..9879: note = derived and/or modified CDS sequence (opt5) from DENV-1__FJ461325__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcacggagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgttacgtgatcagcggatctagcgccgacctgtccctggagaaggctgccgaggtctcttgggaagaggaagccgagcatagcggcgcttcccacaatattctcgtggaagttcaggatgacgggaccatgaaaatcaaggatgaggagcgggacgatacactgaccatccttctgaaagcgacactcctggccgtgtctggagtctatcctctcagcattcccgctaccctgttcgtgtggtacttctggcaaaagaaaaagcagcgctccggcgtcctttgggacacgccttctcccccggaagtggagagagccgttctggatgacggcatctatcggattatgcagcgcgggctgctcggaagaagccaggtgggcgtcggggtgtttcaagaaaacgttttccataccatgtggcacgtgacacggggagccgtcctgatgtaccagggcaagagacttgagccttcctgggctagcgtgaaaaaggacctgatctcttacgggggaggctggcgcctccagggctcctggaataccggggaggaagtgcaggttattgccgtcgagcccggcaagaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctatggcaatggggttgtgaccacatccggaacctacgtcagcgccatcgctcaggccaaagcgtcccaggagggccctctgcccgagattgaagacgaggtgtttagaaagcgcaaccttaccatcatggatctgcaccccgggtctggaaaaacacggagatatctgcctgctattgttcgcgaagccatcaagcggaaactcagaacgctgattcttgccccgacccgcgtggtcgctagcgagatggccgaagctctgaagggcatgcccatccggtaccaaacaaccgccgtgaagtccgagcatacagggaaagagatcgttgacctcatgtgccacgcgaccttcacgatgagactgctgagccctgtgcgggtccccaattataacatgattatcatggatgaagcccattttacagacccttcttccattgctgcccgcggctacatcagcaccagagtgggaatgggcgaggctgccgccattttcatgaccgctacaccccctgggtctgtggaagcgtttccgcagagcaatgccgtcatccaggatgaggaacgggacatccccgagcgctcctggaactctggatatgagtggattaccgatttccctggcaagacagtttggtttgtgcccagcatcaaatccgggaatgacattgctaactgtctcagaaagaatggaaaacgggtgatccagctttctagaaagaccttcgatacggaataccaaaagaccaagaacaacgactgggactacgtcgtgaccacagatattagcgagatgggcgccaatttccgcgccgaccgggttatcgatcctagacgctgcctgaagcccgtgattctgaaagacgggccggaacgggtcatcctcgctggccctatgcccgtgaccgttgcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctctttgaacctgagcgcgaaaagagcgccgcgattgatggggagtatagactgcggggagaggcccgcaagacattcgtggaactgatgagacggggcgacctcccggtctggctttcttacaaagtggcttccgaggggtttcaatatagcgatcgcagatggtgcttcgacggcgaacggaacaatcaggtcctggaggaaaacatggatgtggagatctggaccaaggagggagaacgcaaaaagctgcgcccccggtggctcgacgccagaacatactccgaccctctggctcttagagagtttaaagagttcgccgctggccggagatctgttagcggggatctgatcctcgagattggaaagctgccccagcacctgacccagcgggcccaaaatgcgctcgacaaccttgtgatgctgcataattccgaacagggcgggcgcgcctatagacacgctatggaggagctgcctgatacaatcgaaaccctcatgctgcttgccctgattgctgtgctcacgggaggcgtcacactgtttttcctgtctggccgggggctcggaaaaaccagcatcggccttctgtgtgttatggcctccagcgtgctgctctggatggcctctgtggagccccattggattgctgcgtccatcatcctggaatttttccttatggtcctgctcattccggagcctgaccgccagagaacaccccaggataaccaactggcctacgtggttatcgggctgctctttatgattcttacagtggctgccaatgagatgggactgctggaaaccacaaagaaggacctcggcatcgggcacgtcgccgtggagaaccaccatcacgctgccatgctggatgtcgaccttcatcctgcgagcgcctggacgctgtacgctgtggccaccacaattatcacccccatgatgcggcacacaattgaaaacaccacggctaatatctctctcaccgccatcgcgaaccaggccgctattctgatgggactggataaaggctggcctatctccaagatggacattggcgttcccctccttgccctggggtgctatagccaggtgaatccgctgacactcaccgctgccgtcctgatgcttgtggctcattacgccatcattggacctggcctgcaagcgaaagccacacgcgaggctcagaagagaaccgccgctgggatcatgaaaaaccccacggttgatggaatcgtggccattgacctcgatcccgtcgtgtatgacgccaagttcgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattttggaataccacaatcgccgtgtctatggctaacatcttccgcggcagctacctcgccggggccggactggctttctccctgatgaaaagcctcggcgggggaagacggggcaccggggcccagggagaaacacttggcgagaaatggaagagacagctgaatcagctgtccaaatctgaatttaacacctataagcgcagcggcattatggaggttgaccggtccgaagcgaaggaggggctcaaaagaggagagacgacaaagcacgccgtctctcgcggcaccgctaaactgcggtggttcgtggaaagaaatcttgtgaagcccgaggggaaagtcatcgatctgggatgtggccgcgggggatggagctactattgcgccggcctcaagaaggttaccgaagtgaaaggctacacaaaaggcgggcctgggcacgaggaacccattcctatggctacctacgggtggaacctggtgaaactgcattccggaaaggacgtctttttcattccccctgagaaatgtgatacactcctttgcgacattggcgagtctagcccgaatcccacgatcgaagaggggcggaccctgagagtgctgaagatggttgaaccttggctccgcggaaaccaattttgtattaaaatcctgaatccctatatgccttccgtggtcgagacacttgagcagatgcagcggaagcacggcggcatgctggtgagaaaccccctcagccgcaattctacccatgaaatgtactgggtttcctgcgggacaggaaacatcgtgagcgccgtcaatatgacctctcggatgctgctgaacagattcacgatggcgcaccgcaagccgacctatgagagagatgtggacctcggcgccgggacacggcacgtggctgtcgaacctgaggttgccaacctggatattatcggacagcgcattgaaaatatcaaacatgagcacaagtccacctggcattacgacgaggataacccctataaaacatgggcttaccacggcagctatgaagtgaagccctctgggtccgccagctccatggtgaatggagtcgtgaaacttctgaccaagccttgggacgttattcccatggtgacacaaatcgctatgaccgatacgacaccttttggccagcagagagtcttcaaggagaaagtggacacccggaccccgaaggccaaaagaggcacagcgcaaatcatggaagttacggccaagtggctctgggggtttctgagccggaacaaaaagccccgcatttgtaccagagaggagttcacacggaaggtgcgctctaatgctgccatcggagctgtctttgtggacgagaaccagtggaatagcgccaaagaggccgttgaagatgagagattctgggaccttgtgcatcgggaacgcgagctgcacaagcagggcaaatgcgcgacctgcgtctacaacatgatggggaagagagagaaaaagctcggagagtttggcaaggctaaagggtcccgggccatttggtacatgtggctgggcgcccgcttcctggagttcgaagctctcggatttatgaatgaggatcactggttctctagagaaaacagcctgtccggcgtggagggggagggacttcataagctgggctatatcctccgggacatttctaaaatccctgggggaaatatgtacgccgatgacacagctggctgggatacccgcatcacagaagacgatctgcagaacgaggccagaattaccgacatcatggaacccgagcacgcgcttctggccaagagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgaacctggctgaacgggtgcttgattggctggagaagtatggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaacgccatttgttccgctgtgcccgttgattggatcccgacatctagaaccacgtggagcattcacgcccatcaccagtggatgaccacagaagacatgctgtccgtgtggaatcgggtctggatcgaggaaaacccttggatggaggataagacccatatcagctcttggggagacgtgccctacctcggcaaaagagaggaccaatggtgcgggtccctgattggacttacagcccgcgctacctgggccacaaatatccaggttgcgattaaccaggtgcggagactgatcggcaatgaaaactacctcgattatatgaccagcatgaagcgcttcaaaaatgagtctgaccccgaaggggctctgtggtga

SEQ ID NO: 18939 - RNA, 9879 nt, synthetic construct
  misc_feature 1..9879: note = derived and/or modified CDS sequence (opt5) from DENV-1__FJ410232__SS-prME
  source 1..9879: mol_type = other RNA
agcgtgaccatgctgctcatgctgatgcccacagcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgacagccctttttctggcgcatgccatcgggacctctattacccagaagggaatcatcttcattctcctgatgcttgtcacacctagcatggctatgagatgcgtgggcatcgggtcccgggattttgttgagggactgagcggcgccacgtgggtggacgtcgtgctcgagcacgggtcttgtgtgaccacaatggctaaggataaacccaccctggacattgaactgctcaagacagaggtcaccaaccctgccgttctgcgcaaactttgcatcgaagcgaagatttccaatacgacaaccgatagcagatgtccgacccaaggagaggccacactggtggaagaacaggacgctaacttcgtgtgccggcgcacctttgtcgatagaggctggggcaatgggtgtggactcttcggcaaagggtctctgatcacatgcgccaagtttaagtgcgtgacgaaacttgagggaaagattgttcagtacgaaaacctgaaatattccgtgatcgtcaccgtgcacacaggcgaccagcatcaagttgggaatgagagcaccgaacacggaacaaccgctacgatcacaccccaggcccctacaaccgagattcagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcttccacatctcaagagacctggaatcgccaggacctgctcgtgaccttcaaaacagcgcacgccaagaagcaggaagtcgtggttctgggaagccaagagggcgctatgcacacggccctgaccggggccacagaaatccagacctccggaacaaccacgatttttgctggccatctcaaatgcagactgaagatggataaacttacactgaaggggatgagctatgtgatgtgtaccggctctttcaaactcgagaaggaagtcgccgagacccagcacggaacagtgctggttcagatcaagtacgagggcaccgacgcgccgtgcaaaattcctttctccacacaagatgaaaagggggtgacgcagaacggacggctgatcaccgctaatcccatcgtcacagacaaagagaagcctgtgaacattgaagccgagccgccctttggcgagagctatatcgtgattggggccggagaaaaagctcttaagctctcttggttcaagaaaggcagctccatcgggaagatgtttgaggccaccgctagaggcgcccgccggatggcgattctgggagatacagcctgggacttcggctctatcgggggagtttttaccagcgtcggcaaactggtgcatcagatcttcgggacggcttacggagtgctcttttccggcgtcagctggaccatgaagattgggatcggcgtgctgcttacatggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacaaatgaggtccacacctggacggaacaatataagtttcaggccgactcccctaaacggctgtctgcggccatcggcaaggcttgggaggagggggtgtgcggcattagaagcgccacacgcctcgaaaacatcatgtggaaacagatctccaacgagctgaatcatattcttctggaaaacgacatgaagctcaccgttgtggtcggagatgtggctggcatcctggggcagggcaagaaaatgattcggccgcaacccatggagtacaaatattcttggaaaagctggggcaaggccaagatcattggggccgacgctcagaataccacattcatcatcgatggacctaacacccccgaatgtcctgacgatcagagagcgtggaatatttgggaggtggaggactacggctttggcatcttcacgacaaacatttggctgaaacttcgcgattcctatacccaggtctgcgaccaccggctcatgagcgccgctatcaaagattctaaggccgttcacgccgacatggggtactggattgaatccgagaaaaatgaaacatggaagctggctagagccagctttatcgaggtgaagacctgtatctggcccaaatctcatacactgtggtccaacggagtgctcgaaagcgagatgattatcccgaagatttatggcgggcctatctctcaacacaattaccgccccggatacttcacccagacggcgggcccttggcatctggggaaacttgagctggatttcgacctctgcgaaggaaccacagtcgtggttgatgagcactgcggcaaccggggccccagcctgagaaccacaaccgtgacggggaagattatccacgaatggtgttgccggtcctgtacactgcctccccttcgctttagaggagaggacggctgctggtatgggatggagatccggccggtcaaagaaaaggaggaaaatctcgtcaagagcatggtttctgctggatccggcgaggtggacagcttctccctggggctgctctgtatttctatcatgattgaagaggtcatgagaagccgctggtcccggaaaatgctgatgaccggaacacttgccgtgtttttcctgctcatcatgggccagctgacctggaacgatctgattagactttgcatcatggttggcgccaatgcttctgaccgcatggggatgggaaccacatacctggccctcatggcgacgtttaagatgagacctatgttcgctgtgggcctgctctttcggcgcctgaccagcagagaggtccttctgctcacaattgggctgtccctggtggcctctgtggaacttcccaacagcctggaggaactcggagatggcctggccatggggatcatgatcctcaaactgcttaccgacttccaatcccatcagctgtgggctacactcctgagcctgacctttattaagacgacattctctcttcactatgcctggaaaaccatggctatggtcctgtccatcgttagcctctttcccctgtgtctctctaccacatcccagaagaccacatggctgcctgtgcttctgggaagcctgggctgcaagccgctcacgatgttcctgattgccgagaataaaatctggggccggaagtcttggccccttaacgaagggattatggcggtgggaatcgtctccatcctgctcagctccctgctcaaaaacgatgtgcctctggccggcccccttattgctgggggaatgctgatcgcctgttacgttattagcggctctagcgctgacctgtccctcgagaaggccgccgaggtgtcttgggaagaggaagctgagcatagcggggcgtcccacaatatcctggtcgaagtgcaggatgacggaaccatgaaaattaaggatgaggagcgcgacgatacacttaccatcctgctcaaagccacactgctcgctgtttctggcgtgtatcctctgagcatccccgccaccctttttgtctggtacttctggcaaaagaagaaacagagatccggcgtgctgtgggacacgccttctcccccggaagtcgagcgggccgtgctggatgacgggatttatcgcatcatgcagagaggactcctgggccggagccaggttggggtgggagtcttccaagaaaacgtgtttcataccatgtggcacgttacacgcggcgctgtgcttatgtaccaggggaagagactggagccttcctgggccagcgtcaaaaaggacctcatttcttacggaggcggctggcggctgagagggtcctggaataccggagaggaagtccaggtgatcgcggttgagcccggcaaaaaccctaagaatgtccagacagctcccgggaccttcaagacaccggaaggagaggtgggcgccattgccctcgattttaaacctgggacgagcggatctcccatcgtgaaccgcgaaggcaagattgtcggcctgtatgggaatggagtggttaccacatccggcacctacgtgagcgctatcgcccaagcgaaggcttcccaggaggggcctcttcccgagatcgaagacgaggtcttccggaagagaaacctgaccattatggatctgcaccccggatctggcaaaacacgccggtatctccctgccatcgtgagagaagccattaagcgcaagctgcggacgcttatcctggctccgaccagagttgtggccagcgagatggctgaagccctcaaagggatgcccattcgctaccagacaaccgcggtcaagtccgagcatacaggcaaagagatcgtggacctgatgtgccacgccacctttacgatgcggctgctcagccctgttagagtgcccaattataacatgatcattatggatgaagctcatttcacagacccttcttccatcgccgctcggggatacattagcacccgcgtcggcatgggggaggccgccgctatctttatgaccgcgacaccccctggatctgtggaagccttcccgcaaagcaatgctgtgattcaggatgaggaaagagacatccccgagcggtcctggaactctggctatgagtggatcaccgattttcctgggaagacagtctggttcgttcccagcattaaatccggaaatgacatcgccaactgtcttcgcaagaatggcaagagagtgattcagctgtctcggaaaacctttgatacggaataccagaagaccaagaacaacgactgggactacgtggtcaccacagatatcagcgagatgggggccaatttcagagctgaccgcgtgattgatcctcggagatgcctgaagcccgttatcctcaaagacggcccggaacgcgtgattctggccggacctatgcccgtcaccgtggcgtccgctgcccaacggagaggccgcatcgggcggaaccacaataaggagggagatcagtatatctacatgggccagccccttaacaatgacgaggatcatgcccactggacggaagctaagatgctgctcgacaacattaatacccctgaggggatcattcccgccctgttcgaacctgagagagagaaaagcgcggccgttgatggagagtatcgcctgagaggcgaggctcggaagacatttgtggaactcatgcgcagaggggaccttccggtctggctgtcttacaaagtggcctccgagggcttccagtatagcgatcggcgctggtgctttgacggagaaagaaacaatcaagtcctggaggaaaacatggatgtggagatctggaccaaggagggcgaacggaaaaagctcagaccccgctggctggacgctcggacatactccgaccctcttgccctgagagagttcaaagaatttgctgccgggcgccggtctgttagcggagatctcattctggagatcggcaagctgccccagcacctcacccagagagcgcagaatgcccttgacaacctggtgatgctgcataattccgaacaagggggacgggcttatcgccacgccatggaggagctccctgatacaatcgaaaccctgatgcttctggctctcattgccgtgctgacgggcggcgtcacactgttctttctctctgggagaggacttggcaagaccagcatcgggctgctgtgtgttatggcctccagcgtgctcctgtggatggcttctgtggagccccattggattgcggcctccatcattcttgagttctttctgatggtcctcctgatcccggagcctgaccggcagcgcacaccccaggataaccagctggcttacgtggttatcggactccttttcatgattctgacagtggccgccaatgagatgggcctgctcgaaaccaccaaaaaggacctggggatcggacacgtcgctgtggagaaccaccatcacgccgcgatgcttgatgtcgacctgcatcctgccagcgcttggacgctctacgccgtggctaccacaattatcacccccatgatgagacacacaattgaaaacaccacggccaatatctctctgaccgcgattgccaaccaagctgccatcctgatgggcctcgataaaggctggcctatctccaagatggacattggggttccccttctggctctgggatgctatagccaggtgaatccgctcacactgaccgccgctgtccttatgctggtggcccattacgcgatcattggccctgggctccaggccaaagctacacgggaggcccaaaagcgcaccgctgccggaatcatgaagaaccccacggttgatggcattgtggccatcgacctggatcccgtcgtgtatgacgcgaaatttgaaaagcagctggggcagatcatgctccttattctgtgtacatctcagatcctgctcatgagaaccacatgggctctgtgcgagagcattacccttgccaccggacctctgacaacgctctgggagggctccccgggcaaattctggaataccacaatcgctgtgtctatggccaacatttttcgggggagctacctggccggagctggcctggccttctccctcatgaaaagccttgggggaggccgcagagggaccggagcgcaaggcgaaacactgggcgagaaatggaagcggcagctgaatcagctctccaagtctgagttcaacacctataaaagaagcgggatcatggaggttgaccgctccgaagccaaggagggactgaaacggggcgagacgacaaagcacgctgtctctagagggaccgccaaacttcgctggtttgtggaacggaatctggtgaagcccgagggaaaggtcatcgatctcggctgtgggagaggaggctggagctactattgcgctggcctgaaaaaggttaccgaagtgaaagggtacacaaagggaggccctgggcacgaggaacccattcctatggccacctacggatggaacctggtgaaactccattccggcaaggacgtcttctttattccccctgagaaatgtgatacacttctgtgcgacatcggggagtctagcccgaatcccacgatcgaagagggacgcaccctgcgggtgctcaagatggttgaaccttggctgagaggcaaccagttctgtattaagatccttaatccctatatgccttccgtggtcgagacactggagcaaatgcagcgcaaacacggcgggatgctcgtgcggaaccccctgagcagaaattctacccatgaaatgtactgggtttcctgcggaacaggcaacattgtgagcgcggtcaatatgacctctcgcatgctgctcaaccggtttacgatggcccacagaaagccgacctatgagcgcgatgtggacctggggacaggaaccagacacgtggctgtcgaacctgaggttgccaaccttgatatcatcggccagcggattgaaaatatcaaacatgagcacaagtccacatggcattacgacgaggataacccctataaaacctgggcttaccacgggagctatgaagtgaagccctctggatccgccagctccatggtgaatggcgtcgtgaagctgctcacaaaaccttgggacgttattcccatggtgacccagatcgctatgacggatacaacccctttcggccaacagcgcgtctttaaggagaaagtggacaccagaacaccgaaggccaaacgggggacggcgcagattatggaagttaccgccagatggctgtggggattccttagccggaacaagaagccccgcatctgtacaagagaggaatttacccggaaagtgcgctctaatgctgccatcggcgctgtcttcgtggacgagaaccaatggaatagcgccaaggaggccgttgaagatgagagattttgggacctggtgcatcgggaacgcgagctccacaaacaggggaagtgcgcgacatgcgtctacaacatgatgggaaaaagagaaaagaagctgggcgagttcgggaaagctaagggctcccgggccatttggtacatgtggctgggagcccgctttctcgagttcgaagctctgggcttcatgaatgaggatcactggttttctagagaaaacagcctttccggggtggagggagagggcctgcataaactcgggtatatcctgcgggacatttctaagatccctggaggcaatatgtacgccgatgacaccgctgggtgggatacacgcattaccgaagacgatcttcagaacgaggccaaaatcacggacatcatggaacccgagcacgcgctgctcgccaaggctattttcaaactgacctatcagaataaggtcgtgagagttcaacggcctgccaagaacggcacagtgatggatgtcatcagccgcagagaccagcggggatccggccaggtggggacctacggactgaatacatttaccaacatggaagctcagctcattagacaaatggagtctgagggcatcttcagcccctccgaactggagacgccgaaccttgccgaacgcgcgctggattggctcgagaaatatggggtggaacggctgaagagaatggccattagcggagacgactgtgttgtgaaacctatcgatgaccgctttgctacagcccttaccgctctgaatgatatgggcaaggtccggaaagacatcccccagtgggagccttctaaggggtggaacgattggcaacaggtgcccttctgctcccatcactttcaccaactcattatgaaggacggcagagagatcgttgtgccttgtcgcaatcaggatgaactggtcggacgggccagagtgagccagggcgctgggtggtctctgcgcgagacagcctgcctcggaaaatcctacgcgcagatgtggcaactgatgtatttccatcggagagaccttcgcctggccgctaacgccatttgtagcgccgtccccgtggattgggttccgacctcccggacgacctggtctatccacgctcatcaccagtggatgacaaccgaagacatgctcagcgtgtggaatagagtctggattgaggaaaacccttggatggaggataagacacatatctccagctgggaggacgtgccctacctgggcaaacgggaagaccagtggtgcgggtctcttattggactgaccgccagagcgacatgggctaccaatatccaagttgccatcaaccaggtgcgccggctcattggcaatgagaactacctggattatatgacgtccatgaagagatttaaaaatgaaagcgaccccgagggggccctgtggtga

SEQ ID NO: 18940 - RNA, 9879 nt, synthetic construct
  misc_feature 1..9879: note = derived and/or modified CDS sequence (opt5) from DENV-1__FJ461327__SS-prME
  source 1..9879: mol_type = other RNA
agcgtgaccatgctgctcatgctgatgcccaccgcccttgctttccacctgacgaccagaggaggggaacctcatatgattgtctccaagcaggaacggggaaaatctctcctgtttaagaccagcgccggcgttaacatgtgcacccttattgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatgggactggataaaggctggcctatctccaagatggacatgggcgttcccctccttgctctggggtgctatagccaggtgaatccgctgaccctcacagccgctgtcctgatgcttgtggcccattacgcgattatcggacctggcctgcaagccaaagctacccgcgaggcccagaagagaacagctgccgggattatgaaaaaccccaccgttgatggaatcgtggccatcgacctcgatcccgtcgtgtatgacgcgaagttcgaaaagcagctgggccagattatgctgctcatcctttgtacgtctcaaattctgctgatgcggacaacctgggctctctgcgagagcatcacactggccaccgggcctcttaccacactgtgggagggatccccgggcaaattttggaatacgaccattgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcatcatggaggttgaccggtccgaagccaaggaggggctcaaaagaggagagaccacgaagcacgctgtctctcgcggcacagccaaactgcggtggttcgtggaaagaaatcttgtgaagcccgaggggaaagtcattgatctgggatgtggccgcgggggatggagctactattgcgctggcctcaagaaggttaccgaagtgaaaggctacaccaaaggcgggcctgggcacgaggaacccatccctatggccacatacgggtggaacctggtgaaactgcattccggaaaggacgtctttttcattccccctgagaaatgtgataccctcctttgcgacatcggcgagtctagcccgaatcccacaattgaagaggggcggacgctgagagtgctgaagatggttgaaccttggctccgcggaaaccaattttgtatcaaaattctgaatccctatatgccttccgtggtcgagacccttgagcagatgcagcggaagcacggcggcatgctggtgagaaaccccctcagccgcaattctacacatgaaatgtactgggtttcctgcgggaccggaaacatcgtgagcgcggtcaatatgacatctcggatgctgctgaacagattcaccatggcccaccgcaagccgacgtatgagagagatgtggacctcggcgctgggacccggcacgtggccgtcgaacctgaggttgctaacctggatatcattggacagcgcatcgaaaatattaaacatgagcacaagtccacatggcattacgacgaggataacccctataaaacctgggcctaccacggcagctatgaagtgaagccctctgggtccgctagctccatggtgaatggagtcgtgaaacttctgacaaagccttgggacgttatccccatggtgacccaaattgccatgacagataccacgccttttggccagcagagagtcttcaaggagaaagtggacacacggaccccgaaggcgaaaagaggcaccgcccaaatcatggaagttacagctaagtggctctgggggtttctgagccggaacaaaaagccccgcatctgtacgagagaggagttcacccggaaggtgcgctctaatgccgctattggagccgtctttgtggacgagaaccagtggaatagcgccaaagaggcggttgaagatgagagattctgggaccttgtgcatcgggaacgcgagctgcacaagcagggcaaatgcgctacatgcgtctacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtggagggggagggacttcataagctgggctatattctccgggacatctctaaaattcctgggggaaatatgtacgctgatgacaccgccggctgggatacacgcatcaccgaagacgatctgcagaacgaggcgagaatcacagacattatggaacccgagcacgcccttctggctaagagcatctttaaactcacctatcaaaataaggtcgtgcgggttcagcgccctgccaaaaacgggacggtgatggatgtcatttccagacgggaccagagaggctctggacaggtgggcacctacgggctgaatacattcaccaacatggaagctcaactgatccgccagatggagagcgagggaatcttttcccccagcgaactcgagacaccgaacctggccgaacgggtgcttgattggctggagaagtatggcgttgaaagactcaagcgcatggcgatctctggggacgactgtgtggtcaaacctatcgatgaccggttcgccaccgctctgacggcccttaatgatatgggaaaggtgagaaaagacattccccagtgggagccttccaagggctggaacgattggcagcaagttcccttttgcagccatcacttccaccagctgatcatgaaagacgggcgcgagattgtggtcccttgtcggaatcaggatgaactcgtgggcagagctcgcgtctctcagggagccggctggtccctgcgggagacagcttgcctgggaaagagctacgcccaaatgtggcagctcatgtattttcatagacgcgacctgcggcttgcggccaacgctatctgttccgccgtgcccgttgattggattccgacctctagaacaacctggagcatccacgcccatcaccagtggatgacgaccgaagacatgctgtccgtgtggaatcgggtctggattgaggaaaacccttggatggaggataagacacatatcagctcttggggagacgtgccctacctcggcaaaagagaggaccaatggtgcgggtccctgatcggacttaccgctcgcgccacatgggcgaccaatattcaggttgctatcaaccaggtgcggagactgattggcaatgaaaactacctcgattatatgacaagcatgaagcgcttcaaaaatgagtctgaccccgaaggggccctgtggtga

SEQ ID NO: 18941 - RNA, 9879 nt, synthetic construct
  misc_feature 1..9879: note = derived and/or modified CDS sequence (opt5) from DENV-1__FJ461328__SS-prME
  source 1..9879: mol_type = other RNA
agcgtgaccatgctgctcatgctgatgcccacggcccttgctttccacctgacgaccagaggaggggagcctcatatgatcgtctccaagcaggaacggggaaaatctctcctgtttaagaccagcgccggagttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacggagtgctgttttccggcgtcagctggacgatgaagattgggatcggcgtgcttctgacctggctcggactcaattctagatccacaagcctgtctatgacctgtattgccgttggccttgtgacactctacctgggggtcatggtgcaggctgactccggatgcgttatcaactggaaaggccgcgagctgaagtgtgggagcggaattttcgtgaccaatgaagtccacacatggaccgagcaatataagtttcaggccgattcccctaaacggctctctgcggccatcggcaaggcttgggaggaaggggtgtgcggcattagaagcgccacgcgcctggagaacatcatgtggaaacagatctccaacgaacttaatcatattctgctcgagaacgacatgaagttcacagttgtggtcggagacgtggctggcatcctggtgcaggggaaaaagatgattcggccgcaacccatggaatacaaatattcttggaaaagctggggaaaggccaaaatcattggcgccgatgtccaaaattccacctttatcatcgacgggcctaacacccccgagtgtcctgatgaccagagagcttggaatatttgggaggttgaagattacggattcggcatctttacaaccaacatttggctgaaacttcgcgacagctatacacaggtgtgcgatcaccggctcatgtctgcggccatcaaagactccaaggctgtgcacgccgatatgggctactggattgagagcgagaagaatgagacatggaagctggccagagcttctttcatcgaagtcaagacctgtatctggcccaaatcccatacactgtggagcaacggggtgctcgagtctgagatgattatcccgaagattcacggaggccctatcagccaacataattatcgccccgggtacttcacccagacagccggaccttggcacctgggcaaacttgaactggactttgatctctgcgaggggaccacggttgtggtcgacgaacactgcggaaaccggggcccctccctgagaaccacaaccgtgacaggcaagattatccatgagtggtgttgccggagctgtaccctgcctccccttcgcttcagaggggaggatggatgctggtacggcatggaaatccggccggttaaagagaaggaagagaatctcgtgaagtctatggtctccgcggggagcggagaagtggactccttttctctgggcctgctctgtattagcatcatgattgaggaggttatgagatcccgctggtctcggaaaatgctgatgacggggacacttgctgtgttctttctgctcatcatgggacagctgacctggaacgacctgattagactttgcatcatggtcggcgccaatgccagcgatcgcatgggcatggggacaacctatctggctctcatggccaccttcaagatgagacctatgtttgcggtgggactgctgttccggcgcctgacatccagagaagtgcttctgctcacgattggcctgtctctggtcgctagcgttgagcttcccaactccctggaagaactgggggacggactggccatgggcatcatgatcctcaaactgcttaccgattttcaaagctaccagctgtgggccacactcctgtctctgaccttcattaagacaaccttttcccttcactatgcttggaaaacgatggccatggtgctgagcatcgtgtctctcttccccctgtgtctctccacaaccagccagaagaccacatggctgcctgtccttctggggtctctgggatgcaagccgctcaccatgtttctgattgctgaaaataaaatctggggccggaagtcctggccccttaacgagggcattatggccgtggggatcgttagcatcctgctctccagcctgctcaaaaacgacgtgcctctggcgggaccccttattgccggcgggatgctgatcgcttgttacgtcatttctggaagctccgccgatctgtctctcgagaaggctgccgaagtgagctgggaggaagaggccgaacattccggcgcttctcacaatatcctggttgaggtgcaggacgatgggacaatgaaaattaaggacgaggaacgcgatgacacgcttaccatcctgctcaaagcgacactgctcgccgtcagcggagtgtatcctctgtccatccccgctacccttttcgtctggcatttctggcaaaagaagaaacagagatctggcgtgctgtgggatacacctagccctcccgaggttgaacgggccgtgctggacgatggcatttaccgcatcatgcagagagggctcctgggacggtcccaggtcggcgtgggggtttttcaagagaacgtgttccacaccatgtggcacgtcacgcgcggagccgtgcttatgtatcagggcaagagactggagcccagctgggcttctgtgaaaaaggacctcatttcctacgggggaggctggcggtttcagggcagctggaataccggggaagaggttcaggtcatcgccgtggaacccggcaagaaccctaagaatgtgcaaacagcgcccggcaccttcaagacaccggagggggaagtcggagctattgccctggactttaaacctggcacctctgggtcccccatcgtgaacagagagggaaagattgttggcctctacggcaatggggtggtcacaacgagcggaacctatgtgtccgccatcgctcaggccaaagcgtctcaggagggccctctgcccgaaatcgaggatgaagttttccgcaagcggaaccttacaattatggacctgcatcccgggagcggaaaaaccagacgctacctgcctgctatcgtgcgggaggccattaagagaaagctccgcaccctgatccttgccccgacacgggtcgtggcttccgaaatggccgaggctctgaaaggcatgcccattagatatcaaacgaccgccgttaagagcgagcacacagggaaagaaatcgtggatctcatgtgccatgcgacctttacaatgcgcctgctgtctcctgtccgggtgcccaattacaacatgatcattatggacgaggcccacttcaccgatccttccagcatcgctgccagaggctatatttctacgcgggtgggaatgggcgaagctgccgccatctttatgacagctacaccccctgggagcatggaggcgttcccgcagtccaatgccgtcattcaggacgaagaaagagatatccccgagagatcttggaacagcggatacgaatggatcaccgactttcctggcaagacagtttggttcgtgccctccattaaagctgggaatgatatcgccaactgtctccggaagaatggaaagcgcgtgattcagctttctagaaaaaccttcgacacagagtatcaaaagaccaaaaacaacgattgggactacgtcgtgacgacagacatcagcgaaatgggcgccaattttcgggctgatagagttattgaccctcgccggtgcctgaagcccgtgatcctgaaagatgggccggagagagtcattctcgccggccctatgcccgtgaccgttgcgtccgctgcccagcgccggggaagaatcggccgcaaccataataaggagggggaccagtacatctatatgggacagcccctgaacaatgatgaagaccacgcccactggacagaggctaagatgcttctggataacattaatacccctgaaggcatcattcccgccctcttcgagcctgaacgggagaaaagcgcggccatcgacggggagtacagactgcgcggagaagctagaaagacgtttgtggagctgatgcggcgcggcgatctcccggtctggctttcttataaagtggcctccgaagggttccaatacagcgacagacggtggtgctttgatggcgagcgcaacaatcaggtcctggaagagaacatggacgtggagatttggaccaaggaaggagagcgcaaaaagctgcggcccagatggctcgatgctcgcacatattccgaccctctggcccttcgggagttcaaagagtttgctgccggcagacgctctgttagcggggacctgatcctcgaaatcggaaagctgccccagcatctgacccagcgggcgcaaaatgccctcgataaccttgtgatgctgcacaattccgagcagggcgggagagcttaccggcatgccatggaggaactgcctgacacaattgagaccctcatgctgcttgctctgatcgccgtgctcacaggaggcgtcaccctgttctttctgtctggcaaggggctcggaaaaacgagcattggccttctgtgtgttatggcctccagcgtgctgctctggatggcttctgtggaaccccactggatcgcggcctccattatcctggagttctttcttatggtcctgctcatcccggagcctgatcgccagagaacaccccaggacaaccaactggcttatgtggttattgggctcctcttcatgatccttaccgtggccgccaatgaaatgggactgctggagaccacaaagaaagatctcggcattgggcacgtcgctgtggaaaaccatcaccatgccgcgatgctggacgtcgatcttcaccctgccagcgcttggaccctgtacgccgtggctacaacgatcattacccccatgatgcggcatacaatcgagaacaccacagccaatatttctctcaccgcgatcgccaaccaggctgccatcctgatgggactggacaagggctggcctatttccaaaatggatatcggcgttcccctccttgctctggggtgctacagccaggtgaatccgctgacgctcaccgccgctgtcctgatgcttgtggcccactatgcgattatcggacctggcctgcaagccaaggctacacgcgaagcccagaagagaaccgctgccgggattatgaaaaaccccacaatcgacggaatcgttgccattgatctcgaccccgtggtctacgatgcgaagtttgagaaacagctgggccagatcatgctgctcattctttgtacctctcaaatcctgctgatgcggacgacatgggctctctgcgagagcattaccctggccacagggcctcttaccaccctgtgggaaggatccccgggcaagttctggaatacaacgatcgctgtgtctatggccaacatcttccgcggcagctatctcgccggggctggactggccttttccctgatgaaaagcctcggcgggggaagacggggcaccggggcgcagggagagacacttggcgaaaagtggaagcgccagctgaatcagctgtccaaatctgagttcaacacctacaagagaagcggcattatggaagtggaccggtccgaggccaaagaggggctcaagagaggagaaacaaccaaacacgctgtttctcgcggcacggccaagctgcggtggtttgtcgagagaaatcttgtgaagcccgaagggaaagtgatcgacctgggatgtggccgcgggggatggagctattactgcgctggcctcaagaaagtcacagaggttaagggctataccaaagggggacctggccatgaggaacccattcctatggccacctacgggtggaacctggtgaagctgcactccggaaaagatgtgttctttattccccctgagaagtgtgacacactcctttgcgatatcggcgaatctagcccgaatcccaccatcgaggaagggcggacactgagagtcctgaagatggtggagccttggctccgcggaaaccaattctgtattaaaatcctgaatccctacatgccttccgttgtggagacgcttgaacagatgcagcggaagcatggcggcatgctggtcagaaaccccctcagccgcaattctacccacgagatgtattgggtgtcctgcgggacaggaaacatcgttagcgcggtgaatatgacctctcggatgctgctgaacagatttacaatggcccaccgcaaaccgacctacgaacgggacgtcgatctcggcgctgggacgagacatgtggccgtggagcctgaagtcgctaacctggacattatcggacagcgcattgagaatatcaagcacgagcataaatccacctggcactatgatgaagacaacccctacaagacatgggcctatcatggcagctacgaggttaagccctctgggtccgctagctccatggtgaatggagtggtcaaacttctgaccaagccttgggatgtgattcccatggttacacaaatcgccatgaccgacacaacccctttcggccagcagagagtgtttaaagaaaaggtcgatacgcggacaccgaaagcgaagcgcggcaccgcccaaatcatggaggtgaccgctagatggctctgggggttcctgagccggaacaagaaacccagaatttgtacacgggaagagtttacgcgcaaggttagatctaatgccgctatcggagccgtgttcgtcgacgagaaccagtggaatagcgccaaagaagcggtggaggacgatcggttttgggaccttgttcaccgcgaaagagagctgcacaagcagggcaaatgcgctacctgcgtgtataacatgatggggaagcgggaaaagaaactcggagagttcggcaaggccaaagggtcccgcgccatttggtacatgtggctgggcgctagattcctggagtttgaagccctcggattcatgaatgaggatcattggttttctcgggaaaacagcctgtccggcgtcgagggggagggacttcacaagctgggctacatcctccgcgacatttctaaaatccctgggggaaatatgtatgctgatgacacagccggctgggataccagaatcacagaagacgatctgcagaacgaggcgaagattaccgacatcatggaacccgagcatgcccttctggctaaaagcattttcaagctcacataccaaaataaggtggtccgggtgcagcgccctgccaaaaacgggaccgttatggatgtgatctccagacgggaccagcgcggctctggacaggtcggcacgtatgggctgaatacctttacaaacatggaagctcaactgattagacagatggagagcgagggaatcttcctccccaacgaactggagaccccgaatcttgccggccgggtgctggattggctcgaaaagtacggggtggagagactgaaacgcatggcgatctccggagacgactgtgttgtgaagcctattgatgaccggtttgccacagctcttaccgccctgaacgatatgggcaaagtcagaaaggacatcccccagtgggaacctagcaaggggtggaatgattggcagcaagtgcccttctgctctcaccactttcatcagctcattatgaaagacggccgcgagatcgttgtgccttgtcggaaccaggatgagctggtcggcagagctcgcgtgtcccagggcgccgggtggagcctgcgggaaacggcttgcctcggaaagtcttatgcccaaatgtggcagctgatgtacttccacagacgcgaccttcggctggcggccaatgctatttgttccgccgtccccgtggattgggttccgacaagcagaaccacatggtccatccatgcccaccatcagtggatgaccacggaggacatgctctctgtgtggaaccgcgtctggattgaagagaatccttggatggaagataaaacccggatcagctcctgggaggacgtgccctatctgggcaagagagaggaccaatggtgcgggagccttatcggactgacagctcgggccacctgggcgacaaacattcaggttgctatcaatcaggtgagacgcctcattggcaacgaaaattactctgattacatgacctccatgaaacggtttaagaacgagagcgaacccgagggggccctgtggtga

SEQ ID NO: 18942 - RNA, 9879 nt, synthetic construct
  misc_feature 1..9879: note = derived and/or modified CDS sequence (opt5) from DENV-1__FJ410234__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaagatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccagctccctggaggaactcggagatggcctggccatggggatcatgattctcaaactgcttacagacttccaaagccatcagctgtgggctaccctcctgtctctgacatttatcaagaccgccttctcccttcactatgcttggaaaacgatggccatggtcctgagcattgtttctctctttcccctgtgtctctccacaaccagccagaagaccacatggctgcctgtgcttctgggatctctgggctgcaagccgctcaccatgttcctgatcgcggagaacaaaatttggggccggaagtcctggccccttaatgaagggatcatggccgtgggaatcgtcagcattctgctctccagcctgctcaaaaacgatgtgcctctggctggcccccttatcgccgggggaatgctgattgcttgttacgttatctctggcagctccgccgacctgtctctcgagaaggccgctgaggtgagctgggaagaggaagcggagcattccggggcctctcacaacattctggtcgaagtgcaggatgacggaacaatgaaaatcaaggatgaggagcgcgacgatacgcttaccatcctgctcaaagctacactgctcgccgttagcggcgtgtatcctctgtccattcccgccaccctttttgtctggtacttctggcaaaagaagaaacagagatctggcgtgctgtgggacacacctagccctcccgaagtcgagcgggctgtgctggatgacgggatctatcgcattatgcagagaggactcctgggccggtcccaggttggggtgggagtcttccaagaaaatgtgtttcataccatgtggcacgttacgcgcggcgccgtgcttatgtaccaggggaagagactggagcccagctgggcgtctgtcaaaaaggacctcatctcctacggaggcggctggcggctgagagggagctggaacaccggagaggaagtccaggtgattgctgttgagcccggcaaaaatcctaagaacgtccagacagcccccgggaccttcaagacaccggaaggagaggtgggcgccatcgctctcgattttaaacctgggacctctggatcccccattgtgaatcgcgaaggcaagatcgtcggcctgtatgggaacggagtggttacaacgagcggcacctacgtgtccgccatcgcgcaagctaaagcctctcaggaggggcctcttcccgagattgaagacgaggtcttccggaagagaaatctgacaatcatggatctgcaccccggaagcggcaaaacccgccggtatctccctgccattgtgagagaagctatcaagcgcaagctgcggacccttattctggccccgacaagagttgtggcttccgagatggccgaagcgctcaaagggatgcccatccgctaccagacgaccgccgtcaagagcgagcatacaggcaaagagatcgtggacctgatgtgccacgctacctttacaatgcggctgctctctcctgttagagtgcccaactataatatgattatcatggatgaagcccatttcaccgacccttccagcattgctgcccggggatacatctctacgcgcgtcggcatgggggaggccgctgcgatttttatgacagccacaccccctggaagcgtggaggctttcccgcaatccaacgccgtgatccaggatgaggaaagagacatccccgagcggtcttggaatagcggctatgagtggattaccgattttcctgggaagacagtctggttcgttccctccatcaaatctggaaacgacattgccaattgtcttcgcaagaacggcaagagagtgatccagctgagccggaaaacctttgatacagaataccagaagaccaaaaataacgactgggactacgtggtcacgacagatatttccgagatgggggctaacttcagagccgaccgcgtgatcgatcctcggagatgcctgaagcccgttattctcaaagacggcccggaacgcgtgatcctggcgggacctatgcccgtcaccgtggctagcgccgcccaacggagaggccgcatcgggcggaatcacaacaaggagggagatcagtatatttacatgggccagccccttaataacgacgaggatcatgctcactggacagaagccaagatgctgctcgacaatatcaacacccctgaggggattatccccgcgctgttcgaacctgagagagaaaaatctgccgctgttgatggagagtatcgcctgagaggcgaggcccggaagacgtttgtggaactcatgcgcagaggggaccttccggtctggctgtcctacaaagtggctagcgagggcttccagtattccgatcggcgctggtgctttgacggagaaagaaataaccaagtcctggaggaaaatatggatgtggagatttggaccaaggagggcgaacggaaaaagctcagaccccgctggctggacgcccggacatactctgaccctcttgctctgagagagttcaaagaatttgccgcggggcgccggagcgtttccggagatctcatcctggagatcggcaagctgccccagcacctcacccagagagcccagaacgctcttgacaatctggtgatgctgcataactctgaacaagggggacgggcctatcgccacgctatggaggagctccctgatacaattgaaaccctgatgcttctggccctcatcgccgtgctgacaggcggcgtcaccctgttctttctcagcgggagaggacttggcaagacgtccattgggctgctgtgtgttatggctagctctgtgctcctgtggatggcgtccgtggagccccattggatcgccgctagcattatccttgagttctttctgatggtcctcctgatcccggagcctgaccggcagcgcacaccccaggataatcagctggcctacgtggttattggactccttttcatgatcctgaccgtggccgctaacgagatgggcctgctcgaaaccaccaaaaaggacctggggattggacacgtcgccgtggagaatcaccatcacgcggccatgcttgatgtcgacctgcatcctgcttctgcctggaccctctacgctgtggccacaacgatcattacccccatgatgagacacacaatcgaaaacaccacagcgaacatttccctgaccgccatcgctaatcaagccgctatcctgatgggcctcgataaaggctggcctattagcaagatggacatcggggttccccttctggccctgggatgctattctcaggtgaacccgctcacgctgaccgctgccgtccttatgctggtggcgcattacgccattatcggccctgggctccaggctaaagccacacgggaggctcaaaagcgcaccgccgccggaattatgaagaatcccacagttgatggcatcgtggcgatcgacctggatcccgtcgtgtatgacgctaaatttgaaaagcagctggggcagattatgctccttatcctgtgtaccagccagattctgctcatgagaacgacatgggccctgtgcgagtccatcacccttgctacaggacctctgaccaccctctgggagggctctccgggcaaattctggaacacaacgattgccgtgagcatggccaatatctttcgggggtcctacctggctggagccggcctggcgttcagcctcatgaagtcccttgggggaggccgcagagggaccggagcccaaggcgaaacactgggcgagaaatggaagcggcagctgaaccagctctctaagagcgagttcaatacctataaaagatccgggatcatggaggttgaccgctctgaagctaaggagggactgaaacggggcgagacaaccaagcacgccgtcagcagagggacggctaaacttcgctggtttgtggaacggaacctggtgaagcccgagggaaaggtcattgatctcggctgtgggagaggaggctggtcctactattgcgccggcctgaaaaaggttacagaagtgaaagggtacaccaagggaggccctgggcacgaggaacccatccctatggcgacctacggatggaatctggtgaaactccattctggcaaggacgtcttctttattccccctgagaaatgtgatacacttctgtgcgacatcggggagagctccccgaaccccaccattgaagagggacgcacactgcgggtgctcaagatggttgaaccttggctgagaggcaatcagttctgtatcaagattcttaacccctatatgcctagcgtggtcgagacgctggagcaaatgcagcgcaaacacggcgggatgctcgtgcggaatcccctgtctagaaactccacccatgaaatgtactgggttagctgcggaacaggcaatatcgtgtctgccgtcaacatgacctcccgcatgctgctcaatcggtttacaatggctcacagaaagccgacctatgagcgcgatgtggacctggggacgggaaccagacacgtggccgtcgaacctgaggttgctaaccttgatatcattggccagcggatcgaaaacattaaacatgagcacaagagcacatggcattacgacgaggataatccctataaaacctgggcctaccacgggtcttatgaagtgaagccctccggaagcgcttccagcatggtgaacggcgtcgtgaagctgctcacaaaaccttgggacgttatccccatggtgacccagattgccatgacagataccacgcctttcggccaacagcgcgtctttaaggagaaagtggacacaagaaccccgaaggcgaaacgggggaccgcccagatcatggaagttacagctagatggctgtggggattcctttctcggaataagaagccccgcatctgtacgagagaggaatttacccggaaagtgcgcagcaacgccgctattggcgccgtcttcgtggacgagaatcaatggaactccgccaaggaggcggttgaagatgagagattttgggacctggtgcatcgggaacgcgagctccacaaacaggggaagtgcgctacatgcgtctacaatatgatgggaaaaagagaaaagaagctgggcgagttcgggaaagccaagggctctcgggccatctggtacatgtggctgggagctcgctttctcgagttcgaagccctgggcttcatgaacgaggatcactggtttagcagagaaaattccctttctggggtggagggagagggcctgcataaactcgggtatattctgcgggacatcagcaagattcctggaggcaacatgtacgctgatgacaccgccgggtgggatacacgcatcaccgaagacgatcttcagaatgaggcgaaaatcacagacattatggaacccgagcacgccctgctcgctaaggccatcttcaaactgacctatcagaacaaggtcgtgagagttcaacggcctgctaagaatggcacggtgatggatgtcatttcccgcagagaccagcggggatctggccaggtggggacctacggactgaacacatttaccaatatggaagcccagctcatcagacaaatggagagcgagggcattttctcccccagcgaactggagacaccgaaccttgcggaacgcgccctggattggctcgagaaatatggggtggaacggctgaagagaatggctatctctggagacgactgtgttgtgaaacctatcgatgaccgctttgccaccgctcttacggccctgaacgatatgggcaaggtccggaaagacattccccagtgggagccttccaaggggtggaatgattggcaacaggtgcccttctgcagccatcactttcaccaactcatcatgaaggacggcagagagattgttgtgccttgtcgcaaccaggatgaactggtcggacgggctagagtgtctcagggcgccgggtggtccctgcgcgagacagcgtgcctcggaaaaagctacgcccagatgtggcaactgatgtatttccatcggagagaccttcgcctggctgccaatgccatctgttccgctgtccccgtggattgggttccgacctctcggacaacctggagcattcacgcccatcaccagtggatgacgaccgaagacatgctctccgtgtggaacagagtctggatcgaggaaaatccttggatggaggataagacacatattagctcttgggaggacgtgccctacctgggcaaacgggaagaccagtggtgcgggtcccttatcggactgaccgcgagagctacatgggccaccaacatccaagttgccattaatcaggtgcgccggctcatcggcaacgagaattacctggattatatgacaagcatgaagagatttaaaaacgaatctgaccccgagggggctctgtggtga

SEQ ID NO: 18943 - RNA, 9879 nt, synthetic construct
  misc_feature 1..9879: note = derived and/or modified CDS sequence (opt5) from DENV-1__FJ410235__SS-prME
  source 1..9879: mol_type = other RNA
agcgtgacaatgctgctgatgctgatgcccacagcccttgctttccacctgacgaccagaggcggggaacctcatatgatcgtctccaagcaggaacgggggaaatctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacgaccaatcccatcgtcacagacaaggagaaacctgtgaacattgaagctgagccgcccttcggcgagtcttatatcgtgattggggccggagaaaaggccctgaaacttagctggtttaaaaagggctcctctatcgggaaaatgttcgaggctaccgccagaggcgctcgccggatggccattctcggagatacagcgtgggactttggcagcatcgggggagttttcacctccgtcggcaagctggtgcatcagatctttgggacggcctacggagtgctgttcagcggcgtctcttggaccatgaaaattgggatcggcgtgctcctgacatggcttggactcaattccagaagcacctctctctccatgacatgtattgctgttggcctggtgaccctgtaccttggggtcatggtgcaggccgatagcggatgcgttatcaactggaagggccgcgaactcaagtgtgggtccggaatttttgtgacaaatgaggtccacacctggacggaacagtataaattccaagctgactctcctaagcggctgagcgccgcgatcggcaaagcctgggaggagggggtgtgcggcattagatccgctacacgcctggaaaacatcatgtggaagcagatctctaacgagctcaatcatattctgcttgaaaacgacatgaaatttaccgttgtggtcggagatgtggccggcatcctggctcaggggaagaaaatgattcggccgcagcccatggagtacaagtatagctggaagtcctggggaaaagccaagatcattggcgccgacgtgcaaaataccacattcatcatcgatgggcctaacacccccgaatgtcctgacgatcagagagcttggaatatttgggaggtcgaggactacggatttggcatcttcacgacaaacatttggctcaaactgcgcgatagctatacccaggtttgcgaccaccggctgatgtctgcggccatcaaggattccaaagctgtgcacgccgacatgggctactggattgaaagcgagaagaatgaaacatggaaacttgccagagcttctttcatcgaggtgaaaacctgtatctggcccaagtcccatacactctggagcaacggggtcctggaatctgagatgattgtgccgaaaatctatggaggccctattagccagcacaattaccgccccgggtactttacccaaacggccggaccttggcatctgggcaagctcgagctggatttcgacctttgcgaagggaccacagttgtggtcgatgagcactgcggaaaccggggcccctccctgagaaccacaaccgtgacgggcaaaatcattcacgaatggtgttgccggagctgtacactccctcccctgcgctttaagggggaggacggatgctggtatggcatggagatcagaccggttaaggaaaaagaggaaaatctggtgaagtctatggtctccgcggggagcggagaggtggactccttctctcttggcctcctgtgtatcagcattatgatcgaagaggttatgcggtccagatggtctcgcaaaatgctgatgaccgggacactcgctgtgtttttcctgcttattatgggacagctgacctggaacgatctcatccggctgtgcattatggtcggcgccaatgccagcgacagaatgggcatggggaccacatacctggctcttatggccacgtttaagatgcgccctatgttcgcggtgggactgctctttagacggctgacctcccgcgaggtgctcctgcttacaatcggcctgtctctcgtcgctagcgttgaactgcccaactccctggaggaacttggggatggactggccatgggcattatgatcctcaaactgctcaccgacttccagagccatcaactgtgggccacacttctgtctctcacctttatcaagacgacattctccctgcactatgcttggaagaccatggccatggtgctgagcattgtgtctctttttcccctgtgtctctccaccacaagccagaaaaccacatggctgcctgtcctcctggggtctcttggatgcaagccgctgacgatgttcctgatcgctgagaataaaatttggggcagaaagtcctggcccctcaacgaaggcatcatggccgtggggattgttagcatcctgctttccagcctgctcaaaaacgatgtgcctctggcgggacccctcatcgccggcgggatgctgattgcttgttacgtcatctctggaagctccgccgacctttctctggagaaggctgccgaggtgagctgggaagaggaagccgagcattccggcgcttctcacaatattctggttgaagtgcaggatgacgggaccatgaaaatcaaggatgaggagcgggacgatacactcaccattctgcttaaggcgacactgctcgccgtcagcggagtgtatcctctgtccatccccgctaccctcttcgtctggtacttttggcagaaaaagaaacaacgctctggcgtgctgtgggacacgccttcccctcccgaagttgagagagccgtgcttgatgacggcatctatcggattatgcagcgcgggctgctgggaagatcccaggtcggcgtgggggttttccaggaaaacgtgtttcataccatgtggcacgtcacacggggagccgtgctcatgtaccaaggcaagcgcctggagcccagctgggcttctgtgaaaaaggaccttatctcctacgggggaggctggagactgcagggcagctggaataccggggaggaagttcaggtcattgccgtggagcccggaaagaaccctaaaaatgtgcagacagcgcccggcaccttcaagacatctgaaggggaggtcggagctatcgccctcgattttaaaccgggcacgtccgggagccctattgtgaaccgggaaggaaagatcgttggcctgtatggcaatggggtggtcaccacatccggaacctacgtgtctgccattgctcaagccaaagcgagccaggagggccccctccctgagatcgaagacgaggttttcagaaagcgcaacctgaccatcatggatcttcaccccgggtccggaaagacacggagatatctgcccgctattgtgcgcgaagccatcaaacggaagctgagaacgctcattctggcccctacccgcgtcgtggctagcgagatggccgaagctcttaaaggcatgccgatccggtaccagacaaccgccgttaagtctgagcatacagggaaagagattgtggacctgatgtgccacgcgacctttacgatgagactcctgtcccccgtccgcgtgcctaattataacatgatcatcatggatgaagcccatttcacagaccccagctctattgctgcccggggctacatcagcaccagagtgggaatgggcgaggctgccgccatttttatgaccgctacacctcccgggtccgtcgaagcgttccctcaatctaatgccatcattcaggatgaggaacgggacatcccggagcgcagctggaactccggatatgagtggatcaccgattttcccggcaagacagtttggttcgtgccttctattaagagcgggaatgacatcgctaactgtctgcgcaagaatggaaagcgggtgattcagctctcccgcaaaaccttcgatacggaataccagaagaccaagaataacgactgggactacgtcgtgaccacagatatcagcgagatgggcgccaattttagagccgaccgggttattgatcccagacgctgccttaagcctgtgatcctgaaggacgggcccgaacgggtcattctggctggcccgatgcctgtgaccgttgcctctgcggctcaaagacgcggacggatcggcagaaaccacaataaagagggggatcagtatatctacatgggacagcccctcaacaatgacgaggatcatgcccactggacggaagccaagatgctgcttgacaacattaatacccccgagggcatcattcctgctctgttcgaacccgagcgcgaaaaatccgccgcgatcgatggggagtatcggctcagaggagaggcccgcaagacatttgtggaactgatgagacggggcgacctgcctgtctggctcagctacaaagtggcttccgaggggttccagtattctgatcgcagatggtgctttgacggcgaacggaacaatcaagtccttgaggaaaacatggatgtggagatttggaccaaggagggagaacgcaaaaagctgagaccgcggtggctggacgccagaacatacagcgaccccctcgctctgcgcgagttcaaggaatttgccgctggccggagatccgtttctggggatcttatcctggagatcggaaaactccctcagcacctgacccagcgcgcccagaatgcgctggacaacctcgtgatgcttcataatagcgaacaaggcgggcgggcctatagacacgctatggaggagctgcccgatacaattgaaaccctgatgctcctggcccttatcgctgtgctgacgggaggcgtcacactcttctttctgtccggccgggggctgggaaagaccagcattggcctcctttgtgttatggcctcttccgtgctgctgtggatggccagcgtggagcctcattggatcgctgcgtctattatcctcgagttctttctgatggtccttctgatccccgagccggaccgccagagaacccctcaggataaccagctcgcctacgtggttattgggctgctgttcatgatcctcacagtggctgccaatgagatgggacttctggaaaccaccaagaaggacctgggcattgggcacgtcgccgtggagaaccaccatcacgctgccatgctcgatgtcgacctgcatcccgcgtccgcctggacgctttacgctgtggccaccacaatcattacccctatgatgcggcacacaatcgaaaacaccacggctaatattagcctgaccgccatcgcgaaccaagccgctatcctcatgggactggataaaggctggcccatttctaagatggacatcggcgttcctctgctcgcccttgggtgctatagccaggtgaatcccctgacactgaccgctgccgtcctcatgctggtggctcattacgccattatcggaccgggccttcaggcgaaggccacacgcgaggctcagaaaagaaccgccgctgggattatgaagaaccctacggttgatggaatcgtggccatcgacctggatcccgtcgtgtatgacgccaaatttgaaaagcagctcggccagattatgctgctgatcctctgtacatcccagattcttctgatgcggaccacatgggcgctgtgcgagtctatcaccctcgctaccgggcccctgacaacgctttgggagggaagccctggcaaattctggaataccacaattgccgtgtccatggctaacatcttccgcggcagctacctggccggggccggactcgctttttccctgatgaagtctctgggcgggggaagacggggcaccggggcccaaggagaaacactcggcgagaagtggaaacgccagcttaatcagctgggcaagagcgagttcaacacctataaaagatccgggatcatggaggttgaccggtctgaagcgaaggagggactgaaaagaggcgagacgacaaagcacgccgtcagccgcgggaccgctaagctccggtggtttgtggaaagaaatctggtgaaaccggagggaaaggtcattgatcttggctgtgggcgcggaggctggtcctactattgcgccggcctgaaaaaggttaccgaagtgaaagggtacacaaagggaggccccgggcacgaggaacctatccccatggctacctacggatggaacctcgtgaaactgcattctggcaaggacgtcttctttattcctcccgagaagtgtgatacactgctctgcgacatcggggagagctcccctaatccgacgattgaagagggacggacccttagagtgctgaaaatggttgaaccctggctgcgcggcaaccagttctgtatcaagattctcaatccttatatgcccagcgtggtcgagacactggagcaaatgcagcggaaacacggcgggatgcttgtgagaaaccctctgtctcgcaattccacccatgaaatgtactgggttagctgcggaacaggcaacatcgtgtctgccgtcaatatgacctcccggatgctcctgaacagatttacgatggcgcaccgcaagcccacctatgagcgggatgtggacctgggggccggaacaagacacgtggctgtcgaaccggaggttgccaacctcgatatcattggccagcgcatcgaaaatattaaacatgagcacaagagcacctggcattacgacgaggataacccttataagacatgggcttaccacgggtcttatgaagtgaaaccctccggaagcgcctccagcatggtgaatggcgtcgtgaagctgcttaccaaaccctgggacgttatccctatggtgacacagattgctatgaccgatacgacacccttcggccaacagagagtctttaaggagaaagtggacacccggacccctaaggccaagcgcgggacagcgcagatcatggaagttacggccaaatggctgtggggattcctctctagaaacaagaaaccgcggatctgtaccagagaggaatttacacggaaggtgcgcagcaatgctgccattggcgctgtcttcgtggacgagaaccaatggaactccgccaaagaggccgttgaagatgagagattttgggacctggtgcatcgggaacgcgagcttcacaagcaggggaagtgcgcgacctgcgtctacaacatgatgggaaaaagagaaaagaaactgggcgagttcgggaaggctaaaggctctcgggccatctggtacatgtggctcggagcccgcttcctggagtttgaagctctgggcttcatgaatgaggatcactggtttagcagagaaaactccctctctggggtggagggagagggcctgcataaacttgggtatattctgcgggacatcagcaaaattcccggaggcaatatgtacgccgatgacacagctgggtgggatacccgcatcacagaagacgatctccagaacgaggccaagatcaccgacattatggaacctgagcacgcgctgcttgccaagtccatcttcaaactgacgtatcagaataaggtcgtgagagttcaacggcccgctaaaaacggcaccgtgatggatgtcatttctcgcagagaccagcggggaagcggccaggtggggacatacggactcaatacctttacaaacatggaagcccagctgatccgccaaatggagtccgagggcattttcagcccttctgaactggagacccccaacctcgctgggagagtgctggattggcttgaaaagcatggagttgagcggctgaaaagaatggccatctccggcgacgactgtgtggtcaagccgatcgatgaccgctttgcgacggccctcacagctctgaatgatatggggaaggtgcggaaagacattcctcagtgggaacccagcaagggctggaacgattggcagcaggttcctttctgctctcaccactttcatcaacttatcatgaaagacggaagagagattgtggtcccctgtcgcaatcaggatgagctggtgggccgggccagagtctcccagggggctggatggagcctccgcgaaaccgcctgcctgggcaagtcctatgctcagatgtggcaactgatgtacttccaccggagagacctccgcctggccgcgaacgccatctgttctgctgtgcctgttgattgggtgcccacaagccggaccacgtggtccattcatgcccaccatcagtggatgaccacagaggacatgcttagcgtctggaatagagtgtggatcgaagagaacccgtggatggaagataaaacccacatttcttcctggggagacgttccttatctgggaaagcgcgaggaccagtggtgcggcagcctcatcgggctgacagcccgggctacctgggccacaaatatccaagtggcgattaaccaggtcagacggcttatcggcaatgagaactacctggattacatgacctctatgaagagatttaaaaatgaaagcgaccccgagggagctctctggtga

SEQ ID NO: 18944 - RNA, 9879 nt, synthetic construct
  misc_feature 1..9879: note = derived and/or modified CDS sequence (opt5) from DENV-1__FJ410236__SS-prME
  source 1..9879: mol_type = other RNA
agcgtgaccatgctgctcatgctggtgcccacagcccttgctttccacctgacgaccagaggcggggaacctcatatgatcgtttccaagcaggaacggggaaaatctctcctgtttaagacaagcgccggcgtgaacatgtgcacccttatcgcgatggacctgggggagctctgtgaagatacaatgacctacaaatgcccccgcatcacagagaccgaacccgacgatgtggactgttggtgcaatgctacggatacctgggtcacatatggaacctgttcccaaacaggcgagcacagacgggacaagcgctctgtggccctggcccctcatgttgggctgggactcgagaccagaacggaaacatggatgagctccgagggcgcttggaaacagattcagcgggtggaaacctgggccctgcgccaccccggcttcacagtcatcgctctttttctggcccatgcgattgggacctctatcacccagaagggaatcattttcatcctcctgatgcttgtgacacctagcatggccatgagatgcgttggcattgggtcccgggattttgtggagggactgagcggcgctacgtgggtcgacgtggtgctcgagcacgggtcttgtgtcaccacaatggccaaggataaacccaccctggacatcgaactgctcaagacagaggttaccaaccctgctgtgctgcgcaaactttgcattgaagccaagatctccaatacgacaaccgatagcagatgtccgacccaaggagaggcgacactggtggaagaacaagacgccaacttcgtctgccggcgcacctttgtggatagaggctggggcaatgggtgtggactcttcggcaaagggtctctgattacatgcgctaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgccacgattacaccccaagctcctaccaccgagatccagctcacagactacggcgccctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggttgtgctgggaagccaagagggcgccatgcacacggctctgaccggggccacagaaattcagacctccggaacaaccacgatctttgccggccatctcaaatgcagactgaagatggataaacttacactgaaggggatgagctatgtcatgtgtaccggctctttcaaactcgagaaggaagtggctgagacccagcacggaacagttctggtgcagattaagtacgagggcaccgacgccccgtgcaaaatccctttctccacacaagatgaaaagggggtcacgcagaacggacggctgatcaccgcgaatcccattgtgacagacaaagagaagcctgtgaacatcgaagctgagccgccctttggcgagagctatattgttatcggggccggagaaaaagccatgaaactttcttggttcaagaaaggcagctccattgggaagatgtttgaggctaccgccagaggcgctcgccggatggccatcctcggagatacagcgtgggacttcggctctatcgggggagtctttaccagcgtgggcaaactggtgcatcagattttcgggacggcctacggagtcctgttttccggcgtgagctggaccatgaagatcgggattggcgttctcctgacatggcttggactcaattctagatccaccagcctctctatgacatgtatcgctgtgggcctggtcaccctgtaccttggggtgatggttcaggccgattccggatgcgtgattaactggaaaggccgcgaactcaagtgtgggagcggaatcttcgtcacaaatgaggtgcacacctggacggaacaatataagtttcaggctgactcccctaaacggctgtctgccgcgattggcaaggcctgggaggagggggtttgcggcatcagaagcgctacacgcctggaaaacatcatgtggaaacagatttccaacgagctcaatcatatcctgcttgaaaacgacatgaagttcaccgtggtcgtgggagatgtggccggcattctggctcaggggaaaaagatgatccggccgcaacccatggagtacaaatattcttggaaaagctggggaaaggccaagattatcggcgccgacgtccagaataccacatttatcattgatgggcctaacacccccgaatgtcctgacgatcagagagcttggaatatctgggaggttgaggactacggattcggcatttttacgacaaacatctggctcaagctgcgcgattcctatacccaggtgtgcgaccaccggctgatgagcgcggccattaaagattctaaggctgtgcacgccgacatgggctactggatcgaatccgagaaaaatgaaacatggaaacttgccagagctagcttcatcgaggtcaagacctgtatttggcccaaatctcatacactctggtccaacggggtgctggaaagcgagatgatcattccgaagatctatggaggccctatttctcaacacaattaccgccccgggtacttcacccagacggccggaccttggcatctgggcaaactcgagctggattttgacctttgcgaagggaccacagttgtggtcgatgagcactgcggaaaccggggccccagcctgagaaccacaaccgtgacgggcaagatcatccacgaatggtgttgccggtcctgtacactccctcccctgcgcttcagaggggaggacggatgctggtatggcatggagattcggccggttaaagaaaaggaggaaaatctggtcaagagcatggtctctgcggggtccggagaggtggacagcttttcccttggcctcctgtgtatctctattatgatcgaagaggttatgagaagccgctggtcccggaaaatgctgatgaccgggacactcgctgtgttctttctgcttattatgggacagctgacctggaacgatctcatcagactgtgcattatggtcggcgccaatgcctctgaccgcatgggcatggggaccacatacctggctcttatggccacgttcaagatgagacctatgtttgcggtgggactgctgttccggcgcctgaccagcagagaggtgctcctgcttacaatcggcctgtccctcgtcgcttctgttgaactgcccaacagcctggaggaacttggggatggactggccatgggcatcatgattctcaaactgctcaccgactttcaatcccatcagctgtgggccacacttctgagcctcaccttcatcaagacgacattttctctgcactatgcttggaaaaccatggccatggtgctgtccattgtgagccttttccccctgtgtctctctaccacatcccagaagaccacatggctgcctgtcctcctggggagccttggatgcaagccgctgacgatgtttctgatcgctgagaataaaatttggggccggcgctcttggcccctcaacgaaggcatcatggccgtggggatcgtttccattctgcttagctccctgctcaagaacgatgtgcctctggcgggacccctcatcgccggcgggatgctgattgcttgttacgtcatcagcggatctagcgccgacctttccctggagaaagctgccgaggtgtcttgggaagaggaagccgagcatagcggcgcttcccacaatattctggttgaagtgcaggatgacgggaccatgaagatcaaagatgaggagagagacgatacactcaccatcctgcttaaggcgacactgctcgccgtctctggagtgtatcctctgagcattcccgctaccctcttcgtctggtacttctggcagaagaagaagcagcggtccggcgtgctgtgggacacgccttctcccccggaagttgagcgcgccgtgcttgatgacggcatctatagaattatgcagcgggggctgctgggacgcagccaggtcggcgtgggggtttttcaagaaaacgtgttccataccatgtggcacgtcacaagaggagccgtgctcatgtaccagggcaaacggctggagccttcctgggctagcgtgaagaaagaccttatctcttacgggggaggctggagactgcagggctcctggaataccggggaggaagttcaggtcattgccgtggagcccggaaagaaccctaaaaatgtgcaaacagcgcccggcacctttaagacaccggaaggggaggtcggagctatcgccctcgatttcaagcctggcacgagcgggtctcccattgtgaaccgcgaaggaaaaatcgttggcctgtatggcaatggggtggtcaccacatccggaacctacgtgagcgccatcgctcaggccaaggcgtcccaggagggccctctccccgagattgaagacgaggtttttcggaaaagaaacctgaccatcatggatcttcaccccgggtctggaaagacacgccggtatctgcctgctattgtgagagaagccatcaaacgcaagctgcggacgctcattctggccccgaccagagtcgtggctagcgagatggccgaagctcttaagggcatgcccatccgctaccaaacaaccgccgttaaatccgagcatacagggaaggagatcgtggacctgatgtgccacgcgaccttcacgatgcggctcctgagccctgtcagagtgcccaattataacatgattatcatggatgaagcccattttacagacccttcttccattgctgcccggggctacatcagcacccgcgtgggaatgggcgaggctgccgccattttcatgaccgctacaccccctgggtctgtcgaagcgtttccgcagagcaatgccgttatccaggatgaggaaagagacatccccgagcggtcctggaactctggatatgagtggattaccgatttccctggcaaaacagtgtggtttgtgcccagcatcaagtccgggaatgacattgctaactgtctgcgcaaaaatggaaagagagtcatccagctctctcggaagaccttcgatacggaataccagaagaccaagaacaacgactgggactacgtggttaccacagatattagcgagatgggcgccaatttcagagccgaccgcgtgatcgatcctcggagatgccttaaacccgtcattctgaaggacgggccggaacgcgtgatcctggctggccctatgcccgttaccgtggcctccgcggctcagcggagaggacgcatcggccggaaccacaataaagagggggatcagtatatttacatgggacagcccctcaacaatgacgaggatcatgcccactggacggaagccaagatgctgcttgacaacatcaatacccctgagggcattatccccgctctgtttgaacctgagagagaaaagagcgccgcgattgatggggagtatcgcctcagaggagaggcccggaaaacattcgtcgaactgatgcgcagaggcgacctgccggtgtggctctcttacaaggtcgcttccgaggggtttcaatatagcgatcggcgctggtgcttcgacggcgaaagaaacaatcaggtgcttgaggaaaacatggatgttgagatctggaccaaagagggagaacggaagaaactgagaccccgctggctggacgcccggacatactccgaccctctcgctctgagagagtttaaggagttcgccgctggccgccggtctgtgagcggggatcttatcctggagattggaaaactcccccagcacctgacccagagagcccaaaatgcgctggacaacctcgtgatgcttcataattccgaacagggcgggcgggcctatcgccacgctatggaggagctgcctgatacaatcgaaaccctgatgctcctggcccttattgctgtcctgacgggaggcgttacactctttttcctgtctggcagagggctgggaaagaccagcatcggcctcctttgtgtgatggcctccagcgtgctgctgtggatggcctctgtcgagccccattggattgctgcgtccatcatcctcgaatttttcctgatggtgcttctgattccggagcctgaccggcagcgcacaccccaggataaccaactcgcctacgttgtgatcgggctgctgtttatgattctcacagtcgctgccaatgagatgggacttctggaaaccacaaagaaagacctgggcatcgggcacgtggccgtcgagaaccaccatcacgctgccatgctcgatgtggacctgcatcctgcgagcgcctggacgctttacgctgttgccaccacaattatcacccccatgatgagacacacaattgaaaacaccacggctaatatctctctgaccgccatcgcgaaccaggccgctattctcatgggactggataagggctggcctatctccaaaatggacattggcgtgcccctgctcgcccttgggtgctatagccaggtcaatccgctgacactgaccgctgccgtgctcatgctggttgctcattacgccatcattggacctggccttcaagcgaaggccacacgggaggctcagaaacgcaccgccgctgggatcatgaagaaccccacggtggatggaatcgtcgccattgacctggatcccgtggtgtatgacgccaagttcgaaaaacagctcggccagatcatgctgctgattctctgtacatctcaaatccttctgatgagaaccacatgggcgctgtgcgagagcattaccctcgctaccgggcctctgacaacgctttgggagggatccccgggcaagttttggaataccacaatcgccgtttctatggctaacatcttccggggcagctacctggccggggccggactcgctttctccctgatgaaaagcctgggcgggggacgcagaggcaccggggcccagggagaaacactcggcgagaagtggaaacggcagcttaatcagctgtccaagtctgaatttaacacctataagagaagcggcattatggaggtcgaccgctccgaagcgaaagaggggctgaagcggggagagacgacaaaacacgccgtgtctagaggcaccgctaagctccgctggttcgtggaacggaatctggtcaaacccgaggggaaggttatcgatcttggatgtggcagagggggatggagctactattgcgccggcctgaagaaagtgaccgaagtgaagggctacacaaaagggggacctggccacgaggaacccattcctatggctacctacgggtggaacctcgtcaagctgcattccggaaaagacgtgtttttcattccccctgagaagtgtgatacactgctctgcgacattggcgagtctagcccgaatcccacgatcgaagaggggcgcacccttcgggttctgaaaatggtggaaccttggctgagaggaaaccaattttgtattaagatcctcaatccctatatgccttccgtcgtggagacactggagcagatgcagcgcaagcacggcggcatgcttgttcggaaccccctgagcagaaattctacccatgaaatgtactgggtgtcctgcgggacaggaaacatcgtcagcgccgtgaatatgacctctcgcatgctcctgaaccggttcacgatggcgcacagaaaaccgacctatgagcgcgatgtggacctgggcgccgggacaagacacgtcgctgttgaacctgaggtggccaacctcgatattatcggacagcggattgaaaatatcaagcatgagcacaaatccacctggcattacgacgaggataacccctataagacatgggcttaccacggcagctatgaagtgaaaccctctgggtccgccagctccatggtcaatggagtggttaagctgcttaccaagccttgggacgtgattcccatggtcacacaaatcgctatgaccgatacgacaccttttggccagcagcgcgtgttcaaagagaaggttgacaccagaaccccgaaagccaagcggggcacagcgcaaatcatggaagtgacggccaaatggctgtgggggtttctcagcagaaacaagaagccccggatttgtacccgcgaggagttcacaagaaaagtccggtctaatgctgccatcggagctgtgtttgttgacgagaaccagtggaatagcgccaaggaggccgtggaagatgagcgcttctgggacctggtccatagagaacgggagcttcacaaacagggcaagtgcgcgacctgcgtgtacaacatgatggggaaacgcgaaaagaagctgggagagtttggcaaagctaaggggtccagagccatttggtacatgtggctcggcgcccggttcctggagttcgaagctctgggatttatgaatgaggatcactggttctctcgcgaaaacagcctctccggcgtcgagggggagggactgcataaacttggctatatcctgagagacatttctaagatccctgggggaaatatgtacgccgatgacacagctggctgggatacccggatcacagaagacgatctccagaacgaggcccgcattaccgacatcatggaacccgagcacgcgctgcttgccaaaagcatttttaagctgacgtatcaaaataaagtggttagagtgcagcggcctgctaagaacgggaccgtcatggatgtgatctcccgcagagaccagcggggctctggacaggtgggcacatacgggctcaataccttcacaaacatggaagcccaactgattagacagatggagagcgagggaatcttttcccccagcgaactggagaccccgaacctcgctgaacgcgttctggattggcttgagaagtatggcgtgaaacggctgaagagaatggccatctctggggacgactgtgtcgtgaaacctattgatgaccgcttcgcgacggccctcacagctctgaatgatatgggaaaggttcggaaagacatcccccagtgggaaccttccaagggctggaacgattggcagcaagtgcccttttgcagccatcacttccaccagcttattatgaaggacgggagagagatcgtcgtgccttgtcgcaatcaggatgagctggtcggccgggccagagtgtctcagggagctggctggtccctccgcgaaaccgcctgcctggggaaaagctacgctcaaatgtggcagctgatgtattttcatcggagagacctccgcctggccgcgaacgccatttgttccgctgttcccgtggattggatcccgacatctcggaccacgtggagcattcacgcccatcaccagtggatgaccacagaggacatgctttccgtctggaatagagtgtggatcgaagagaacccttggatggaagataagacccatatcagctcttggggagacgttccctacctgggcaaacgggaggaccaatggtgcgggtccctcattggactgacagccagagctacctgggccacaaatatccaggtggcgattaaccaggtccgccggcttatcggcaatgagaactacctggattatatgaccagcatgaagagattcaaaaatgaatctgaccccgagggggctctctggtga

SEQ ID NO: 18945 - RNA, 9879 nt, synthetic construct
  misc_feature 1..9879: note = derived and/or modified CDS sequence (opt5) from DENV-1__FJ410238__SS-prME
  source 1..9879: mol_type = other RNA
agcgtgaccatgctgctgatgctgatgcccacagcccttgctttccacctgacgaccagaggaggggaacctcatatgatcgtgtccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatacaagcgacagaatgggcatggggaccacctaccttgctctgatggccacattcaaaatgcgccctatgtttgcggtcggactcctgttcagacggctcacgtcccgcgaggtgctgcttctgaccatcggcctctctctggtggctagcgccgaactgcccaactcccttgaggaactgggggatggactcgccatgggcatcatgattctgaagctcctgacagactttcaaagccatcagctttgggctaccctgctctctctgacattcatcagaaccacgttttccctgcactatgcctggaaaacaatggctatggtccttagcattgtttctctgttccccctctgtctgtccaccaccagccagaagacaacctggctccctgtgctgcttgggtctctgggatgcaagccgctgacaatgtttctcatcgccgagaataaaatttggggccggaagtcctggcccctgaacgaaggcatcatggcggtggggatcgtcagcattcttctgtccagcctcctgaaaaacgatgtgcctctcgccggacccctgatcgctggcgggatgcttattgcctgttacgttatctctggaagctccgctgacctgtctctggagaaggccgccgaggtgagctgggaagaggaagctgagcattccggcgcgtctcacaatattctcgtcgaagtgcaggatgacgggacgatgaaaatcaaggatgaggagcgcgacgataccctgacaatccttctgaaagccaccctcctggctgttagcggagtgtatcctctctccattcccgccacactgttcgtctggtacttctggcaaaagaagaaacagagatctggcgtgctttgggacaccccttcccctcccgaagtcgagcgggccgtgctggatgacggcatctatcgcattatgcagagagggctgctcggacggtcccaggttggcgtgggggtctttcaagaaaacgtgttccatacgatgtggcacgttacccgcggagctgtgctgatgtaccagggcaagagacttgagcccagctgggcctctgtcaaaaaggacctgatctcctacgggggaggctggcggctccagggcagctggaatacaggggaggaagtccaggtgattgcggttgagcccggcaagaatcctaagaatgtccaaaccgctcccggcacatttaagacctctgaaggggaggtgggagccatcgccctggatttcaaaccgggcacatccgggagccctattgtgaacagagaaggaaagatcgtcggcctctatggcaatggggtggttacgacctccggaacatacgtgtctgctatcgcccaggcgaaagctagccaggagggccccctgcctgagattgaagacgaggtctttcgcaagcggaaccttaccatcatggatctgcaccccgggtccggaaaaaccagacgctatctgcccgccattgtgcgggaagccatcaagagacgcctccggacactgattcttgctcctacgagagttgtggccagcgagatggctgaagccctgaagggcatgccgatccgctaccaaaccacagcggtcaaatctgagcataccgggaaggagatcgtggacctcatgtgccacgccacattcaccatgcggctgctgtcccccgttagagtgcctaattataacatgattatcatggatgaagctcattttacggaccccagctctattgccgctcggggctacatcagcacacgcgtcggaatgggcgaggccgccgctattttcatgaccgcgacccctcccgggtccgtggaagcctttcctcagtctaatgctgtgatccaggatgaggaaagagacatcccggagcggagctggaactccggatatgagtggattacagatttccccggcaaaaccgtctggtttgttccttctatcaagagcgggaatgacattgccaactgtctccgcaaaaatggaaagagagtgatccagctttcccggaagacattcgataccgaataccagaagacgaagaacaacgactgggactacgtggtcacaaccgatattagcgagatgggcgccaatttcagagctgaccgcgtgatcgatccccggagatgcctgaaacctgttattctgaaggacgggcccgaacgcgtgatcctcgccggcccgatgcctgtcacagtggcgtctgctgcccagcggagaggacgcatcggccggaaccacaataaagagggggatcagtatatttacatgggacagcccctgaacaatgacgaggatcatgcccactggaccgaagctaagatgcttctggacaacatcaatacgcccgagggcattatccctgccctctttgaacccgagagagaaaagtccgcggccattgatggggagtatcgcctgagaggagaggctcggaaaaccttcgttgaactgatgcgcagaggcgacctccctgtgtggcttagctacaaggtcgcctccgaggggtttcaatattctgatcggcgctggtgcttcgacggcgaaagaaacaatcaggtgctggaggaaaacatggatgtcgagatctggacaaaagagggagaacggaagaaactgagaccgcgctggctcgacgctcggacctacagcgaccccctggcccttagagagtttaaggagttcgctgccggccgccggtccgtgtctggggatctgatcctcgagattggaaaactgcctcagcacctgacacagagagcgcaaaatgccctcgacaaccttgttatgctgcataatagcgaacagggcgggcgggtgtatcgccacgctatggaggagctgcccgataccatcgaaacactcatgctgcttgccctgattgctgtgctcaccggaggcgtcacgctgtttttcctgtccggcagagggctcggaaagacaagcatcggccttctgtgtgttatggcctcttccgtgctgctctggatggccagcgtggagcctcattggattgctgcgtctatcatcctggaatttttccttatggtcctgctcattcccgagccggaccggcagcgcacccctcaggataaccaactggcctacgtggttatcgggctgctctttatgattcttaccgtggctgccaatgagatgggactgctggaaacaaccaagaaagacctcggcatcgggcacgtcgccgtggagaaccaccatcacgctgccatgctggatgtcgaccttcatcccgcgtccgcctggacactgtacgctgtggccacgaccattatcacacctatgatgagacacaccattgaaaacacaaccgctaatatcagcctcacggccatcgcgaaccaggccgctattctgatgggactggataagggctggcccatctctaaaatggacattggcgttcctctccttgccctggggtgctatagccaggtgaatcccctgaccctcacagctgccgtcctgatgcttgtggctcattacgccatcattggaccgggcctgcaagcgaaggccacccgggaggctcagaaacgcacagccgctgggatcatgaagaaccctaccgttgatggaatcgtggccattgacctcgatcccgtcgtgtatgacgccaagttcgaaaaacagctgggccagatcatgctgctcattctttgtacgtcccaaatcctgctgatgagaacaacctgggcgctctgcgagtctattacactggctaccgggccccttaccacactgtgggagggaagccctggcaagttttggaatacgaccatcgccgtgtccatggctaacatcttccggggcagctacctcgccggggccggactggctttctccctgatgaaatctctcggcgggggacgcagaggcacaggggcccagggagaaacccttggcgagaagtggaaacggcagctgaatcagctgagcaagtccgaatttaacacatataagagatctggcattatggaggttgaccgcagcgaagcgaaagaggggctcaagcggggagagaccacgaaacacgccgtctccagaggcacagctaagctgcgctggttcgtggaacggaatcttgtgaaaccggaggggaaggtcatcgatctgggatgtggcagagggggatggtcttactattgcgccggcctcaagaaagttaccgaagtgaagggctacaccaaagggggacccggccacgaggaacctattcccatggctacatacgggtggaacctggtgaagctgcatagcggaaaagacgtctttttcatccctcccgagaagtgtgataccctcctttgcgacattggcgagtccagccctaatccgacaatcgaagaggggcgcacgctgcgggtgctgaaaatggttgaaccctggctcagaggaaaccaattttgtattaagatcctgaatccttatatgccctctgtggtcgagacccttgagcagatgcagcgcaagcacggcggcatgctggtgcggaaccctctctccagaaatagcacacatgaaatgtactgggtttcttgcgggaccggaaacatcgtgtccgccgtcaatatgacaagccgcatgctgctgaaccggttcaccatggcgcacagaaaacccacgtatgagcgcgatgtggacctcggcgccgggaccagacacgtggctgtcgaaccggaggttgccaacctggatattatcggacagcggattgaaaatatcaagcatgagcacaaatctacatggcattacgacgaggataacccttataagacctgggcttaccacggctcctatgaagtgaaacccagcgggtccgccagctctatggtgaatggagtcgtgaaacttctgacaaagccctgggacgttattcctatggtgacccaaatcgctatgacagataccacgccctttggccagcagcgcgtcttcaaagagaaggtggacacaagaacccctaaagccaagcggggcaccgcgcaaatcatggaagttacagccaaatggctctgggggtttctgagcagaaacaagaagccgcggatttgtacgcgcgaggagttcaccagaaaagtgcggtccaatgctgccatcggagctgtctttgtggacgagaaccagtggaactctgccaaggaggccgttgaagatgagcgcttctgggaccttgtgcatagagaacgggagctgcacaaacagggcaagtgcgcgacatgcgtctacaacatgatggggaaacgcgaaaagaagctcggagagtttggcaaagctaaggggagcagagccatttggtacatgtggctgggcgcccggttcctggagttcgaagctctcggatttatgaatgaggatcactggttctcccgcgaaaactctctgagcggcgtggagggggagggacttcataaactgggctatatcctcagagacatttccaagatccccgggggaaatatgtacgccgatgacaccgctggctgggatacacggatcaccgaagacgatctgcagaacgaggccaaaattacagacatcatggaacctgagcacgcgcttctggccaagtctatttttaaactcacctatcaaaataaggtcgtgcgcgttcagagacccgctaagaacgggacggtgatggatgtcatcagccggcgcgaccagagaggctccggacaggtgggcacctacgggctgaatacattcaccaacatggaagcccaactgattcggcagatggagagcgagggaatcttttctccttccgaactcgagacacccaacctggctggcagagtgcttgattggctggaaaaacatggggttgagcgcctcaagcggatggccatcagcggagacgactgtgtggtcaaaccgattgatgacagattcgcgaccgccctgacggctcttaatgatatgggcaaggtgcgcaaagacatccctcagtgggaaccctctaaggggtggaacgattggcagcaagttcctttttgctcccaccacttccatcagctgattatgaaggacggccgggagatcgtggtcccctgtagaaatcaggatgagctcgtgggacgcgcccgggtcagccagggcgctgggtggtccctgagagaaacagcctgcctgggaaaatcttatgctcaaatgtggcagctcatgtactttcaccgccgggacctgagacttgccgcgaacgccatttgtagcgctgtgcctgttgattgggtgcccacctcccgcacaacctggagcatccatgcccaccatcagtggatgacgaccgaggacatgctgtctgtctggaatcgggtgtggattgaagagaacccgtggatggaagataagacacacgtttccagctggggcgacgtgccttatctcgggaaaagagaggaccaatggtgcggatctctgatcggccttaccgcccgggctacatgggccaccaatatccaggtcgcgattaaccaggtgagacgcctgctcgggaatgagaactacctggattacatgacaagcatgaagcggttcaaaaatgaatccgaccccgagggcgctctgtggtga

SEQ ID NO: 18946 - RNA, 9879 nt, synthetic construct
  misc_feature 1..9879: note = derived and/or modified CDS sequence (opt5) from DENV-1__FJ410239__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgccggcaaactcgttcatcagattttcgggacggcttacggagtcctgttttccggcgtgagctggaccatgaagatcgggattggcgtgcttctgacatggctcggactcaattctagatccaccagcctgtctatgacatgtatcgccgtcggccttgtgaccctctacctgggggttatggtgcaggctgattccggatgcgtcattaactggaaaggccgcgaactgaagtgtgggagcggaatcttcgtgacaaatgaggttcacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgtcgtggttggagatgtggctggcattctggcccaggggaaaaagatgatccggccgcaacccatggagtacaaatattcttggaaaagctggggaaaggccaagattatcggcgctgacgtccagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctaaggccgtccacgccgacatgggctactggatcgaatccgagaaaaatgaaacatggaagctggctagagccagcttcatcgaggttaagacctgtatttggcccaaatctcatacactgtggtccaacggggtgctcgaaagcgagatgatcattccgaagatctatggaggccctatttctcaacacaattaccgccccgggtacttcacccagacggcgggaccttggcatctgggcaaacttgagctggattttgacctctgcgaagggaccacagtggtcgtggatgagcactgcggaaaccggggccccagcctgagaaccacaaccgttacgggcaagatcatccacgaatggtgttgccggtcctgtacactgcctccccttcgcttcagaggggaggacggatgctggtatggcatggagattcggccggtgaaagaaaaggaggaaaatctcgtcaagagcatggtgtctgctgggtccggagaggttgacagcttttccctgggcctgctctgtatctctattatgatcgaagaggtgatgagaagccgctggtcccggaaaatgctgatgaccgggacacttgccgtcttctttctgctcattatgggacagctgacctggaacgatctgatcagactttgcattatggtgggcgccaatgcttctgaccgcatgggcatggggaccacatacctggccctcatggcgacgttcaagatgagacctatgtttgctgttggactgctgttccggcgcctgaccagcagagaggtgcttctgctcacaatcggcctgtccctggtcgcctctgtggaacttcccaacagcctggaggaactcggggatggactggccatgggcatcatgattctcaaactgcttaccgactttcaatcccatcagctgtgggctacactcctgagcctgaccttcatcaagacgacattttctcttcactatgcctggaaaaccatggctatggtgctgtccattgtcagcctcttccccctgtgtctctctaccacatcccagaagaccacatggctgcctgtttttcttgggagcctgggatgcaagccgctgacgatgttcctcatcgccgagaataaaatttggggccggcgctcttggcccctgaacgaaggcatcatggcggtggggatcgtgtccattcttctgagctccctcctgaagaacgatgtccctctcgccggacccctgatcgctggcgggatgcttattgcctgttacgtgatcagcggatctagcgctgacctgtccctggagaaagccgccgaggtttcttgggaagaggaagctgagcatagcggcgcgtcccacaatattctcgtggaagtccaggatgacgggaccatgaagatcaaagatgaggagagagacgatacactgaccatccttctgaaggccacactcctggctgtgtctggagtttatcctctcagcattcccgccaccctgttcgtgtggtacttttggcagaagaagaagcagcggtccggcgtcctttgggacacgccttctcccccggaagtggagcgcgccgtcctggatgacggcatctatagaattatgcagcgggggctgctcggacgcagccaggtgggcgttggggtgttccaagaaaacgtctttcataccatgtggcacgtgacaagaggagctgttctgatgtaccagggcaaacggcttgagccttcctgggccagcgtgaagaaagacctgatctcttacgggggaggctggagactccagggctcctggaataccggggaggaagtccaggtgattgcggtggagcccggaaagaaccctaaaaatgttcaaacagctcccggcaccttcaagacaccggaaggggaggtcggagccatcgccctggattttaagcctggcacgagcgggtctcccattgtgaaccgcgaaggaaaaatcgtgggcctctatggcaatggggtcgtgaccacatccggaacctacgttagcgctatcgcccaggcgaaggcttcccaggagggccctctgcccgagattgaagacgaggtgttccggaaaagaaaccttaccatcatggatctgcaccccgggtctggaaagacacgccggtatctgcctgccattgtcagagaagccatcaaacgcaagctccggacgctgattcttgctccgaccagagtggttgccagcgagatggctgaagccctgaagggcatgcccatccgctaccaaacaaccgcggtgaaatccgagcatacagggaaggagatcgtcgacctcatgtgccacgccacctttacgatgcggctgctgagccctgtgagagttcccaattataacatgattatcatggatgaagctcatttcacagacccttcttccattgccgctcggggctacatcagcacccgcgtgggaatgggcgaggccgccgctatttttatgaccgcgacaccccctgggtctgtcgaagccttcccgcagagcaatgctgtgatccaggatgaggaaagagacatccccgagcggtcctggaactctggatatgagtggattaccgattttcctggcaaaacagtgtggttcgtccccagcatcaagtccgggaatgacattgccaactgtctccgcaaaaatggaaagagagttatccagctttctcggaagaccttcgatacggaataccagaagaccaagaacaacgactgggactacgtggtgaccacagatattagcgagatgggcgccaattttagagctgaccgcgtcatcgatcctcggagatgcctgaaacccgtgattctgaaggacgggccggaacgcgttatcctcgccggccctatgcccgtgaccgtcgcgtccgctgcccagcggagaggacgcatcggccggaaccacaataaagagggggatcagtatatttacatgggacagcccctgaacaatgacgaggatcatgcccactggacggaagctaagatgcttctggacaacatcaatacccctgagggcattatccccgccctcttcgaacctgagagagaaaagagcgcggccattgatggggagtatcgcctgagaggagaggctcggaaaacatttgtggaactgatgcgcagaggcgacctcccggtttggctttcttacaaggtggcctccgaggggttccaatatagcgatcggcgctggtgctttgacggcgaaagaaacaatcaggtcctggaggaaaacatggatgtggagatctggaccaaagagggagaacggaagaaactgagaccccgctggctcgacgctcggacatactccgaccctctggcccttagagagttcaaggaatttgctgccggccgccggtctgtcagcggggatctgatcctcgagattggaaaactgccccagcacctgacccagagagcgcaaaatgccctcgacaaccttgtgatgctgcataattccgaacagggcgggcgggcttatcgccacgccatggaggagctgcctgatacaatcgaaaccctcatgctgcttgctctgattgccgttctcacgggaggcgtgacactgttctttctgtctggcagagggctcggaaagaccagcatcggccttctgtgtgtgatggcctccagcgtcctgctctggatggcttctgttgagccccattggattgcggcctccatcatcctggagttctttcttatggtgctgctcattccggagcctgaccggcagcgcacaccccaggataaccaactggcttacgtggtcatcgggctcctgttcatgattcttacagtggccgccaatgagatgggactgctggaaaccacaaagaaagacctcggcatcgggcacgttgctgtggagaaccaccatcacgccgcgatgctggatgtcgaccttcatcctgccagcgcttggacgctgtacgccgtggctaccacaattatcacccccatgatgagacacacaattgaaaacaccacggccaatatctctctcaccgcgatcgccaaccaggctgccattctgatgggactggataagggctggcctatctccaaaatggacattggcgtccccctccttgctctggggtgctatagccaggtgaatccgctgacactcaccgccgctgttctgatgcttgtggcccattacgcgatcattggacctggcctgcaagccaaggctacacgggaggcccagaaacgcaccgctgccgggatcatgaagaaccccacggtcgatggaatcgtggccattgacctcgatcccgttgtgtatgacgcgaagtttgaaaaacagctgggccagatcatgctgctcattctttgtacatctcaaatcctgctgatgagaaccacatgggctctctgcgagagcattaccctggccaccgggcctcttacaacgctgtgggagggatccccgggcaagttctggaataccacaatcgctgtctctatggccaacatcttccggggcagctacctcgccggggctggactggccttttccctgatgaaaagcctcggcgggggacgcagaggcaccggggcgcagggagaaacacttggcgagaagtggaaacggcagctgaatcagctgtccaagtctgagttcaacacctataagagaagcggcattatggaggtggaccgctccgaagccaaagaggggctcaagcggggagagacgacaaaacacgctgtgtctagaggcaccgccaagctgcgctggtttgttgaacggaatcttgtcaaacccgaggggaaggtgatcgatctgggatgtggcagagggggatggagctactattgcgctggcctcaagaaagtgaccgaagtcaagggctacacaaaagggggacctggccacgaggaacccattcctatggccacctacgggtggaacctggttaagctgcattccggaaaagacgtgttctttattccccctgagaagtgtgatacactcctttgcgacatcggcgagtctagcccgaatcccacgatcgaagaggggcgcaccctgcgggtgctgaaaatggtcgaaccttggctcagaggaaaccaattctgtattaagatcctgaatccctatatgccttccgtggttgagacacttgagcagatgcagcgcaagcacggcggcatgctggtgcggaaccccctcagcagaaattctacccatgaaatgtactgggtctcctgcgggacaggaaacatcgtgagcgcggttaatatgacctctcgcatgctgctgaaccggtttacgatggcccacagaaaaccgacctatgagcgcgatgtggacctcggcgctgggacaagacacgtcgccgtggaacctgaggtggctaacctggatattatcggacagcggattgaaaatatcaagcatgagcacaaatccacctggcattacgacgaggataacccctataagacatgggcctaccacggcagctatgaagtcaaaccctctgggtccgctagctccatggttaatggagtggtgaaacttctgaccaagccttgggacgtcattcccatggtgacacaaatcgccatgaccgatacgacacctttcggccagcagcgcgtttttaaagagaaggtggacaccagaaccccgaaagcgaagcggggcacagcccaaatcatggaagtcacggctaaatggctctgggggttcctgagcagaaacaagaagccccggatttgtacccgcgaggaatttacaagaaaagtgcggtctaatgccgctatcggagccgttttcgtggacgagaaccagtggaatagcgccaaggaggcggtcgaagatgagcgcttttgggaccttgtgcatagagaacgggagctgcacaaacagggcaagtgcgctacctgcgtttacaacatgatggggaaacgcgaaaagaagctcggagagttcggcaaagccaaggggtccagagccatttggtacatgtggctgggcgctcggttcctggagtttgaagccctcggattcatgaatgaggatcactggttttctcgcgaaaacagcctgtccggcgtggagggggagggacttcataaactgggctatatcctcagagacatttctaagatccctgggggaaatatgtacgctgatgacacagccggctgggatacccggatcacagaagacgatctgcagaacgaggcgcgcattaccgacatcatggaacccgagcacgcccttctggctaaaagcattttcaagctcacgtatcaaaataaagtcgtgagagtccagcggcctgccaagaacgggaccgtgatggatgttatctcccgcagagaccagcggggctctggacaggtgggcacatacgggctgaatacctttacaaacatggaagctcaactgattagacagatggagagcgagggaatcttctcccccagcgaactcgagaccccgaacctggccgaacgcgtccttgattggctggagaagtatggcgtggaacggctcaaaagaatggcgatctctggggacgactgtgtggttaagcctattgatgaccgctttgccacggctctgacagcccttaatgatatgggaaaagtgcggaaggacatcccccagtgggagccttccaaaggctggaacgattggcagcaagtccccttctgcagccatcactttcaccagctgattatgaaggacgggagagagatcgtggttccttgtcgcaatcaggatgaactcgtgggccgggctagagtctctcagggagccggctggtccctgcgcgagaccgcttgcctgggaaagagctacgcccaaatgtggcagctcatgtatttccatcggagagacctgcgccttgcggccaacgctatttgttccgccgtgcccgtcgattggatcccgacatctcggaccacgtggagcattcacgcccatcaccagtggatgaccacagaagacatgctgtccgtgtggaatagagtttggatcgaggaaaacccttggatggaggataaaacccatatcagctcttggggagacgtgccctacctcggcaagcgggaggaccaatggtgcgggtccctgattggacttacagctagagccacctgggcgacaaatatccaggtcgctattaaccaggtgcgccggctgatcggcaatgaaaactacctcgattatatgaccagcatgaaaagatttaagaatgagtctgaccccgaaggggccctgtggtga

SEQ ID NO: 18947 - RNA, 9879 nt, synthetic construct
  misc_feature 1..9879: note = derived and/or modified CDS sequence (opt5) from DENV-1__FJ410240__SS-prME
  source 1..9879: mol_type = other RNA
agcgtgaccatgctgctcatgctgatgcccaccgcccttgctttccacctgacgaccagaggcggggaacctcatatgatcgtgtccaagcaggaacggggaaagtctctcctgtttaagacaagcgccggcgttaatatgtgcacccttattgcgatggacctgggggagttctgtgaagatacaatgacctacaagtgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgctcacacaggcgaccagcatcaagtggggaatgagagcaccgaacacggaacaaccgccacgatcacaccccaggccccttctacagagattcagctgaccgactacggcgctctcacactggattgtagcccccggaccggcctggactttaacgaaatggttctcctgacgatgaaggagaaaagctggcttgtgcataagcagtggttcctggatctccctctgccctggacatccggggcgtctaccagccaagagacatggaatcgcaaagaccttctggtcacctttaagaccgcccacgctaagaaacaggaagtggtcgtgctcggatcccaggagggcgccatgcacacagccctgacgggggctaccgaaatccaaacaagcggaaccacaaccattttcgccggccatctgaagtgcagactcaaaatggataagctgacgcttaaagggatgtcttatgttatgtgtacaggctccttcaagctggagaaggaagtggcggagacccagcacggaaccgtcctcgtgcagatcaaatacgagggcacagacgctccgtgcaagattccttttagcacccaggatgaaaaaggggttacacaaaacggacggctgatcacggccaatcccatcgtgaccgacaaggagaaacctgtcaacattgaagccgagccgcccttcggcgagtcttatatcgtgattggggctggagaaaaggccctgaaacttagctggtttaaaaagggctcctctatcgggaaaatgttcgaggctacagccagaggcgcgcgccggatggccattctcggagataccgcttgggactttggcagcatcgggggagtgttcacatccgttggcaagctggtccatcagatctttgggaccgcctacggagtgctgttcagcggcgtgtcttggacgatgaaaattgggatcggcgtcctcctgacctggcttggactcaattccagaagcacatctctctccatgacctgtattgctgtgggcctggttacactgtaccttggggtgatggtccaggccgatagcggatgcgtgatcaactggaagggccgcgaactcaagtgtgggtccggaatttttgttaccaatgaggtgcacacatggaccgaacagtataaattccaagcggactctcctaagcggctgagcgccgctatcggcaaagcctgggaggagggggtctgcggcattagatccgctacgcgcctggaaaacatcatgtggaagcagatctctaacgagctcaatcatattctgcttgaaaacgacatgaaatttacagtggttgtgggagatgtcgccggcatcctggcccaggggaagaaaatgattcggccgcagcccatggagtacaagtatagctggaagtcctggggaaaagctaagatcattggcgcggacgtgcaaaataccaccttcatcatcgatgggcctaacacacccgaatgtcctgacgatcagagagcctggaatatttgggaggtggaggactacggatttggcatcttcaccacgaacatttggctcaaactgcgcgatagctatacacaggtctgcgaccaccggctgatgtctgctgccatcaaggattccaaagccgttcacgctgacatgggctactggattgaaagcgagaagaatgaaacctggaaacttgccagagcgtctttcatcgaggtgaaaacatgtatctggcccaagtcccataccctctggagcaacggggtgctggaatctgagatgattatcccgaaaatttatggaggccctatcagccagcacaattaccgccccgggtactttacacaaaccgctggaccttggcatctgggcaagctcgagctggatttcgacctttgcgaagggacgaccgtcgtggttgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggtcaaggaaaaagaggaaaatctggtgaagtctatggtttccgccgggagcggagaggtggactccttctctcttggcctcctgtgtattagcatcatgattgaagaggtcatgcggtccagatggtctcgcaaaatgctgatgacagggaccctcgccgtgtttttcctgcttatcatgggacagctgacatggaacgatctcattcggctgtgcatcatggttggcgctaatgccagcgacagaatgggcatggggaccacctacctggcgcttatggctacatttaagatgcgccctatgttcgccgtgggactgctctttagacggctgacgtcccgcgaggtcctcctgcttaccattggcctgtctctcgtggccagcgtggaactgcccaactccctggaggaacttggggatggactggctatgggcatcatgatcctcaaactgctcacagacttccagagccatcaactgtgggccacccttctgtctctcacatttattaagaccacgttctccctgcactatgcttggaagacaatggccatggtcctgagcatcgtttctctttttcccctgtgtctctccaccaccagccagaaaacaacctggctgcctgtgctcctggggtctcttggatgcaagccgctgacaatgttcctgattgcggagaataaaatctggggcagaaagtcctggcccctcaacgaaggcattatggccgtggggatcgtcagcatcctgctttccagcctgctcaaaaacgatgtgcctctggctggacccctcattgccggcgggatgctgatcgcttgttacgttatttctggaagctccgccgacctttctctggagaaggccgctgaggtgagctgggaagaggaagcggagcattccggcgcctctcacaatatcctggtcgaagtgcaggatgacgggacgatgaaaattaaggatgaggagcgggacgataccctcacaatcctgcttaaggctaccctgctcgccgttagcggagtgtatcctctgtccatccccgccacactcttcgtctggtacttttggcagaaaaagaaacaacgctctggcgtgctgtgggacaccccttcccctcccgaagtcgagagagctgtgcttgatgacggcatttatcggatcatgcagcgcgggctgctgggaagatcccaggttggcgtgggggtcttccaggaaaacgtgtttcatacgatgtggcacgttacccggggagccgtgctcatgtaccaaggcaagcgcctggagcccagctgggcgtctgtcaaaaaggaccttatttcctacgggggaggctggagactgcagggcagctggaatacaggggaggaagtccaggtgatcgctgttgagcccggaaagaaccctaaaaatgtccagaccgcccccggcacattcaagacctctgaaggggaggtgggagccattgctctcgattttaaaccgggcacatccgggagccctatcgtgaaccgggaaggaaagattgtcggcctgtatggcaatggggtggttacgacctccggaacatacgtgtctgccatcgcgcaagctaaagccagccaggagggccccctccctgagatcgaagacgaggtcttcagaaagcgcaacctgaccattatggatcttcaccccgggtccggaaagacccggagatatctgcccgccatcgtgcgcgaagctattaaacggaagctgagaacactcatcctggcccctacgcgcgttgtggctagcgagatggccgaagcgcttaaaggcatgccgattcggtaccagaccacagccgtcaagtctgagcataccgggaaagagatcgtggacctgatgtgccacgctacatttaccatgagactcctgtcccccgttcgcgtgcctaattataacatgatcattatggatgaagcccatttcacggaccccagctctatcgctgcccggggctacattagcacaagagtcggaatgggcgaggccgctgcgatctttatgaccgccacccctcccgggtccgtggaggctttccctcaatctaatgccgtgattcaggatgaagaacgggacatcccggagcgcagctggaactccggatatgagtggatcacagattttcccggcaagaccgtctggttcgttccttctattaagagcgggaatgacatcgccaactgtctgcgcaagaatggaaagcgggtgattcagctctcccgcaaaacattcgataccgaataccagaagacgaaaaacaacgactgggactacgtggtcacaaccgatatcagcgagatgggcgctaattttagagccgaccgggtgattgatcccagacgctgccttaagcctgttatcctgaaggacgggcccgaacgggtgattctggcgggcccgatgcctgtcacagtggcttctgccgcccaaagacgcggacggatcggcagaaaccacaataaagagggggatcagtatatctacatgggacagcccctcaacaatgacgaggatcatgctcactggaccgaagccaagatgctgcttgacaacattaatacgcccgagggcatcattcctgcgctgttcgaacccgagcgcgaaaaatccgccgctatcgatggggagtatcggctcagaggagaggcccgcaagacctttgttgaactgatgagacggggcgacctgcctgtgtggctcagctacaaagtcgcttccgaggggttccagtattctgatcgcagatggtgctttgacggcgaacggaacaatcaagtgcttgaggaaaacatggatgtcgagatttggacaaaggagggagaacgcaaaaagctgagaccgcggtggctggacgccagaacctacagcgaccccctcgctctgcgcgagttcaaggaatttgccgcgggccggagatccgtgtctggggatcttatcctggagatcggaaaactccctcagcacctgacacagcgcgcccagaatgctctggacaacctcgttatgcttcataatagcgaacaaggcgggcgggcctatagacacgctatggaggagctgcccgataccattgaaacactgatgctcctggcccttatcgccgtgctgaccggaggcgtgacgctgttctttctgtccggccgggggctgggaaagacaagcattggcctcctttgtgtcatggcttcttccgttctgctgtggatggcgagcgtggagcctcattggatcgccgcttctattatcctcgagttctttctgatggtgcttctgatccccgagccggaccgccagagaacccctcaggataaccagctcgcctacgtcgtgattgggctgctgttcatgatcctcaccgttgccgctaatgagatgggacttctggaaacaaccaaaaaggacctgggcattgggcacgtggccgtcgagaaccaccatcacgcggccatgctcgatgtggacctgcatcccgcttccgcctggacactttacgctgtcgccacgaccatcattacacctatgatgcggcacaccatcgaaaacacaaccgcgaatattagcctgacggccatcgctaaccaagccgctatcctcatgggactggataaaggctggcccatttctaagatggacatcggcgtgcctctgctcgcccttgggtgctatagccaggttaatcccctgaccctgacagctgccgtgctcatgctggtcgcgcattacgccattatcggaccgggccttcaggctaaggccacccgcgaggctcagaagagaacagccgccgggattatgaagaaccctaccgtggatggaatcgttgcgatcgacctggatcccgtggtctatgacgctaaatttgaaaagcagctcggccagattatgctgctgatcctctgtacgtcccagattcttctgatgcggacaacctgggccctgtgcgagtctatcacactcgctaccgggcccctgaccacactttgggagggaagccctggcaaattctggaatacgaccattgccgtgtccatggccaacatcttccgcggcagctacctggctggggccggactcgcgttttccctgatgaagtctctgggcgggggaagacggggcacaggggcccaaggagaaaccctcggcgagaagtggaaacgccagcttaatcagctgagcaagtccgagttcaacacatataaaagatctggcatcatggaggtggaccggagcgaagctaaggaggggctgaaaagaggagagaccacgaagcacgccgtttcccgcggcacagctaagctccggtggtttgtcgaaagaaatctggtgaaaccggaggggaaggtgattgatcttggatgtggccgcgggggatggtcttactattgcgccggcctgaaaaaggtcaccgaagttaaaggctacaccaaagggggacccggccacgaggaacctatccccatggcgacatacgggtggaacctcgtgaaactgcatagcggaaaggacgtgttctttattcctcccgagaagtgtgataccctgctctgcgacatcggcgagtccagccctaatccgacaattgaagaggggcggacgcttagagtcctgaaaatggtggaaccctggctgcgcggaaaccagttctgtatcaagattctcaatccttatatgccctctgttgtggagaccctggagcaaatgcagcggaaacacggcggcatgcttgtcagaaaccctctgtcccgcaatagcacacatgaaatgtactgggtgtcttgcgggaccggaaacatcgtttccgccgtgaatatgacaagccggatgctcctgaacagatttaccatggctcaccgcaagcccacgtatgagcgggatgtcgacctgggcgccgggaccagacacgtggctgtggaaccggaggtcgccaacctcgatatcattggacagcgcatcgaaaatattaaacatgagcacaagtctacatggcattacgacgaggataacccttataagacctgggcttaccacggctcctatgaagttaaacccagcgggtccgccagctctatggtgaatggagtggtcaagctgcttacaaaaccctgggacgtgatccctatggttacccagattgcgatgacagataccacgcccttcggccaacagagagtgtttaaggagaaagtcgacacacggacccctaaggccaagcgcggcaccgctcagatcatggaagtgacagccaaatggctgtgggggttcctcagcagaaacaagaaaccgcggatctgtacgagagaggaatttacccggaaggttcgctccaatgctgccattggagccgtgttcgtcgacgagaaccaatggaactctgcgaaagaggctgtggaagatgagagattttgggacctggttcatcgggaacgcgagcttcacaagcagggcaagtgcgccacatgcgtgtacaacatgatggggaaaagagaaaagaaactgggagagttcggcaaggccaaagggagccgggctatctggtacatgtggctcggcgcccgcttcctggagtttgaagctctgggattcatgaatgaggatcactggttttccagagaaaactctctcagcggcgtcgagggggagggactgcataaacttggctatattctgcgggacatctccaaaattcccgggggaaatatgtacgccgatgacaccgcgggctgggatacacgcatcaccgaagacgatctccagaacgaggccaagatcacagacattatggaacctgagcacgctctgcttgccaagtctatcttcaaactgacctatcagaataaggtggtcagagtgcaacggcccgctaaaaacgggacggttatggatgtgattagccgcagagaccagcggggctccggacaggtcggcacctacgggctcaatacatttaccaacatggaagcccagctgatccgccaaatggagagcgagggaattttctctccttccgaactggagacacccaacctcgcgggcagagtgctggattggcttgaaaagcatggggtggagcggctgaaaagaatggccatcagcggagacgactgtgttgtgaagccgatcgatgaccgctttgctaccgccctcacggctctgaatgatatgggcaaggtccggaaagacattcctcagtgggaaccctctaaggggtggaacgattggcaacaggtgcctttctgctcccaccactttcatcaacttatcatgaaagacggcagagagattgttgtgccctgtcgcaatcaggatgagctggtcggacgggccagagtgagccagggcgctgggtggtccctccgcgaaacagcctgcctgggaaagtcttatgcgcagatgtggcaactgatgtacttccaccggagagacctccgcctggccgctaacgccatctgtagcgccgtccctgtggattgggttcccacctcccggacaacctggagcattcatgctcaccatcagtggatgacgaccgaggacatgctttctgtgtggaatagagtctggatcgaagagaacccgtggatggaagataaaacacacatttccagctggggcgacgtgccttatctggggaagcgcgaggaccagtggtgcggatctctcatcggcctgaccgcccgggcgacatgggctaccaatatccaagttgccattaaccaggtgagacggcttatcgggaatgagaactacctggattacatgacaagcatgaagagatttaaaaatgaatccgaccccgagggcgccctctggtga

SEQ ID NO: 18948 - RNA, 9879 nt, synthetic construct
  misc_feature 1..9879: note = derived and/or modified CDS sequence (opt5) from DENV-1__FJ410242__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaacatgtgcacccttatcgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccaccacgcgcctggaaaacatcatgtggaagcagatttctaacgagctcaatcatatcctgcttgaaaacgacatgaaatttacagttgtggtcggagatgtggccggcattctggctcaggggaagaaaatgatccggccgcagcccatggagtacaagtatagctggaagtcctggggaaaagccaagattatcggcgccgacgtgcaaaataccaccttcatcattgatgggcctaacacacccgaatgtagcgacgatcagagagcttggaatatctgggaggtcgaggactacggatttggcattttcaccacgaacatctggctcaaactgcgcgattcttatacacaggtttgcgaccaccggctgatgtccgcggccattaaggatagcaaagctgtgcacgccgacatgggctactggatcgaatctgagaagaatgaaacctggaaacttgccagagcttccttcatcgaggtgaaaacatgtatttggcctaagagccataccctctggtctaacggggtcctggaaagcgagatgatcattcccaaaatctatggaggcccgatttcccagcacaattaccgccctgggtactttacacaaaccgccggaccctggcatctgggcaagctcgagctggatttcgacctttgcgaagggacgaccgtggttgtggatgagcactgcggaaaccggggccctagcctgagaacaaccacagtcaccggcaaaatcatccacgaatggtgttgccggtcttgtacgctgccccctctgcgctttaagggggaggacggatgctggtatggcatggagattagacccgtgaaggaaaaagaggaaaatctggttaagtccatggtgagcgcggggtccggagaggtcgactctttcagccttggcctcctgtgtatctccattatgatcgaagaggtgatgcggtctagatggagccgcaaaatgctgatgacagggaccctcgctgtctttttcctgcttattatgggacagctgacatggaacgatctcatccggctgtgcattatggtgggcgccaatgcctccgacagaatgggcatggggaccacctacctggctcttatggccacatttaagatgcgcccgatgttcgcggtcggactgctctttagacggctgacgtctcgcgaggtgctcctgcttaccatcggcctgagcctcgtggcttccgtcgaactgcctaacagcctggaggaacttggggatggactggccatgggcatcatgattctcaaactgctcacagacttccagtctcatcaactgtgggccacccttctgtccctcacatttatcaagaccacgttcagcctgcactatgcttggaagacaatggccatggttctgtctattgtgtccctttttcccctgtgtctcagcaccacctctcagaaaacaacctggctgcccgtgctcctggggtcccttggatgcaagcctctgacaatgttcctgatcgctgagaataaaatttggggcagaaagagctggccgctcaacgaaggcatcatggccgtcgggatcgtgtccattctgcttagctctctgctcaaaaacgatgttcccctggcgggacctctcatcgccggcgggatgctgattgcttgttacgtgatcagcggatcctctgccgaccttagcctggagaaggctgccgaggtctcctgggaagaggaagccgagcattctggcgctagccacaatattctggtggaagttcaggatgacgggacgatgaaaatcaaggatgaggagcgggacgataccctcacaatcctgcttaaggcgaccctgctcgccgtgtccggagtctatcccctgtctattcctgctacactcttcgtgtggtacttttggcagaaaaagaaacaacgcagcggcgtcctgtgggacaccccctcccctcccgaagtggagagagccgttcttgatgacggcatctatcggattatgcagcgcgggctgctgggaagaagccaggtgggcgtcggggtgttccaggaaaacgtttttcatacgatgtggcacgtgacccggggagccgtcctcatgtaccaaggcaagcgcctggagccgtcttgggcttccgtgaaaaaggaccttatcagctacgggggaggctggagactgcagggctcttggaatacaggggaggaagtgcaggttattgccgtcgagcctggaaagaaccccaaaaatgtgcagaccgcgcctggcacattcaagacctccgaaggggaggtgggagctatcgccctcgattttaaacccggcacaagcgggtccccgattgtcaaccgggaaggaaagatcgtgggcctgtatggcaatggggttgtgacgacctctggaacatacgtcagcgccatcgctcaagccaaagcgtcccaggagggccctctccccgagattgaagacgaggtgttcagaaagcgcaacctgaccatcatggatcttcaccctgggagcggaaagacccggagatatctgcccgctattgttcgcgaagccatcaaacggaagctgagaacactcattctggcccccacgcgcgtggtcgcttctgagatggccgaagctcttaaaggcatgcctatccggtaccagaccacagccgtgaagtccgagcataccgggaaagagatcgttgacctgatgtgccacgcgacatttaccatgagactcctgagcccggtgcgcgtccccaattataacatgattatcatggatgaagcccatttcacggacccttctagcattgctgcccggggctacatctccacaagagtgggaatgggcgaggctgccgccatttttatgaccgctacaccccctgggtctgtggaagcgttcccccaaagcaatgccgtcatccaggatgaggaacgggacatccctgagcgctcctggaactctggatatgagtggattacagattttccgggcaagaccgtttggttcgtgcccagcatcaagtccgggaatgacattgctaactgtctgcgcaagaatggaaagcgggtgatccagctcagccgcaaaacattcgataccgaataccagaagacgaaaaacaacgactgggactacgtcgtgacaaccgatatttctgagatgggcgccaattttagagccgaccgggttatcgatcctagacgctgccttaagcccgtgattctgaaggacgggcctgaacgggtcatcctggctggccccatgccggtgacagttgcctccgcggctcaaagacgcggacggatcggcagaaaccacaataaagagggggatcagtatatttacatgggacagcctctcaacaatgacgaggatcatgcccactggaccgaagccaagatgctgcttgacaacatcaatacgcccgagggcattatccccgctctgttcgaacctgagcgcgagaagtccgccgcgattgatggggagtatcggctcagaggagaggcccgcaagacctttgtggaactgatgagacggggcgacctgcccgtctggctctcctacaaagtggcttctgaggggttccagtatagcgatcgcagatggtgctttgacggcgaacggaacaatcaagtccttgaggaaaacatggatgtggagatctggacaaaggagggagaacgcaaaaagctgagacctcggtggctggacgccagaacctactccgacccgctcgctctgcgcgagttcaaggaatttgccgctggccggagatctgttagcggggatcttatcctggagattggaaaactcccccagcacctgacacagcgcgcccagaatgcgctggacaacctcgtgatgcttcataattccgaacaaggcgggcgggcctatagacacgctatggaggagctgcctgataccatcgaaacactgatgctcctggcccttattgctgtgctgaccggaggcgtcacactcttctttctgagcggccgggggctgggaaagacatctatcggcctcctttgtgttatggcctccagcgtgctgctgtggatggcctctgtggagccccattggattgctgcgtccatcatcctcgagttctttctgatggtccttctgattcctgagcccgaccgccagagaaccccgcaggataaccagctcgcctacgtggttatcgggctgctgttcatgattctcaccgtggctgccaatgagatgggacttctggaaacaaccaaaaaggacctgggcatcgggcacgtcgccgctgagaaccaccatcacgccgcgatgctcgatgtggacctgcatcctgccagcgcttggacactttacgccgtcgctacgaccattatcacacccatgatgcggcacaccattgaaaacacaaccgccaatatctctctgacggcgatcgccaaccaagctgccattctcatgggactggataaaggctggcctatcagcaagatggacattggcgtgcccctgctcgctcttgggtgctattcccaggttaatcctctgaccctgacagccgctgtgctcatgctggtcgcccattacgcgatcattggacccggccttcaggccaaggctacccgcgaggcccagaagagaacagctgccgggatcatgaagaacccgaccgtggatggaatcgttgccattgacctggatcctgtggtctatgacgcgaaatttgaaaagcagctcggccagatcatgctgctgattctctgtacgtctcagatccttctgatgcggacaacctgggctctgtgcgagagcattacactcgccaccgggcccctgaccacactttgggagggatcccccggcaaattctggaatacgaccatcgctgtgagcatggccaacatcttccgcggctcctacctggccggggctggactcgccttttctctgatgaaaagcctgggcgggggaagacggggcacaggggcgcaaggagaaaccctcggcgagaagtggaaacgccagcttaatcagctgtccaagtctgagttcaacacatataaaagaagcggcattatggaggtggaccggtccgaagccaaggaggggctgaaaagaggagagaccacgaagcacgctgtttctcgcggcacagccaagctccggtggtttgtcgaaagaaatctggtgaaacctgaggggaaggtgatcgatcttggatgtggccgcgggggatggagctactattgcgctggcctgaaaaaggtcaccgaagttaaaggctacaccaaagggggaccgggccacgaggaacccattcctatggccacatacgggtggaacctcgtgaaactgcattccggaaaggacgtgttctttattccccctgagaagtgtgataccctgctctgcgacattggcgagagctctcccaatcctacaatcgaagaggggcggacgcttagagtcctgaaaatggtggaaccgtggctgcgcggaaaccagttctgtattaagatcctcaatccctatatgccttccgttgtggagaccctggagcaaatgcagcggaaacacggcggcatgcttgtcagaaaccccctgagccgcaattctacacatgaaatgtactgggtgtcctgcgggaccggaaacatcgttagcgcggtgaatatgacatctcggatgctcctgaacagatttaccatggcccaccgcaagcctacgtatgagcgggatgtcgacctgggcgctgggaccagacacgtggccgtggaacccgaggtcgctaacctcgatattatcggacagcgcattgaaaatatcaaacatgagcacaagtccacatggcattacgacgaggataacccgtataagacctgggcctaccacggcagctatgaagttaaaccttccgggagcgcttctagcatggtgaatggagtggtcaagctgcttacaaaaccctgggacgtgattcccatggttacccagatcgccatgacagataccacgcctttcggccaacagagagtgtttaaggagaaagtcgacacacggacccccaaggcgaagcgcggcaccgcccagatcatggaagtgacagctaaatggctgtgggggttcctctccagaaacaagaaacctcggatttgtacgagagaggaatttacccggaaggttcgctctaatgccgctatcggagccgtgttcgtcgacgagaaccaatggaatagcgccaaagaggcggtggaagatgagagattttgggacctggttcatcgggaacgcgagcttcacaagcagggcaagtgcgctacatgcgtgtacaacatgatggggaaaagagaaaagaaactgggagagttcggcaaggccaaagggtcccgggccatttggtacatgtggctcggcgctcgcttcctggagtttgaagccctgggattcatgaatgaggatcactggttttctagagaaaacagcctctccggcgtcgagggggagggactgcataaacttggctatatcctgcgggacatttctaaaatccccgggggaaatatgtacgctgatgacaccgccggctgggatacacgcatcaccgaagacgatctccagaacgaggcgaagattacagacatcatggaacccgagcacgccctgcttgctaagagcattttcaaactgacctatcagaataaggtggtcagagtgcaacggcctgccaaaaacgggacggttatggatgtgatctcccgcagagaccagcggggcagcggacaggtcggcacctacgggctcaatacatttaccaacatggaagctcagctgattcgccaaatggagtctgagggaatcttctcccccagcgaactggagacacctaacctcgccggcagagtgctggattggcttgaaaagcatggggtggagcggctgaaaagaatggcgatctctggagacgactgtgttgtgaagcccattgatgaccgctttgccaccgctctcacggccctgaatgatatgggcaaggtccggaaagacatcccgcagtgggaaccttccaaggggtggaacgattggcaacaggtgcccttctgcagccaccactttcatcaacttattatgaaagacggcagagagatcgttgtgccttgtcgcaatcaggatgagctggtcggacgggctagagtgtcccagggcgccgggtggtctctccgcgaaacagcttgcctgggaaagagctatgcccagatgtggcaactgatgtacttccaccggagagacctccgcctggcggccaacgctatttgttccgccgtccccgtggattgggttcctaccagccggacaacctggtctatccatgcccaccatcagtggatgacgaccgaggacatgctttccgtgtggaatagagtctggattgaagagaacccctggatggaagataaaacacacatcagctcttggggcgacgtgccgtatctggggaagcgcgaggaccagtggtgcggaagcctcatcggcctgaccgctcgggccacatgggcgaccaatattcaagttgctatcaaccaggtgagacggcttattgggaatgagaactacctggattacatgacatccatgaagagatttaaaaatgaatctgaccctgagggcgccctctggtga

SEQ ID NO: 18949 - RNA, 9879 nt, synthetic construct
  misc_feature 1..9879: note = derived and/or modified CDS sequence (opt5) from DENV-1__FJ410243__SS-prME
  source 1..9879: mol_type = other RNA
tccgtgaccatgctgctgatgctgatgcccaccgcccttgctttccacctgacgacccggggcggggaacctcatatgatcgtctccaagcaggaacggggaaaatctctcctgtttaagaccagcgccggcgttaatatgtgcacccttatcgcgatggacctgggggagttctgtgaagatacaatgacctacaaatgcccccgcatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttcgggggatgagctatgtgatgtgtacaggctctttcaaactggagaaggaagtcgcggagacccagcacggaaccgtgctcgttcagatcaagtacgagggcacagacgctccgtgcaaaattcctttttccacccaggatgaaaagggggtgacacaaaacggaagactgatcacggccaatcccatcgtcaccgacaaagagaagcctgtgaacattgaagccgagccgcccttcggcgagagctatatcgtgattggggctggagaaaaagccctgaaactttcttggtttaagaaaggcagctccatcgggaagatgttcgaggctacagcccgcggcgcgcggagaatggccattctcggagataccgcttgggactttggctctatcgggggagttttcacaagcgtcggcaaactggtgcatcagatctttgggaccgcctacggagtgctgttctccggcgtcagctggacgatgaagattgggatcggcgtgctcctgacctggcttggactcaattctcgctccacaagcctctctatgacctgtattgctgttggcctggtgacactgtaccttggggtcatggtgcaggccgattccggatgcgttatcaactggaaaggccgggaactcaagtgtgggagcggaatttttgtgaccaatgaggtccacacatggaccgaacagtataagttccaagcggactcccctaaaagactgtctgccgctatcggcaaggcctgggaggagggggtgtgcggcattcgcagcgctacgcggctggaaaacatcatgtggaaacagatctccaacgagctcaatcatattctgcttgaaaacgacatgaagtttacagttgtggtcggagatgtggccggcatcctggcccaggggaaaaagatgattagaccgcagcccatggagtacaaatattcttggaaaagctggggaaaggctaagatcattggcgcggacgtgcaaaatgccaccttcatcatcgatgggcctaacacccccgaatgtcctgacgatcagcgcgcttggaatatttgggaggtcgaggactacggatttggcatcttcacaaccaacatttggctcaagctgcgggattcctatacgcaggtttgcgaccacagactgatgagcgccgccatcaaagattctaaggctgtgcacgccgacatgggctactggattgaatccgagaaaaatgaaacatggaaacttgcgcgcgctagcttcatcgaggtgaagacctgtatctggcccaaatctcatacactctggtccaacggggtcctggaaagcgagatgattatcccgaagatttatggaggccctatctctcagcacaattaccggcccgggtactttacccaaacagccggaccttggcatctgggcaaactcgagctggatttcgacctttgcgaagggaccacggtggttgtggatgagcactgcggaaacagaggccccagcctgcggaccacaaccgtcacaggcaagattatccacgaatggtgttgccgctcctgtaccctccctcccctgagatttaaaggggaggacggatgctggtatggcatggagatccggccggtgaaggaaaaggaggaaaatctggttaaaagcatggtgtctgccgggtccggagaggtcgacagcttctcccttggcctcctgtgtatttctatcatgattgaagaggtgatgagaagccgctggtcccggaagatgctgatgacggggacactcgctgtctttttcctgcttatcatgggacagctgacctggaacgatctcattagactgtgcatcatggtgggcgccaatgcgtctgaccgcatgggcatggggacaacctacctggctcttatggccacctttaaaatgagacctatgttcgccgtcggactgctctttcggcgcctgacaagcagagaggtgctcctgcttacgattggcctgtccctcgtggcttctgtcgaactgcccaacagcctggaggaacttggggatggactggccatgggcatcatgatcctcaagctgctcaccgacttccagtcccatcaactgtgggctacacttctgagcctcacctttattaaaacaaccttctctctgcactatgcctggaagacgatggcgatggttctgtccatcgtgagcctttttcccctgtgtctctctacaacctcccagaagaccacatggctgcctgtgctcctggggagccttggatgcaaaccgctgaccatgttcctgattgccgagaataagatctggggccggaaatcttggcccctcaacgaaggcattatggctgtcgggatcgtgtccatcctgcttagctccctgctcaagaacgatgttcctctggccggacccctcattgctggcgggatgctgatcgcctgttacgtgattagcggatctagcgccgacctttccctggagaaagctgcggaggtctcttgggaagaggaagccgagcatagcggcgcttcccacaatatcctggtggaagttcaggatgacgggcctatgaagattaaagatgaggagcgcgacgatatgctcacaatcctgcttaaggccacgctgctcgccgtgtctggagtctatcccctgagcatccctgctaccctcttcgtgtggtacttttggcagaagaaaaagcaaagatccggcgtcctgtgggacacaccctctccgcctgaagtggagcgggccgttcttgatgacggcatttatcgcatcatgcagagagggctgctgggacggagccaggtgggcgtcggggtgttccaggaaaacgtttttcataccatgtggcacgtgacacgcggagcggtcctcatgtaccaaggcaaaagactggagccctcctgggctagcgtgaagaaagaccttatttcttacgggggaggctggcggctgcagggctcctggaataccggggaggaagtgcaggttatcgccgtcgagcctggaaagaaccccaagaatgtgcagacggccccgggcaccttcaaaacaagcgaaggggaggtgggagctattgccctcgattttaagcctggcacctctgggtcccccatcgtcaacagagaaggaaaaattgtgggcctgtatggcaatggggttgtgacaaccagcggaacatacgtctccgcgatcgctcaagccaaggcctctcaggagggccctctccccgagatcgaagacgaggtgttccgcaaacggaacctgacgattatggatcttcaccccgggagcggaaagaccagacgctatctgcctgctatcgttcgggaagccattaagagaaaactgcgcacactcatcctggctccgacccgggtggtcgcctccgagatggcggaagcccttaagggcatgcccattagataccagaccacagctgtgaaaagcgagcatacggggaaggagatcgttgacctgatgtgccacgccacctttacaatgcgcctcctgtctcctgtgcgggtccccaattataacatgatcattatggatgaagctcatttcaccgacccttccagcatcgccgccagaggctacatttctacacgggtgggaatgggcgaggctgcggccatctttatgaccgctacgccccctgggagcatggaagccttcccgcaatccaatgccgtgattcaggatgaggaacgcgacatccccgagagatcttggaacagcggatatgagtggatcacagattttcctggcaaaaccgtctggttcgttccctccattaagtctgggaatgacatcgctaactgtctgcggaagaatggaaaacgcgtgattcagctcagcagaaagaccttcgatacagaataccagaaaaccaagaacaacgactgggactacgtggtcacaaccgatatctccgagatgggcgccaattttcgggcggacagagtgattgatcctcgccggtgccttaaacccgttatcctgaaggacgggccggaaagagtgattctggctggccctatgcccgtcacggtggccagcgccgctcaacgccggggaagaatcggccgcaaccacaataaggagggggatcagtatatctacatgggacagcccctcaacaatgacgaggatcatgcccactggacagaagcgaaaatgctgcttgacaacattaatacccctgagggcatcattcccgccctgttcgaacctgagcgggaaaagtctgctgccatcgatggggagtatagactccgcggagaggctagaaaaacatttgttgaactgatgcggcgcggcgacctgccggtgtggctctcctacaaggtcgccagcgaggggttccagtattccgatagacggtggtgctttgacggcgaacgcaacaatcaagtgcttgaggaaaacatggatgtcgagatttggaccaaagagggagaaagaaagaaactgcggcccagatggctggacgctcgcacgtactctgaccctctcgccctgcgggagttcaaggaatttgcggccggcagacgcagcgtgtccggggatcttatcctggagatcggaaagctcccccagcacctgacccagcgggctcagaatgccctggacaacctcgttattcttcataattctgaacaaggcgggagagcttatcggcacgccatggaggagctgcctgatacaatcgaaaccctgatgctcctggcccttattgctgtgctgacaggaggcgtgaccctcttctttctgagcggccgcgggctgggaaaaacatccatcggcctcctttgtgtcatggcgagctctgttctgctgtggatggcctccgtggagccccattggattgctgccagcatcatcctcgagttctttctgatggtgcttctgattccggagcctgacagacagcggacaccccaggataaccagctcgcctacgtcgtgatcgggctgctgttcatgattctcacggttgctgccaatgagatgggacttctggaaacaaccaagaaagacctgggcatcgggcacgtggcggtcgagaaccaccatcacgccgctatgctcgatgtggacctgcatcctgcctctgcttggaccctttacgccgtcgcgacaaccattatcacacccatgatgcgccacacgattgaaaacaccacagccaatatctccctgaccgctatcgccaaccaagctgccattctcatgggactggataagggctggcctatcagcaaaatggacattggcgtgcccctgctcgctcttgggtgctattctcaggttaatccgctgacactgaccgccgcggtgctcatgctggtcgcccattacgctatcattggacctggccttcaggccaaggctacgagagaggcccaaaagcggaccgccgcggggatcatgaaaaaccccacagtggatggaatcgttgctattgacctggatcccgtggtctatgacaccaagtttgaaaaacagctcggccagatcatgctgctgattctctgtacaagccagatccttctgatgcgcaccacgtgggccctgtgcgagtccattacactcgctaccgggcctctgacaaccctttgggagggatctccgggcaagttctggaataccacaatcgccgtgagcatggccaacatcttcagaggctcctacctggctggggccggactcgcgtttagcctgatgaaatccctgggcgggggacggcgcggcacgggggcccaaggagaaaccctcggcgagaagtggaagagacagcttaatcagctgtctaaaagcgagttcaacacatataagcggtccggcattatggaggtggacagatctgaagctaaagaggggctgaagcgcggagagaccacaaaacacgccgttagccggggcaccgctaagctcagatggtttgtcgaacgcaatctggtgaagcccgaggggaaagtgatcgatcttggatgtggcagagggggatggtcctactattgcgccggcctgaagaaagtcacggaagttaagggctacacaaaagggggacctggccacgaggaacccattcctatggcgacctacgggtggaacctcgtgaagctgcattctggaaaagacgtgttctttattccccctgagaagtgtgataccctgctctgcgacattggcgagagctccccgaatcccacaatcgaagaggggagaacccttcgcgtcctgaagatggtggaaccttggctgcggggaaaccagttctgtattaaaatcctcaatccctatatgcctagcgttgtggagacactggagcaaatgcagagaaagcacggcggcatgcttgtccgcaaccccctgtctagaaattccacgcatgaaatgtactgggtgagctgcgggaccggaaacatcgtttctgccgtgaatatgacatccagaatgctcctgaaccgctttaccatggctcaccggaaaccgacatatgagagagatgtcgacctgggcgccgggacccgccacgtggctgtggaacctgaggtcgccaacctcgatattatcggacagagaattgaaaatatcaagcatgagcacaaaagcacgtggcattacgacgaggataacccctataagacctgggcttaccacggctcttatgaagttaagccctccgggagcgcctccagcatggtgaatggagtggtcaaactgcttacaaagccttgggacgtgattcccatggttacccagatcgcgatgacagataccacacctttcggccaacagcgggtgtttaaagagaaggtcgacacccgcacgccgaaagccaagagaggcacagctcagatcatggaagtgaccgccaagtggctgtgggggttcctctctcggaacaaaaagcccagaatttgtacccgggaggaatttacacgcaaagttagaagcaatgctgccatcggagccgtgttcgtcgacgagaaccaatggaactccgcgaaggaggctgtggaagatgagcggttttgggacctggttcatcgcgaaagagagcttcacaaacagggcaagtgcgccacgtgcgtgtacaacatgatggggaagcgggagaagaagctgggagagttcggcaaagccaaggggtctcgcgctatttggtacatgtggctcggcgccagattcctggagtttgaagctctgggattcatgaatgaggatcactggtttagccgggaaaactccctctctggcgtcgagggggagggactgcataaacttggctatatcctgcgcgacattagcaagatccctgggggaaatatgtacgccgatgacaccgcgggctgggatacaagaatcaccgaagacgatctccagaacgaggccaaaattacagacatcatggaacccgagcacgctctgcttgccaagtccattttcaagctgacctatcagaataaagtggtccgggtgcaacgccctgctaagaacgggacagttatggatgtgatctctagacgggaccagcgcggcagcggacaggtcggcacctacgggctcaatacgtttaccaacatggaagcccagctgattagacaaatggagtccgagggaatcttcagcccctctgaactggagacaccgaacctcgcgggccgggtgctggattggcttgaaaaacatggggtggagagactgaagcgcatggccatctccggagacgactgtgttgtgaaacctattgatgaccggtttgctaccgccctcacagctctgaatgatatgggcaaggtcagaaaggacatcccccagtgggaacctagcaaagggtggaacgattggcaacaggtgcccttctgctctcaccactttcatcaacttattatgaaggacggccgcgagatcgttgtgccttgtcggaatcaggatgagctggtcggacgggcccgcgtgtcccagggcgctgggtggagcctccgggaaaccgcctgcctgggaaaatcctatgcgcagatgtggcaactgatgtacttccacagacgcgacctccggctggccgctaacgccatttgttctgccgtccccgtggattgggttccgacgagcagaacaacctggtccatccatgctcaccatcagtggatgacaaccgaggacatgcttagcgtgtggaatcgcgtctggattgaagagaacccttggatggaagataagacgcacatctcttcctggggcgacgtgccctatctggggaaacgggaggaccagtggtgcggaagcctcatcggcctgaccgccagagcgacatgggctaccaatattcaagttgccatcaaccaggtgcggagacttattgggaatgagaactacctggattacatgacatctatgaagcgctttaagaatgaaatcgaccccgagggcgccctctggtga

SEQ ID NO: 18950 - RNA, 9879 nt, synthetic construct
  misc_feature 1..9879: note = derived and/or modified CDS sequence (opt5) from DENV-1__FJ410244__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacgagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatgaacaagctgacgcttaaagggatgtcttatgtgatgtgtacaggctccttcaagctggagaaggaagtcgccgagacccagcacggaaccgtgctcgttcagatcaaatacgagggcacagatgcgccgtgcaagattccttttagcacccaggacgaaaaaggggtgacacaaaatggacggctgatcacggctaaccccatcgtcaccgataaggagaaacctgtgaatattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagacaccgcctgggattttggcagcatcgggggagttttcacatccgtcggcaagctggtgcatcagatctttgggaccgcttacggagtgctgttcagcggcgtctcttggacgatgaaaattgggatcggcgtgctcctgacctggcttggactgaactccagaagcacatctctctccatgacctgtattgccgttggcctggtgacactgtaccttggggtcatggtgcaggctgacagcggatgcgttatcaattggaagggccgcgaactcaagtgtgggtccggaatttttgtgaccaacgaggtccacacatggaccgaacagtataaattccaagccgattctcctaagcggctgagcgcggccatcggcaaggcttgggaggagggggtgtgcggcattagatccgccacgcgcctggaaaacatcatgtggaagcagatctctaatgagctcaaccatattctgcttgaaaatgacatgaaatttacagttgtggtcggagacgtggctggcatcctggcccaggggaagaaaatgattcggccgcagcccatggagtacaagtatagctggaagtcctggggaaaagccaagatcattggcgctgatgtgcaaaacaccaccttcatcatcgacgggcctaatacacccgaatgtcctgatgaccagagagcgtggaacatttgggaggtcgaggattacggatttggcatcttcaccacgaatatttggctcaacctgcgcgacagctatacacaggtttgcgatcaccggctgatgtctgccgctatcaaagactccaaggccgtgcacgccgatatgggctactggattgaaagcgagaaaaatgaaacctggaaacttgctagagcctctttcatcgaggtgaagacatgtatctggcccaaatcccataccctctggagcaacggggtcctggaatctgagatgattatcccgaagatttatggaggccctatcagccagcacaattaccgccccgggtactttacacaaaccgcgggaccttggcatctgggcaaactcgagctggacttcgatctttgcgaagggacgaccgtggttgtggacgagcactgcggaaaccggggcccctccctgagaacaaccacagtcaccggcaagattatccacgaatggtgttgccggagctgtacgctccctcccctgcgctttaaaggggaggatggatgctggtatggcatggagatcagaccggtgaaggaaaaggaggaaaatctggttaaatctatggtgtccgctgggagcggagaggtcgactccttctctcttggcctcctgtgtattagcatcatgattgaagaggtgatgcggtccagatggtctcgcaagatgctgatgacagggaccctcgccgtctttttcctgcttatcatgggacagctgacatggaacgacctcattcggctgtgcatcatggtgggcgccaatgctagcgatagaatgggcatggggaccacctacctggcccttatggcgacatttaaaatgcgccctatgttcgctgtcggactgctctttagacggctgacgtcccgcgaggtgctcctgcttaccattggcctgtctctcgtggccagcgtcgaactgcccaactccctggaggaacttggggacggactggccatgggcatcatgatcctcaagctgctcacagatttccagagccatcaactgtgggctacccttctgtctctcacatttattaaaaccacgttctccctgcactatgcctggaagacaatggctatggttctgagcatcgtgtctctttttcccctgtgtctctccaccaccagccagaagacaacctggctgcctgtgctcctggggtctcttggatgcaaaccgctgacaatgttcctgattgccgagaacaagatctggggcagaaaatcctggcccctcaatgaaggcattatggcggtcgggatcgtgagcatcctgctttccagcctgctcaagaacgacgttcctctggccggacccctcattgctggcgggatgctgatcgcctgttacgtgatttctggaagctccgctgatctttctctggagaaagccgccgaggtcagctgggaagaggaagctgagcattccggcgcgtctcacaatatcctggtggaagttcaggacgatgggacgatgaagattaaagacgaggagcgggatgacaccctcacaatcctgcttaaggccaccctgctcgctgtgagcggagtctatcctctgtccatccccgccacactcttcgtgtggtacttttggcagaagaaaaagcaacgctctggcgtcctgtgggataccccttcccctcccgaagtggagagagccgttcttgacgatggcatttatcggatcatgcagcgcgggctgctgggaagatcccaggtgggcgtcggggtgttccaggaaaacgtttttcatacgatgtggcacgtgacccggggagctgtcctcatgtaccaaggcaaacgcctggagcccagctgggcctctgtgaagaaagaccttatttcctacgggggaggctggagactgcagggcagctggaatacaggggaggaagtgcaggttatcgcggtcgagcccggaaagaaccctaagaatgtgcagaccgctcccggcacattcaaaacctctgaaggggaggtgggagccattgccctcgactttaagccgggcacatccgggagccctatcgtcaaccgggaaggaaaaattgtgggcctgtatggcaatggggttgtgacgacctccggaacatacgtctctgctatcgcccaagcgaaggctagccaggagggccccctccctgagatcgaagatgaggtgttcagaaaacgcaacctgaccattatggaccttcaccccgggtccggaaagacccggagatatctgcccgccatcgttcgcgaagccattaagcggaaactgagaacactcatcctggctcctacgcgcgtggtcgccagcgagatggctgaagcccttaagggcatgccgattcggtaccagaccacagcggtgaaatctgagcataccgggaaggagatcgttgatctgatgtgccacgccacatttaccatgagactcctgtcccccgtgcgcgtccctaattataacatgatcattatggacgaagctcatttcacggatcccagctctatcgccgctcggggctacattagcacaagagtgggaatgggcgaggccgccgctatctttatgaccgcgacccctcccgggtccgtggaagccttccctcaatctaatgctattatccaggacgaggaacgggatatcccggagcgcagctggaactccggatatgagtggattacagactttcccggcaaaaccgtctggttcgttccttctatcaagagcgggaatgatattgccaactgtctgagaaagaacggaaaacgggtgatccagctctcccgcaagacattcgacaccgaataccagaaaacgaagaataacgattgggactacgtggtcacaaccgacattagcgagatgggcgccaattttagagctgatcgggtgatcgaccccagacgctgccttaaacctgttattctgaaggatgggcccgaacgggtgatcctggccggcccgatgcctgtcacagtggcgtctgctgcccaaagacgcggacggatcggcagaaaccacaataaggagggggaccagtatatttacatgggacagcccctcaacaatgatgaggaccatgcccactggaccgaagctaaaatgctgcttgataacatcaatacgcccgagggcattatccctgccctgttcgaacccgagcgcgaaaagtccgcggccattgacggggagtatcggctcagaggagaggctcgcaaaacctttgttgaactgatgagacggggcgatctgcctgtgtggctcagctacaaggtcgcctccgaggggttccagtattctgaccgcagatggtgctttgatggcgaacggaacaatcaagtgcttgaggaaaacatggacgtcgagatctggacaaaagagggagaacgcaagaaactgagaccgcggtggctggatgctagaacctacagcgaccccctcgccctgcgcgagttcaaggaatttgctgccggccggagatccgtgtctggggaccttatcctggagattggaaagctccctcagcacctgacacagcgcgcgcagaatgccctggataacctcgttatgcttcataatagcgaacaaggcgggcgggcttatagacacgccatggaggagctgcccgacaccatcgaaacactgatgctcctggctcttattgccgtgctgaccggaggcgtgacactcttctttctgtccggccgggggctgggaaaaacaagcatcggcctcctttgtgtcatggcctcttccgttctgctgtggatggctagcgtggagcctcattggattgcggcctctatcatcctcgagttctttctgatggtgcttctgattcccgagccggatcgccagagaacccctcaggacaaccagctcgcttacgtcgtgatcgggctgctgttcatgattctcaccgttgccgccaacgagatgggacttctggaaacaaccaagaaagatctgggcatcgggcacgtggctgtcgagaatcaccatcacgccgcgatgctcgacgtggatctgcatcccgcctccgcttggacactttacgccgtcgctacgaccattatcacacctatgatgcggcacaccattgaaaacacaaccgccaatatcagcctgacggcgatcgccaaccaagctgccattctcatgggactggacaagggctggcccatctctaaaatggatattggcgtgcctctgctcgctcttgggtgctatagccaggttaatcccctgaccctgacagccgctgtgctcatgctggtcgcccattacgcgatcattggaccgggccttcaggccaaggctacccgcgaggcccaaaagagaacagctgccgggatcatgaaaaaccctaccgtggacggaatcgttgccattgatctggaccccgtggtctatgatgcgaagtttgaaaaacagctcggccagatcatgctgctgattctctgtacgtcccagatccttctgatgcggacaacctgggctctgtgcgagtctattacactcgccaccgggcccctgaccacactttgggagggaagccctggcaagttctggaatacgaccatcgctgtgtccatggccaacatcttccgcggcagctacctggccggggctggactcgccttttccctgatgaaatctctgggcgggggaagacggggcacaggggcgcaaggagaaaccctcggcgagaagtggaagcgccagcttaatcagctgagcaaatccgagttcaacacatataagagatctggcattatggaggtggaccggagcgaagccaaagaggggctgaagagaggagagaccacgaaacacgctgtttcccgcggcacagccaagctccggtggtttgtcgaaagaaatctggtgaagccggaggggaaagtgatcgaccttggatgtggccgcgggggatggtcttactattgcgctggcctgaagaaagtcaccgaagttaagggctacaccaaagggggacccggccacgaggaacctattcccatggccacatacgggtggaacctcgtgaagctgcatagcggaaaagatgtgttctttatccctcccgagaagtgtgacaccctgctctgcgatattggcgagtccagccctaatccgacaatcgaagaggggcggacgcttagagtcctgaagatggtggaaccctggctgcgcggaaaccagttctgtattaaaatcctcaatccttatatgccctctgttgtggagaccctggagcaaatgcagcggaagcacggcggcatgcttgtcagaaaccctctgtcccgcaatagcacacatgaaatgtactgggtgtcttgcgggaccggaaacatcgtttccgcggtgaacatgacaagccggatgctcctgaatagatttaccatggcccaccgcaaacccacgtatgagcgggacgtcgatctgggcgctgggaccagacacgtggccgtggaaccggaggtccctaacctcgacattatcggacagcgcattgaaaatatcaagcatgagcacaaatctacatggcattacgatgaggacaacccctataagacctgggcttaccacggctcctatgaagttaagcccagcgggtccgccagctctatggtgaatggagtggtcaaactgcttacaaagccttgggatgtgattcccatggttacccagatcgctatgacagacaccacgcctttcggccaacagagagtgtttaaagagaaggtcgatacacggaccccgaaagccaagcgcggcaccgcgcagatcatggaagtgacagccaagtggctgtgggggttcctcagcagaaacaaaaagccccggatttgtacgagagaggaatttacccggaaagttcgctccaatgctgccatcggagctgtgttcgtcgacgagaaccaatggaactctgccaaggaggccgtggaagacgagagattttgggatctggttcatcgggaacgcgagcttcacaaacagggcaagtgcgcgacatgcgtgtacaacatgatggggaagagagagaagaagctgggagagttcggcaaagctaaggggagccgggccatttggtacatgtggctcggcgcccgcttcctggagtttgaagctctgggattcatgaatgaggaccactggttttccagagaaaactctctcagcggcgtcgagggggagggactgcataaacttggctatatcctgcgggatatttccaagatccctgggggaaatatgtacgccgacgataccgctggctgggacacacgcatcaccgaagatgacctccagaacgaggccaaaattacagatatcatggaacccgagcacgcgctgcttgccaagtctattttcaagctgacctatcagaataaagtggtcagagtgcaacggcctgctaagaacgggacggttatggacgtgatcagccgcagagatcagcggggctccggacaggtcggcacctacgggctcaacacatttaccaatatggaagcccagctgattcgccaaatggagagcgagggaatcttctctccctccgaactggagacaccgaacctcgctggcagagtgctggactggcttgaaaaacatggggtggagcggctgaagagaatggccatcagcggagatgactgtgttgtgaaacctattgacgatcgctttgcgaccgccctcacggctctgaatgacatgggcaaggtccggaaggatgtgccccagtgggaaccttctaaagggtggaacgactggcagcaggttcccttctgctcccaccactttcatcaacttatcatgaaggatggcagagagattgtggtcccttgtcgcaatcaggacgagctggtgggacgggccagagtcagccagggcgctgggtggtccctccgcgaaacagcctgcctgggaaaatcttatgctcagatgtggcaactgatgtacttccaccggagagatctccgcctggccgcgaacgccatctgtagcgctgtgcccgttgactgggtgccgacctcccggacaacctggagcattcatgcccaccatcagtggatgacgaccgaggatatgctttctgtctggaatagagtgtggatcgaagagaacccttggatggaagacaagacacacatttccagctggggcgatgttccctatctggggaaacgcgaggaccagtggtgcggatctctcatcggcctgaccgcccgggctacatgggccaccaatatccaagtggcgattaaccaggtcagacggcttatcgggaatgagaactacctggactacatgacaagcatgaagagatttaagaatgaatccgatcccgagggcgctctctggtga

SEQ ID NO: 18951 - RNA, 9879 nt, synthetic construct
  misc_feature 1..9879: note = derived and/or modified CDS sequence (opt5) from DENV-1__FJ410245__SS-prME
  source 1..9879: mol_type = other RNA
agcgtgaccatgctgctcatgctgatgcccacagcccttgctttccacctgacgacccggggcggggaacctcatatgatcgtctccaagcaggaacggggaaaatctctcctgtttaagaccagcgccggcgttaacatgtgcacccttattgcgatggacctgggggaactctgtgaagatacaatgacctacaaatgccccagaatcacagagaccgaacccgacgatgtggactgttggtgcaatgctacggatacctgggtgacatatggaacctgttcccaaacaggcgagcaccggcgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcaaaggggaggacggatgctggtatggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgccggatgctcatgacagggaccctggccgttttctttcttctgattatgggacagctcacatggaacgatctgatcagactgtgcattatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcatcatgattctgaaactcctgacagactttcaatcccatcagctttgggctaccctgctcagcctgacattcatcaagaccacgttttctctgcactatgcctggaaaacaatggctatggttctttccattgtgagcctgttccccctctgtctgtctaccacctcccagaagacaacctggctccctgtgctgcttgggagcctgggatgcaagccgctgacaatgtttctcatcgccgagaataaaatttggggccggcgctcttggcccctgaacgaaggcatcatggcggtcgggatcgtgtccattcttctgagctccctcctgaagaacgatgttcctctcgccggacccctgatcgctggcgggatgcttattgcctgttacgtgatcagcggatctagcgctgacctgtccctggagaaagccgccgaggtctcttgggaagaggaagctgagcatagcggcgcgtcccacaatattctcgtggaagttcaggatgacgggacgatgaagatcaaagatgaggagagagacgataccctgacaatccttctgaaggccaccctcctggctgtgtctggagtctatcctctcagcattcccgccacactgttcgtgtggtacttctggcagaagaagaagcagcggtccggcgtcctttgggacaccccttctcccccggaagtggagcgcgccgttctggatgacggcatctatagaattatgcagcgggggctgctcggacgcagccaggtgggcgtcggggtgtttcaagaaaacgttttccatacgatgtggcacgtgaccagaggagctgtcctgatgtaccagggcaaacggcttgagccttcctgggccagcgtgaagaaagacctgatctcttacgggggaggctggagactccagggctcctggaatattggggaggaagtgcaggttatcgcggtcgagcccggaaagaaccctaaaaatgtgcaaacagctcccggcacctttaagacaccggaaggggaggtgggagccattgccctggatttcaagcctggcaccagcgggtctcccatcgtcaaccgcgaaggaaaaatcgtgggcctctatggcaatggggttgtgacaacgtccggaacctacgtcagcgctattgcccaggcgaaggcttcccaggagggccctctgcccgagatcgaagacgaggtgtttcggaaaagaaaccttacaattatggatctgcaccccgggtctggaaagacccgccggtatctgcctgccatcgttagagaagccattaaaaagaagctccgcaccctgatccttgctccgacacgggtggtcgccagcgagatggctgaagccctgaaaggcatgcccatcagataccaaacgaccgcggtgaagtccgagcatacagggaaagagattgttgacctcatgtgccacgccaccttcacaatgcgcctgctgagccctgtgcgggtccccaattataacatgatcattatggatgaagctcattttaccgacccttcttccatcgccgctagaggctacattagcacgcgggtgggaatgggcgaggccgccgctatcttcatgacagcgacaccccctgggtctgtggaagcctttccgcagagcaatgctgtcatccaggatgaggaacgcgacattcccgagagatcctggaactctggatatgagtggatcaccgatttccctggcaagacagtttggtttgtgcccagcattaaatccgggaatgacatcgccaactgtctccggaagaatggaaagcgcgtgattcagctttctagaaaaaccttcgatacagaataccaaaagaccaaaaacaacgactgggactacgtcgtgacgacagatatcagcgagatgggcgccaatttccgggctgacagagttattgatcctcgccggtgcctgaagcccgtgatcctgaaagacgggccggaaagagtcatcctcgccggccctatgcccgtgaccgttgcgtccgctgcccagcgccggggaagaattggccgcaaccacaataaggagggggatcagtatatctacatgggacagcccctgaacaatgacgaggatcatgcccactggacagaagctaagatgcttctggacaacattaatacccctgagggcatcattcccgccctctttgaacctgagcgggaaaagagcgcggccatcgatggggagtatagactgcgcggagaggctagaaagacgttcgtggagctgatgcggcgcggcgacctcccggtctggctttcttacaaagtggcctccgaggggtttcaatatagcgatagacggtggtgcttcgacggcgaacgcaacaatcaggtcctggaggaaaacatggatgtggagatctggaccaaggagggagaacgcaagaagctgcggcccagatggctcgacgctcgcacatactccgaccctctggcccttcgggagtttaaagagttcgctgccggcagacgctctgttagcggggatctgattctcgagatcggaaagctgccccagcacctgacccagcgggcgcaaaatgccctcgacaaccttgtgatgctgcataattccgaacagggcgggagagcttatcggcacgccatggaggagctgcctgatacaattgaaaccctcatgctgcttgctctgatcgccgtgctcacaggaggcgtcaccctgtttttcctgtctggccgcgggctcggaaagacgagcattggccttctgtgtgttatggcctccagcgtgctgctctggatggcttctgtggagccccattggatcgcggcctccatcattctggaatttttccttatggtcctgctcatcccggagcctgacagacagcggacaccccaggataaccaactggcttacgtggttattgggctgctctttatgatccttaccgtggccgccaatgagatgggactgctggaaaccaccaaaaaggacctcggcattgggcacgtcgctgtggagaaccaccatcacgccgcgatgctggatgtcgaccttcatcctgccagcgcttggaccctgtacgccgtggctacaacgatcattacccccatgatgcgccacacaatcgaaaacaccacagccaatatctctctcaccgcgattgccaaccaggctgccatcctgatgggactggataaaggctggcctatttccaagatggacatcggcgttcccctccttgctctggggtgctatagccaggtgaatccgctgacgctcaccgccgctgtcctgatgcttgtggcccattacgcgattatcggacctggcctgcaagccaaagctacaagagaggcccagaagcggaccgctgccgggatcatgaagaaccccacagttgatggaattgtggccatcgacctcgatcccgtcgtgtatgacgcgaaattcgaaaagcagctgggccagattatgctgctcatcctttgtacctctcaaattctgctgatgcgcacgacatgggctctctgcgagagcatcaccctggccacagggcctcttaccaccctgtgggagggatccccgggcaaattttggaatacaacgatcgctgtgtctatggccaacattttcagaggcagctacctcgccggggctggactggccttctccctgatgaaaagcctcggcgggggacggcgcggcaccggggcgcagggagaaacacttggcgagaaatggaagagacagctgaatcagctgtccaagtctgaatttaacacctataaacggagcggcatcatggaggttgacagatccgaagccaaggaggggctcaaacgcggagagacaaccaagcacgctgtctctcggggcacggccaaactgagatggttcgtggaacgcaatcttgtgaagcccgaggggaaggtcattgatctgggatgtggcagagggggatggagctactattgcgctggcctcaaaaaggttacagaagtgaaaggctacaccaaagggggacctggccacgaggaacccatccctatggccacctacgggtggaacctggtgaaactgcattccggaaaggacgtctttttcattccccctgagaaatgtgatacactcctttgcgacatcggcgagtctagcccgaatcccaccattgaagaggggagaacactgcgcgtgctgaagatggttgaaccttggctccggggaaaccaattttgtatcaagatcctgaatccctatatgccttccgtggtcgagacgcttgagcagatgcagagaaaacacggcggcatgctggtgcgcaaccccctcagcagaaattctacccatgaaatgtactgggtttcctgcgggacaggaaacattgtgagcgcggtcaatatgacctctagaatgctgctgaaccgcttcacaatggcccaccggaagccgacctatgagagagatgtggacctcggcgctgggacgcgccacgtggccgtcgaacctgaggttgctaacctggatatcattggacagagaatcgaaaatattaaacatgagcacaagtccacctggcattacgacgaggataacccctataaaacatgggcctaccacggcagctatgaagtgaagccctctgggtccgctagctccatggtgaatggagtcgtgaaacttctgaccaaaccttgggacgttatccccatggtgacacaaatcgccatgaccgatacaaccccttttggccagcagcgggtcttcaaggagaaagtggacacgcgcacaccgaaggcgaaaagaggcaccgcccaaattatggaagttaccgctaagtggctctgggggtttctgagccggaacaagaaacccagaatctgtacacgggaggagttcacgcgcaaggtgagatctaatgccgctattggagccgtctttgtggacgagaaccagtggaatagcgccaaagaggcggttgaagatgagcggttctgggaccttgtgcatcgcgaaagagagctgcacaagcagggcaaatgcgctacctgcgtctacaacatgatggggaagcgggaaaagaaactcggagagtttggcaaggccaaagggtcccgcgccatctggtacatgtggctgggcgctagattcctggagttcgaagccctcggatttatgaatgaggatcactggttctctcgggaaaacagcctgtccggcgtggagggggagggacttcataagctgggctatattctccgcgacatctctaaaatccctgggggaaatatgtacgctgatgacacagccggctgggataccagaattacagaagacgatctgcagaacgaggcgcggatcaccgacattatggaacccgagcacgcccttctggctaagagcatctttaaactcacatatcaaaataaggtcgtgcgcgttcagagacctgccaagaacgggaccgtgatggatgtcatttcccggcgcgaccagagaggctctggacaggtgggcacgtacgggctgaataccttcacaaacatggaagctcaactgatccggcagatggagagcgagggaatcttttcccccagcgaactcgagaccccgaacctggccgaaagagtgcttgattggctggagaaatatggcgttgaacgcctcaagcggatggcgatttctggggacgactgtgtggtcaaacctatcgatgacagattcgccacagctctgaccgcccttaatgatatgggaaaggtgcgcaaagacattccccagtgggagccttccaagggctggaacgattggcagcaagttcccttttgcagccatcacttccaccagctgatcatgaaggacgggcgggagattgtggtcccttgtagaaatcaggatgaactcgtgggccgcgctcgggtctctcagggagccggctggtccctgagagagacggcttgcctggggaaaagctacgcccaaatgtggcagctcatgtattttcatcgccgggacctgagacttgcggccaacgctatctgttccgccgtgcccgttgattggattccgacatctcgcaccacatggagcatccacgcccatcaccagtggatgaccacggaagacatgctgtccgtgtggaatcgggtctggatcgaggaaaacccttggatggaggataagacccatattagctcttggggagacgtgccctacctcggcaaaagagaggaccaatggtgcgggtccctgatcggacttacagctcgggccacctgggcgacaaatattcaggttgctatcaaccaggtgagacgcctgattggcaatgaaaactacctcgattatatgaccagcatgaagcggttcaaaaatgagtctgaccccgaaggggccctgtggtga

SEQ ID NO: 18952 - RNA, 9879 nt, synthetic construct
  misc_feature 1..9879: note = derived and/or modified CDS sequence (opt5) from DENV-1__FJ410246__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagataagcctgtgaacatcgaggccgaaccgcccttcggcgagtcttatattgtgatcggggccggagagaaagctctgaaacttagctggtttaagaaaggctcctctattgggaagatgttcgaagccaccgctagaggcgcccgccggatggcgatcctcggagacacagcctgggattttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgacagcggatgcgttattaactggaaaggccgcgagctcaagtgtgggtccggaatctttgtgacaaatgaagtccacacctggacagagcaatataagttccaggccgactctcctaaacggctgagcgcggccattggcaaggcttgggaagagggggtgtgcggcatcagatccgccacccgcctggagaacatcatgtggaaacagatttctaacgaactcaatcatatcctgcttgagaacgatatgaagtttacggttgtggtcggagacgtggctggcattctggcccaggggaaaaagatgatccggccgcaacccatggaatacaaatatagctggaagtcctggggaaaggccaaaattatcggcgctgatgtgcagaatacaaccttcatcattgacgggcctaacacccccgagtgtcctgatgaccagagagcgtggaatatctgggaagtcgaggattacggatttggcattttcacaaccaacatctggctcaagctgcgcgacagctatacgcaggtttgcgatcaccggctgatgtctgccgctattaaagactccaaggccgtgcacgccgatatgggctactggatcgagagcgagaagaatgagacatggaaacttgctagagcctctttcatcgaagtgaagacctgtatttggcccaaatcccatacactctggagcaacggggtcctggagtctgaaatgatcattccgaagatctatggaggccctattagccaacacaattaccgccccgggtactttacccagacagcgggaccttggcatctgggcaaactcgagctggacttcgatctttgcgaggggaccacggtggttgtggacgaacactgcggaaaccggggcccctccctgagaaccacaaccgtcacaggcaagatcatccacgagtggtgttgccggagctgtaccctccctcccctgcgctttaaaggggaagacggatgctggtatggcatggagattagaccggtgaaggagaaggaagagaatctggttaaatctatggtgtccgctgggagcggagaagtcgattccttctctcttggcctcctgtgtatcagcattatgacggaggaagtgatgcggtccagatggtctcgcaagatgctgatgacagggaccctcgccgtctttttcctgcttatcatgggacagctgacatggaacgacctcattcggctgtgcatcatggtgggcgccaatgctagcgatagaatgggcatggggaccacctacctggcccttatggcgacatttaaaatgcgccctatgttcgctgtcggactgctctttagacggctgacgtcccgcgaggtgctcctgcttaccattggcctgtctctcgtggccagcgtcgagctgcccaactccctggaagaacttggggacggactggccatgggcatcatgatcctcaagctgctcacagatttccaaagccatcagctgtgggctacccttctgtctctcacatttattaaaaccacgttctccctgcactatgcctggaagacaatggctatggttctgagcatcgtgtctctttttcccctgtgtctctccaccaccagccagaagacaacctggctgcctgtgctcctggggtctcttggatgcaaaccgctgacaatgttcctgattgccgaaaataagatctggggcagaaaatcctggcccctcaacgagggcattatggcggtcgggatcgtgagcatcctgctttccagcctgctcaagaacgacgttcctctggccggacccctcattgctggcgggatgctgatcgcctgttacgtgatttctggaagctccgctgatctttctctggaaaaagccgccgaggtcagctgggaggaagaggctgaacattccggcgcgtctcacaatatcctggtggaggttcaggacgatgggacgatgaagattaaagacgaagaacgggatgacaccctcacaatcctgcttaaggccaccctgctcgctgtgagcggagtctatcctctgtccatccccgccacactcttcgtgtggtacttttggcaaaagaaaaagcagcgctctggcgtcctgtgggataccccttcccctcccgaggtggaaagagccgttcttgacgacggcatttatcggatcatgcagcgcgggctgctgggaagatcccaggtgggcgtcggggtgttccaagagaacgtttttcatacgatgtggcacgtgacccggggagctgtcctcatgtaccagggcaaacgcctggaacccagctgggcctctgtgaagaaagatcttatttcctacgggggaggctggagactgcagggcagctggaatacaggggaggaggtgcaggttatcgcggtcgaacccggaaagaaccctaagaatgtgcaaaccgctcccggcacattcaaaacctctgagggggaagtgggagccattgccctcgactttaagccgggcacatccgggagccctatcgtcaaccgggagggaaaaattgtgggcctgtatggcaatggggttgtgacgacctccggaacatacgtctctgctatcgcccaggcgaaggctagccaggaaggccccctccctgagatcgaggatgaagtgttcagaaaacgcaacctgaccattatggaccttcaccccgggtccggaaagacccggagatatctgcccgccatcgttcatgaggccattaagcgcaaactgcggacactcatcctggctcctacgagagtggtcgccagcgaaatggctgaggcccttaagggcatgccgattcgctaccaaaccacagcggtgaaatctgaacacaccgggaaggagatcgttgatctgatgtgccatgccacatttaccatgcggctcctgtcccccgtgagagtccctaattataacatgatcattatggacgaggctcacttcacggatcccagctctatcgccgctcgcggctacattagcacacgggtgggaatgggcgaagccgccgctatctttatgaccgcgacccctcccgggtccgtggaggccttccctcagtctaatgctgtcattcaggacgaagagagagatatcccggaacggagctggaactccggatatgagtggatcacagactttcccggcaaaaccgtttggttcgtgccttctattaagagcgggaatgatatcgccaactgtctgcgcaagaatggaaaaagagtgattcagctctcccggaagacattcgacaccgagtaccagaagacgaagaacaacgactgggattacgtcgtgacaaccgacatcagcgaaatgggcgccaattttcgcgctgatagagttattgacccccggagatgccttaaacctgtgatcctgaaggatgggcccgagcgcgtcattctggccggcccgatgcctgtgacagttgcgtctgctgcccagcggagaggacgcatcggccggaaccataataaggaaggggaccagtatgtgtacatgggacagcccctcaacaatgatgaggaccacgcccactggaccgaggctaaaatgctgcttgataacatcaatacgcccgaaggcattatccctgccctgttcgagcccgaaagagagaagtccgcggccattgacggggaatatcgcctccggggagaggctagaaaaacctttgtcgagctgatgcgcagaggcgatctgcctgtgtggctcagctacaaggtcgcctccgaagggttccaatattctgaccggcgctggtgctttgatggcgagagaaacaatcaggtgcttgaagagaacatggacgttgaaatctggacaaaagagggagagcggaagaaactgcgcccgagatggctggacgctcggacctacagcgatcccctcgccctgagagagttcaaggagtttgctgccggccgccggtccgtgtctggggaccttattctggaaatcggaaagctccctcagcatctgacacagagagcgcaaaatgccctggataacctcgtgatgcttcacaatagcgagcagggcgggcgcgcttatcggcatgccatggaggaactgcccgacaccatcgagacactgatgctcctggctcttattgccgtcctgaccggaggcgttacgctgttctttctgtccggcagagggctgggaaaaacaagcatcggcctcctttgtgtgatggcctcttccgtgctgctgtggatggctagcgtcgaacctcactggattgcggcctctatcattctcgagttctttctgatggtgcttctgatccccgaaccggatcggcagcgcacccctcaggacaaccaactcgcttacgttgtgatcgggctgctgttcatgattctcaccgtcgccgccaatgagatgggacttctggagacaaccaagaaagatctgggcatcgggcacgtggctgtcgaaaaccatcaccatgccgcgatgctcgacgtggatctgcaccccgcctccgcttggacactttacgccgttgctacgaccattatcacacctatgatgagacataccattgagaacacaaccgccaatatcagcctgacggcgattgccaaccaggctgccatcctcatgggactggacaagggctggcccatctctaaaatggatattggcgtgcctctgctcgctcttgggtgctatagccaggtcaatcccctgaccctgacagccgctgtgctcatgctggttgcccactacgcgatcattggaccgggccttcaagccaaggctacccgggaagcccagaagcgcacagctgccgggatcatgaaaaaccctaccgtggacggaattgtcgccatcgatctggaccccgtggtgtatgacgcgaagtttgagaaacagctcggccagatcatgctgctgattctctgtacgtcccaaatccttctgatgagaacaacctgggctctgtgcgaatctattacactcgccaccgggcccctgaccacactttgggagggaagccctggcaagttctggaatacgaccatcgctgtttccatggccaacattttccggggcagctacctggccggggctggactcgccttttccctgatgaaatctctgggcgggggacgcagaggcacaggggcgcagggagagaccctcggcgaaaagtggaagcggcagcttaatcagctgagcaaatccgagttcaacacatataagcgctctggcatcatggaagtcgatagaagcgaggccaaagaagggctgaagcggggagagaccacgaaacacgctgtgtccagaggcacagccaagctccgctggtttgtggagcggaatctggtcaagccggaagggaaagttatcgaccttggatgtggcagagggggatggtcttactattgcgctggcctgaagaaagtgaccgaggtgaagggctacaccaaagggggacccggccatgaggaacctattcccatggccacatacgggtggaacctcgtcaagctgcacagcggaaaagatgtgttctttatccctcccgaaaagtgtgacaccctgctctgcgatattggcgagtccagccctaatccgacaatcgaggaagggcgcacgcttcgggttctgaagatggtggagccctggctgagaggaaaccaattctgtattaaaatcctcaatccttatatgccctctgtcgtggaaaccctggagcagatgcagcgcaagcatggcggcatgcttgttcggaaccctctgtccagaaatagcacacacgagatgtactgggtgtcttgcgggaccggaaacattgtctccgcggtgaatatgacaagccgcatgctcctgaaccggtttaccatggcccacagaaaacccacgtatgaacgcgacgtggatctgggcgctgggacccggcatgtcgccgttgagccggaagtggctaacctcgacatcatcggacagagaattgagaatatcaagcacgaacataaatctacatggcactacgatgaggacaacccttataagacctgggcctaccatggctcctatgaggtgaagcccagcgggtccgctagctctatggtcaatggagtggttaaactgcttacaaagccctgggatgtgattcctatggtcacccaaatcgccatgacagacaccacgcccttcggccagcagcgcgtgtttaaagaaaaggttgacacaagaacccctaaagcgaagcggggcaccgcccaaattatggaggtgacagctaagtggctgtgggggttcctcagccgcaacaaaaagccgagaatctgtacgcgggaagagtttaccagaaaagtccggtccaatgccgctatcggagccgtgttcgttgatgaaaaccagtggaactctgccaaggaggcggtggaggacgaacgcttttgggatctggtccacagagagcgggaacttcacaaacagggcaagtgcgctacatgcgtgtacaacatgatggggaagcgcgagaaaaagctgggagagttcggcaaagccaaggggagcagagccatttggtacatgtggctcggcgctcggttcctggagtttgaggccctgggattcatgaatgaagaccattggttttcccgcgagaactctctcagcggcgtcgaaggggagggactgcacaaacttggctatatcctgagagatatttccaagatccccgggggaaatatgtacgctgacgataccgccggctgggacacacggattaccgaggatgacctccagaacgaagcgaaaatcacagatatcatggagcctgaacatgccctgcttgctaagtctattttcaagctgacctatcaaaataaagtggttcgcgtgcagagacccgccaagaacgggacggtcatggacgtgatcagccggcgcgatcagagaggctccggacaggtgggcacctacgggctcaatacatttaccaacatggaggctcaactgattcggcagatggaaagcgagggaatcttctctccttccgagctggaaacacccaacctcgccggccgcgttctggactggcttgagagacacggggtggaacggctgaaaagaatggcgattagcggagacgattgtgtcgtgaagccgatcgacgatcgctttgccaccgctctcacggccctgaatgacatgggcaaagttcggaaggatatccctcagtgggagccctctaaggggtggaacgactggcagcaagtgcctttctgctcccaccattttcaccagcttattatgaaagatggcagagaaatcgtcgtgccctgtcgcaatcaggacgagctggtcggacgggctagagtgagccagggcgccgggtggtccctccgcgagacagcttgcctgggaaagtcttatgcccaaatgtggcagctgatgtacttccatcggagagatctccgcctggcggccaacgctatttgtagcgccgttcctgtggactgggtccccacctcccggacaacctggagcatccacgcccatcaccagtggatgacgaccgaagatatgctttctgtgtggaatagagtttggattgaggaaaacccgtggatggaggacaaaacacacatctccagctggggcgacgtgccttatctggggaagcgcgaagatcaatggtgcggatctctcattggcctgaccgctcgggccacatgggcgaccaatatccaggtcgctatcaaccaggtgagacggcttattgggaatgagaactacctggactacatgacaagcatgaaaagatttaagaatgagtccgatcccgaaggcgccctctggtga

SEQ ID NO: 18953 - RNA, 9879 nt, synthetic construct
  misc_feature 1..9879: note = derived and/or modified CDS sequence (opt5) from DENV-1__FJ410247__SS-prME
  source 1..9879: mol_type = other RNA
agcgtgaccatgctgctcatgctgatgcccaccgcgcttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaggacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaggctcctacaaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaatcggatctggggccgcagatcttggccccttaacgaaggcatcatggccgtggggattgtctccatcctgctcagctccctgctcaaaaacgatgtgcctctggcgggaccccttattgccggcgggatgctgatcgcttgttacgttattagcggatctagcgccgacctgtccctcgagaaggctgccgaggtgtcttgggaagaggaagccgagcatagcggcgcttcccacaatatcctggtcgaagtgcaggatgacgggaccatgaaaatcaaggatgaggagcgggacgatacacttaccattctgctcaaagcgacactgctcgccgtttctggagtgtatcctctgagcatccccgctaccctttttgtctggtacttctggcaaaagaaaaagcagcgctccggcgtgctgtgggacacgccttctcccccggaagtcgagagagccgtgctggatgacggcatttatcggatcatgcagcgcgggctcctgggaagaagccaggttggcgtgggggtcttccaagaaaacgtgtttcataccatgtggcacgttacacggggagccgtgcttatgtaccagggcaagagactggagccttcctgggctagcgtcaaaaaggacctcatttcttacgggggaggctggcgcctgcagggctcctggaataccggggaggaagtccaggtgatcgccgttgagcccggcaagaaccctaagaatgtccaaacaacccccggcacattcaaaacgccggaaggggaggtgggagcgattgctctcgattttaagcctggcaccagcgggtctcccatcgtgaaccgggaaggaaagatcgtcggcctgtatggcaatggggtggttacaacctccggaacctacgtgagcgccattgcccaggctaaagcctcccaggagggccctcttcccgagatcgaagacgaggtcttcagaaagcgcaacctgacaattatggatctgcaccccgggtctggaaaaacgcggagatatctccctgcgatcgtgcgcgaagctattaagcggaaactgagaacccttatcctggccccgacacgcgttgtggccagcgagatggctgaagccctcaagggcatgcccatccggtaccaaaccacagctgtcaagtccgagcataccgggaaagagattgtggacctgatgtgccacgccacgtttacaatgagactgctcagccctgttcgggtgcccaattataacatgatcattatggatgaagcgcatttcaccgacccttcttccatcgccgctcgcggctacattagcaccagagtcggaatgggcgaggccgctgccatctttatgacagccacaccccctgggtctgtggaggctttcccgcagagcaatgcggtgatccaggatgaggaacgggacattcccgagcgctcctggaactctggatatgagtggatcacagattttcctggcaagaccgtctggttcgttcccagcattaaatccgggaatgacatcgccaactgtcttagaaagaatggaaaacgggtgattcagctgtctagaaagacgtttgatacagaataccaaaagaccaaaaacaacgactgggactacgtggtcacaaccgatatcagcgagatgggcgctaatttccgcgccgaccgggtgattgatcctagacgctgcctgaagcccgttatcctcaaagacgggccggaacgggtgatcctggccggccctatgcccgtcacggtggcttccgccgcgcagagacgcggacggattggcagaaaccacaataaggagggggatcagtatatctacatgggacagccccttaacaatgacgaggatcatgctcactggaccgaagccaaaatgctgctcgacaacattaatacacctgagggcatcattcccgccctgttcgaacctgagcgcgaaaagagcgctgccatcgatggggagtatagactgcggggagaggcgcgcaagacctttgttgaactcatgagacggggcgaccttccggtgtggctgtcttacaaagtcgcctccgaggggttccaatatagcgatcgcagatggtgctttgacggcgaacggaacaatcaggtgctggaggaaaacatggatgtcgagatctggacaaaggagggagaacgcaaaaagctccgcccccggtggctggacgctagaacctactccgaccctcttgccctgcgcgagttcaaagaatttgctgccggccggagatctgtgagcggggatctcattctggagatcggaaagctgccccagcacctcacacagcgggctcaaaatgcccttgacaacctggttatgctgcataattccgaacagggcgggcgcgcgtatagacacgccatggaggagctccctgataccattgaaacgctgatgcttctggctctcatcgccgtgctgacaggaggcgtgaccctgttctttctctctggccgggggcttggaaaaaccagcattggcctgctgtgtgtcatggcttccagcgttctcctgtggatggcctctgtggagccccattggatcgccgcttccatcattcttgagttctttctgatggtgctcctgatcccggagcctgaccgccagagaacaccccaggataaccaactggcgtacgtcgtgattgggctccttttcatgatcctgaccgttgccgctaatgagatgggactgctcgaaacaacgaagaaggacctgggcattgggcacgtggccgtcggaaaccaccatcacgccgctatgcttgatgtggacctgcatcctgccagcgcgtggaccctctacgccgtcgctacaaccatcattacacccatgatgcggcacaccatcgagaacacgaccgccaatatctctctgacagctattgccaaccaggcggccatcctgatgggcctcgataaaggctggcctatttccaagatggacatcggggtgccccttctggctctgggatgctatagccaggttaatccgctcaccctgacagccgctgtgcttatgctggtcgcccattacgctattatcggccctgggctccaagccaaagcgacccgcgaagcccagaagagaacggctgccggaatcatgaaaaaccccacagtggatggcattgttgctatcgacctggatcccgtggtctatgacgccaagtttgagaagcagctggggcagattatgctccttatcctgtgtacctctcaaattctgctcatgcggacaacctgggccctgtgcgaaagcatcacccttgcgacaggacctctgacgaccctctgggagggctccccgggcaaattctggaatacaaccatcgctgtgtctatggccaacatttttcgcgggagctacctggctggagccggcctggccttctccctcatgaaaagccttgggggaggcagacgggggacaggagctcagggcgagaccctgggcgaaaaatggaagagacagctgaatcagctctccaaatctgagttcaacacgtataagcgcagcgggatcatggaagtggaccggtccgaggccaaggaaggactgaaaagaggcgagacaaccaagcacgcggtttctcgcgggaccgccaaacttcggtggtttgtcgagagaaatctggtgaagcccgaaggaaaagtgattgatctcggctgtgggcgcggaggctggagctactattgcgctggcctgaagaaggtcacagaggttaaagggtacaccaagggaggccctgggcacgaagaacccatccctatggccacatacggatggaacctggtgaaactccattccggcaaggacgtgttctttattccccctgaaaaatgtgatacgcttctgtgcgacatcggggagtctagcccgaatcccaccattgaggaaggacggacactgagagtcctcaagatggtggagccttggctgcgcggcaaccaattctgtatcaaaatccttaatccctatatgccttccgttgtggaaaccctggagcagatgcagcggaagcacggcgggatgctcgtcagaaaccccctgagccgcaattctacacatgagatgtactgggtgtcctgcggaaccggcaacattgttagcgctgtgaatatgacgtctcggatgctgctcaacagatttaccatggcccaccgcaagccgacatatgaaagagatgtcgacctgggggcgggaacccggcacgtggccgtggagcctgaagtcgctaaccttgatatcattggccagcgcatcgagaatattaaacatgaacacaagtccacatggcattacgacgaggataacccctataaaacctgggcctaccacgggagctatgaggttaagccctctggatccgctagctccatggtgaatggcgtggtcaaactgctcacaaagccttgggacgtgatccccatggttacccaaatcgccatgacggatacaacccctttcggccagcagagagtgtttaaggaaaaagtcgacacccggacaccgaaggctaaacaagggacggcccagattatggaggtgaccgcgaagtggctgtggggattccttagcagaaacaaaaagccccggatctgtacacgcgaagagtttaccagaaaggttcggtctaatgccgctattggcgccgtgttcgtcgacgaaaaccagtggaatagcgctaaagaggccgtggaggatgaacgcttttgggacctggttcatagagagcgggaactccacaagcaggggaaatgcgccacatgcgtgtacaacatgatgggaaagcgcgagaaaaagctgggcgagttcgggaaggcgaaaggctccagagctatctggtacatgtggctgggagcccggtttctcgagttcgaggccctgggcttcatgaatgaagatcactggttttctcgcgagaacagcctttccggggtcgaaggagagggcctgcataagctcgggtatattctgagagacatctctaaaatccctggaggcaatatgtacgctgatgacaccgccgggtgggatacacggattaccgaggacgatcttcaaaacgaagctcgcatcacggacattatggagcccgaacacgccctgctcgccaagagcatcttcaaactgacctatcagaataaggtggtcagagtgcagcggcctgccaaaaacggcacagttatggatgtgatttcccgcagagaccagcggggatctggccaagtcgggacctacggactgaatacatttaccaacatggaggctcagctcatcagacagatggaaagcgagggcatcttctcccccagcgagctggaaacgccgaaccttgccgagcgcgtgctggattggctcgaaaagtatggggtggagcggctgaagagaatggctatttctggagacgactgtgttgtgaaacctatcgatgaccgctttgccacagcgcttaccgccctgaatgatatgggcaaggtccggaaagacattccccagtgggaaccttccaaggggtggaacgattggcaacaggtgcccttctgcagccatcactttcaccagctcatcatgaaagacggcagagagattgttgtgccttgtcgcaatcaggatgagctggtcggacgggctagagtgtctcaaggcgccgggtggtccctgcgcgaaacagcttgcctcggaaagagctacgcccagatgtggcagctgatgtatttccatcggagagaccttcgcctggctgccaacgcgatctgttccgccgtccccgtggattggattccgacctctcggacgacctggagcatccacgctcatcaccaatggatgacaaccgaggacatgctctccgtttggaatagagtgtggatcgaagagaacccttggatggaagataagacacatattagctcttggggcgacgtcccctacctggggaaacgggaggaccagtggtgcggatcccttatcggcctgaccgccagagccacatgggctaccaatattcaggtggccatcaaccaggttcgccggctcattgggaatgagaactacctggattatatgacgagcatgaagagatttaaaaatgaatctgaccccgagggcgcgctgtggtga

SEQ ID NO: 18954 - RNA, 9879 nt, synthetic construct
  misc_feature 1..9879: note = derived and/or modified CDS sequence (opt5) from DENV-1__FJ410248__SS-prME
  source 1..9879: mol_type = other RNA
agcgtgaccatgctgctcatgctgatgcccacggcccttgctttccacctgacgaccagaggcggggagcctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttatattgtgatcggggccggagaaaaagctcttaagctcagctggttcaagaaaggctcctctattgggaagatgtttgttgccaccgctagaggcgcccgccggatggcgatcctgggagatacagcctgggacttcggcagcatcgggggagtctttacctccgtgggcaaactggtgcatcagattttcgggacagcttacggagtcctctttagcggcgtgtcttggaccatgaagatcgggattggcgttctgcttacgtggctgggactcaattccagaagcacctctctgtccatgacatgtatcgccgtgggcctggtcaccctttacctcggggtgatggttcaggctgatagcggatgcgtgattaactggaaaggccgcgagctgaagtgtgggtccggaatcttcgtcacaaatgaagtgcacacctggacagagcaatataagtttcaggccgactctcctaaacggctgagcgcggccattggcaaggcttgggaagagggggtttgcggcatcagatccgccacccgcctcgagaacatcatgtggaaacagatttctaacgaactgaatcatatccttctggagaacgacatgaagttcacggtggtcgtgggagatgtggctggcattctcgcccaggggaaaaagatgatccggccgcaacccatggaatacaaatatagctggaagtcctggggaaaggccaaaattatcggcgctgacgtccagaatacaacctttatcattgatgggcctaacacccccgagtgtcctgacgatcagagagcgtggaatatctgggaagttgaggactacggattcggcatttttacaaccaacatctggctgaagctgcgcgatagctatacacaggtgtgcgaccaccggcttatgtctgccgctattaaagattccaaggccgtgcacgccgacatgggctactggatcgagagcgagaagaatgagacatggaagctcgctagagcctctttcatcgaagtcaagacctgtatttggcccaaatcccatacactgtggagcaacggggtgctggagtctgaaatgatcattccgaagatctatggaggccctattagccaacacaattaccgccccgggtacttcacccagacagcgggaccttggcatctcggcaaactggagcttgattttaacctgtgcgaggggaccacggttgtggtcgacgaacactgcggaaatcggggcccctccctcagaaccacaaccgtgacaggcaagatcatccacgagtggtgttgccggagctgtaccctgcctcccctgcgcttcaaaggggaagatggatgctggtatggcatggagattagaccggttaaggagaaggaagagaaccttgtgaaatctatggtctccgctgggagcggagaagtggactccttttctctcggcctgctgtgtatcagcattatgatcgaggaagttatgcggtccagatggtctcgcaagatgctcatgacggggacactggccgtgttctttcttctgattatgggacagctcacctggaatgacctgatccggctgtgcattatggtcggcgccaacgctagcgatagaatgggcatggggacaacctaccttgccctgatggcgaccttcaaaatgcgccctatgctcgctgtgggactgctctttagacggctgacatcccgcgaggtgcttctgctcacgatcggcctgtctctggtcgccagcgttgagcttcccaattccctggaagaactcggggacggactggccatgggcatcatgattctcaagctgcttaccgatttccaaagccatcagctgtgggctacactcctgtctctgacctttatcaaaacaacctattcccttcactacgcctggaagacgatggctatggtgctgagcattgtgtctctcttccccctgtgtctctccacaaccagccagaagaccacatggctgcctgtccttctggggtctctgggatgcaaaccgctcaccatgtttctgatcgccgaaaacaagatttggggcagaaaatcctggccccttaacgagggcatcatggcggtggggatcgttagcattctgctctccagcctgctcaagaatgacgtgcctctggccggaccccttatcgctggcgggatgctgattgcctgttatgtcatctctggaagctccgctgatctgtctctcgaaaaagccgccgaggtgagctgggaggaagaggctgaacattccggcgcgtctcacaacattctggttgaggtgcaggacgatgggacaatgaagatcaaagacgaggaacgggatgacacgcttaccatcctgctcaaggccacactgctcgctgtcagcggagtgtaccctctgtccattcccgccacccttttcgtctggtatttttggcaaaagaaaaagcagcgctctggcgtgctgtgggatacaccttcccctcccgaggttgaaagagccgtgctggacgatggcatctaccggattatgcagcgcgggctcctgggaagatcccaggtcggcgtgggggttttccaagagaatgtgttccataccatgtggcacgtcacgcggggagctgtgcttatgtaccagggcaaacgcctggaacccagctgggcctctgtgaagaaagacctcatctcctatgggggaggctggagactgcagggcagctggaacaccggggaggaggttcaggtcattgcggtggaacccggaaagaatcctaagaacgtgcaaacagctcccggcacctttaaaacatctgagggggaagtcggagccatcgccctcgacttcaagccgggcacctccgggagccctattgtgaatcgggagggaaaaatcgttggcctgtacggcaacggggtggtcacaacgtccggaacctatgtgtctgctatcgcccaggcgaaggctagccaggaaggcccccttcctgagattgagaatgaagtttttagaaaacgcaacctgacaatcatggatctgcaccccgggtccggaaagacccggagatacctccccgccattgtgcgcgaggccatcaagcggaaactgagaacccttattctggctcctacacgcgtcgtggccagcgaaatggctgaggccctcaagggcatgccgatccggtatcaaacgaccgcggttaaatctgaacatacagggaaggagatcgtggacctgatgtgccacgccaccttcacaatgagactgctctcccccgtccgcgtgcctaattacaacatgattatcatggatgaggctcattttaccgaccccagctctattgccgctcggggctatatcagcacgagagtgggaatgggcgaagccgccgctattttcatgacagcgacccctcccgggtccgtcgaggcctttcctcagtctaatgctgttatccaggatgaggaacgggacatcccggaacgcagctggaactccggatacgagtggattaccgatttccccggcaaaacagtgtggtttgtgccttctatcaagagcgggaatgacattgccaactgtcttagaaagaacggaaaacgggtcatccagctgtcccgcaagaccttcgatacagagtaccagaaaaccaagaataacgactgggattatgtggttacgacagacattagcgaaatgggcgccaattttagagctgaccgggtgatcgatcccagacgctgcctgaaacctgtcattctcaaggacgggcccgagcgggtgatcctggccggcccgatgcctgttaccgtggcgtctgctgcccagagacgcggacggatcggcagaaaccacaataaggaaggggatcagtacatttatatgggacagccccttaacaatgacgaggatcatgcccactggacagaggctaaaatgctgctcgacaacatcaatacccccgaaggcattatccctgccctgttcgagcccgaacgcgagaagtccgcggccattgatggggaataccggctgagaggagaggctcgcaaaacgttcgtcgagctcatgagacggggcgaccttcctgtgtggctgagctataaggtcgcctccgaagggtttcaatactctgatcgcagatggtgcttcgacggcgagcggaacaatcaggtgctggaagagaacatggatgttgaaatctggaccaaagagggagagcgcaagaaactcagaccgcggtggctggacgctagaacatatagcgatccccttgccctgcgcgaatttaaggagttcgctgccggccggagatccgtgtctggggacctcatcctggaaattggaaagctgcctcagcacctcacccagcgcgcgcaaaatgcccttgacaacctggtgatgctgcataatagcgagcagggcgggcgggcttacagacacgccatggaggaactccccgatacaatcgagaccctgatgcttctggctctcattgccgtcctgacaggaggcgttaccctgtttttcctctccggccgggggcttggaaaaacgagcatcggcctgctgtgtgtgatggcctcttccgtgctcctgtggatggctagcgtcgaacctcattggattgcggcctctatcatccttgagtttttcctgatggtgctcctgattcccgaaccggaccgccagagaacacctcaggataaccaactggcttacgttgtgatcgggctcctttttatgattctgaccgtcgccgccaacgagatgggactgctcgagaccacaaagaaagacctgggcatcgggcacgtggctgtcgaaaatcaccatcacgccgcgatgcttgatgtggacctgcatcccgcctccgcttggaccctctatgccgttgctacaacgattatcacccctatgatgcggcacacaattgagaacaccacagccaatatcagcctgaccgcgatcgccaaccaggctgccattctgatgggactcgataagggctggcccatctctaaaatggacattggcgtgcctcttctggctctggggtgctacagccaggtcaatcccctcacgctgaccgccgctgtgcttatgctggttgcccattatgcgatcattggaccgggcctccaagccaaggctacacgcgaagcccagaagagaaccgctgccgggatcatgaaaaaccctacagtggatggaatcgtcgccattgacctggatcccgtggtgtacgacgcgaagttcgagaaacagctgggccagatcatgctccttattctgtgtacctcccaaatcctgctcatgcggacgacatgggctctgtgcgaatctattacccttgccacagggcccctgaccaccctctgggagggaagccctggcaagttttggaatacaacgatcgctgtttccatggccaacatcttccgcggcagctatctggccggggctggactggccttttccctcatgaaatctcttggcgggggaagacggggcaccggggcgcagggagagacactgggcgaaaagtggaagcgccagctgaatcagctcagcaaatccgagttcaacacctacaagagatctggcattatggaagtcgatcggagcgaggccaaagaagggctgaagagaggagagacaaccaaacacgctgtgtcccgcggcacggccaaacttcggtggttcgtggagagaaatctggtcaagccggaagggaaagttatcgacctcggatgtggccgcgggggatggtcttattactgcgctggcctgaagaaagtgacagaggtgaagggctacaccaaagggggacccggccacgaggagcctattcccatggccacctatgggtggaacctggtcaagctccatagcggaaaagacgtgtttttcatccctcccgaaaagtgtgatacacttctgtgcgacattggcgagtccagccctaatccgaccatcgaggaagggcggacactgagagttctcaagatggtggagccctggctgcgcggaaaccaattttgtattaaaatccttaatccttacatgccctctgtcgtggaaacgctggagcagatgcagcggaagcacggcggcatgctcgttagaaaccctctgtcccgcaatagcacccatgagatgtattgggtgtcttgcgggacaggaaacatcgtctccgcggtgaacatgaccagccggatgctgctcaatagattcacaatggcccaccgcaaacccacctacgaaaaggatgtggacctgggcgctgggacgcggcacgtcgccgttgagccggaagtggctaaccttgatattatcggacagagaattgagaatatcaaacatgaacacaagtctacctggcattatgacgaggataacccttacaagacatgggcctatcacggctcctacgaggtgaaacccagcgggtccgctagctctatggtcaatggagtggttaagctgctcaccaaaccctgggacgtgattcctatggtcacacaaatcgccatgaccgatacaaccccctttggccagcagcgcgtgttcaaggaaaaagttgacacgagaacacctaaggcgaagcggggcaccgcccaaatcatggaggtgaccgctaaatggctgtgggggtttcttagccgcaacaagaaaccgagaatttgtacacgggaagagttcacgagaaaggtccggtccaatgccgctatcggagccgtgtttgttgatgaaaaccagtggaactctgccaaagaggcggtggaggacgaacgcttctgggacctggtccatagagagcgggaactccacaagcagggcaagtgcgctacctgcgtgtacaacatgatggggaaacgcgagaagaaactgggagaatttggcaaggccaaagggagcagagccatttggtatatgtggctgggcgctcggttcctcgagtttgaggccctgggattcatgaatgaagatcactggttctcccgcgagaactctcttagcggcgtcgaaggggagggactgcataagctcggctacatcctgagagacatttccaaaatccccgggggaaatatgtatgctgatgacacagccggctgggatacccggatcacagaggacgatcttcagaacgaagcgaagattaccgacatcatggagcctgaacacgccctgctcgctaagtctatttttaaactgacataccaaaataaggtggttcgcgtgcagagacccgccaaaaacgggaccgtcatggatgtgatcagccggcgcgaccagagaggctccggacaggtgggcacgtatgggctgaacaccttcacaaatatggaggctcaactcattcggcagatggaaagcgagggaatcttttctccttccgagctggaaacccccaaccttgccggccgcgttctggattggctcgagaagcatggggtggaaagactgaaacggatggcgatcagcggagacgattgtgtcgtgaagccgattgacgacagattcgccacagctcttaccgccctgaatgatatgggcaaggttcgcaaagacatccctcagtgggagccctctaaggggtggaacgattggcagcaagtgcctttttgctcccaccacttccatcagctcattatgaaagacggccgggaaatcgtcgtgccctgtagaaatcaggatgagctggtcggacgcgctcgggtgagccagggcgccgggtggtccctgagagagacggcttgcctcggaaagtcttacgcccaaatgtggcagctgatgtattttcaccgccgggaccttagactggcggccaacgctatttgtagcgccgttcctgtggattgggtccccacatcccgcaccacatggagcatccatgcccaccatcagtggatgaccacggaagacatgctctctgtgtggaatcgggtttggattgaggaaaacccgtggatggaggataaaacccacatctccagctggggcgacgtgccttacctggggaagagagaagatcaatggtgcggatctcttatcggcctgacagctcgcgccacctgggcgacaaatattcaggtcgctatcaaccaggtgcggagactcattgggaatgagaactacctggactatatgaccagcatgaagcggttcaaaaatgagtccgaccccgaaggcgccctgtggtga

SEQ ID NO: 18955 - RNA, 9879 nt, synthetic construct
  misc_feature 1..9879: note = derived and/or modified CDS sequence (opt5) from DENV-1__FJ410249__SS-prME
  source 1..9879: mol_type = other RNA
agcgtgaccatgctgctgatgctgatgcccaccgcccttgctttccacctgacgacccggggcggggaacctcatatgatcgtctccaagcaggaacggggaaagtctctcctgtttaagacgagcgccggcgttaatatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagagacggcgcgacaagagatctgtcgccctcgctcctcacgtggggctgggactggagacacggaccgaaacgtggatgagctccgagggcgcctggaaacagattcagcgcgttgaaacatgggctctcagacatcccggctttaccgtgatcgccctgttccttgcgcacgccattgggacatctatcacccagaagggaatcatttttatcctgctcatgctggtcacccctagcatggctatgcggtgcgtgggcgttgggtcccgcgatttcgtggagggacttagcggcgccacatgggtcgacgtggtgctggagcatgggtcttgtgtcacgaccatggctaaggataaacccacactcgacattgaactgctgaagaccgaggttacaaaccctgccgtgctcagaaaactgtgcatcgaagcgaagatttccaataccacgacagatagccggtgtccgacccaaggagaggccacccttgtggaagaacaggacgctaactttgtctgccgcagaacattcgtggatcggggctggggcaatgggtgtggactgtttggcaaagggtctctcattacctgcgccaagttcaagtgcgttacaaaactggagggaaagacggtgcagtacgaaaaccttaaatattccgtcattgtgaccgttcacacaggcgaccagcaccaagtggggaatgagagcaccgaacatggaacaaccgctacgatcacaccccaggccccttctacagagatccagctgaccgactacggcgccctcacactggattgttcccccagaaccggcctggactttaacgaaatggtcctcctgacgatgaaggagaaaagctggcttgtgcacaagcagtggttcctggatctccctctgccctggacatccggggcttctaccagccaagagacatggaatagaaaagaccttctggtcacctttaagaccgcgcatgccaagaaacaggaagtggttgtgctcggatcccaggagggcgctatgcacacagccctgacgggggccaccgaaattcaaacaagcggaaccacaaccatcttcgctggccacctgaagtgccggctcaaaatggataagctgacgcttaaagggatgtcttatgtcatgtgtacaggctccttcaagctggagaaggaagtggccgagacccagcatggaaccgttctcgtgcagattaaatacgagggcacagacgcgccgtgcaagatcccttttagcacccaggatgaaaaaggggtcacacaaaacggaagactgattacggctaatcccatcgtgaccgacaaggagaaacctgtgaacatcgaagccgagccgcccttcggcgagtcttatattgttatcggggccggagaaaaggctctgaaacttagctggtttaaaaagggctcctctattgggaaaatgttcgaggccacagctcgcggcgcccggagaatggcgatcctcggagataccgcctgggactttggcagcattgggggagtcttcacatccgtgggcaagctggtgcaccagatctttggggctgcctacggagtcctgttcagcggcgtgtcttggaccatgaaaatcgggattggcgttctcctgacgtggcttggactcaattcccgcagcacctctctctccatgacatgtatcgctgtgggcctggtcaccctgtaccttggggtgatggttcaggccgatagcggatgcgtgattaactggaagggccgggaactcaagtgtgggtccggaatctttgtcacaaatgaggtgcatacctggacagaacagtataaattccaagcggactctcctaagagactgagcgccgctattggcaaagcctgggaggagggggtttgcggcatccgctccgctacccggctggaaaacattatgtggaagcagatctctaacgagctcaatcacatcctgcttgaaaacgacatgaaatttacggtggtcgtgggagatgtggccggcattctggcccaggggaagaaaatgatcagaccgcagcccatggagtacaagtatagctggaagtcctggggaaaagctaagattatcggcgcggacgtccaaaatacaaccttcattatcgatgggcctaacacccccgaatgtcctgacgatcagcgcgcctggaatatctgggaggttgaggactacggatttggcattttcacaaccaacatctggctcaaactgcgggatagctatacacaggtgtgcgaccatagactgatgtctgctgccattaaggattccaaagccgtgcacgctgacatgggctactggatcgaaagcgagaagaatgaaacatggaaacttgcccgcgcgtctttcattgaggtcaagacctgtatctggcccaagtcccacacactctggagcaacggggtgctggaatctgagatgatcattccgaaaatctatggaggccctattagccagcataattaccggcccgggtactttacccaaacagctggaccttggcacctgggcaagctcgagctggatttcgacctttgcgaagggaccacggttgtggtcgatgagcattgcggaaacagaggcccctccctgcggaccacaaccgtgacaggcaaaatcattcacgaatggtgttgccgcagctgtaccctccctcccctgagatttaagggggaggacggatgctggtatggcatggagatccggccggttaaggaaaaagaggaaaatctggtgaagtctatggtctccgccgggagcggagaggtggactccttctctcttggcctcctgtgtatcagcattatgatcgaagaggttatgagatcccgctggtctcggaaaatgctgatgacggggacactcgccgtgtttttctttctgattatgggacagcttacctggaacgatctgatcagactctgcattatggtcggcgctaatgccagcgaccgcatgggcatggggacaacctacctggcgctgatggctaccttcaagatgagacctatgtttgccgtgggacttctgttccggcgcctcacatccagagaggtgctgctcctgacgaccggcctttctctggtcgccagcgttgaactccccaactccctggaggaactgggggatggacttgctatgggcatcatgattctgaaactcctgacagactttcagagccaccaactctgggccaccctgctttctctgacattcatcaagaccacgttttccctccattatgcttggaagacaatggccatggtgctgagcatcgtgtctctgttccccctttgtctgtccaccaccagccagaaaacaacctggctccctgtcctgctcgggtctctgggatgcaagccgcttacaatgttcctgattgcggagaataaaatctggggccggaagtcctggcccctgaacgaaggcattatggccgtggggatcgttagcattctcctgtccagccttctgaaaaacgatgtgcctctcgctggacccctgatcgccggcgggatgctcatcgcttgttacgtcatttctggaagctccgccgacctgtctcttgagaaggccgctgaggtgagctgggaagaggaagcggagcactccggcgcctctcataatatcctggttgaagtgcaggatgacgggacgatgaaaattaaggatgaggagcgcgacgataccctgacaatcctcctgaaggctacccttctggccgtcagcggagtgtatcctctctccattcccgccacactgtttgtctggtacttctggcagaaaaagaaacaaagatctggcgtgctctgggacacccctagccctcccgaagttgagcgggctgtgctggatgacggcatctatcgcatcatgcagagagggcttctgggacggtcccaggtcggcgtgggggtttttcaggaaaacgtgttccacacgatgtggcatgtcacccgcggagccgtgctgatgtaccaaggcaagagactcgagcccagctgggcgtctgtgaaaaaggacctgatttcctacgggggaggctggcggcttcagggcagctggaatacaggggaggaagttcaggtcatcgctgtggagcccggaaagaaccctaaaaatgtgcagaccgcccccggcacatttaagacctctgaaggggaggtcggagccattgctctggatttcaaaccgggcacatccgggagccctatcgtgaacagagaaggaaagattgttggcctctatggcaatggggtggtcacgacctccggaacatacgtgtctgccatcgcgcaagctaaagccagccaggagggccccctgcctgagattgaagacgaggtttttcgcaagcggaacctcaccatcatggatctgcaccccgggtccggaaagaccagacgctatcttcccgccatcgtgcgggaagctattaaaagaaagctgcgcacactgatcctcgcccctacgcgggtcgtggctagcgagatggccgaagcgctgaaaggcatgccgattagataccagaccacagccgttaagtctgagcacaccgggaaagagatcgtggaccttatgtgccatgctacattcaccatgcgcctgctctcccccgtccgggtgcctaattataacatgattatcatggatgaagcccactttacggaccccagctctatcgctgccagaggctacattagcacacgggtgggaatgggcgaggccgctgcgatcttcatgaccgccacccctcccgggtccgtcgaggcttttcctcaatctaatgccgttattcaggatgaagaacgcgacatcccggagagaagctggaactccggatatgagtggattacagatttccccggcaagaccgtgtggttcgtgccttctatcaagagcgggaatgacatcgccaactgtctgcggaaaaatggaaagcgcgtcattcagctgtccagaaaaacatttgataccgaataccagaagacgaaaaacaacgactgggactacgtggttacaaccgatatcagcgagatgggcgctaatttccgggccgacagagtgattgatccccgccggtgcctcaagcctgtcatccttaaggacgggcccgaaagagtgattctggcgggcccgatgcctgttacagtggcttctgccgcccaacgccggggaagaatcggccgcaaccataataaagagggggatcagtatatttacatgggacagcccctgaacaatgacgaggatcacgctcattggaccgaagccaagatgctcctggacaacatcaatacgcccgagggcatcattcctgcgctttttgaacccgagcgggaaaaatccgccgctatcgatggggagtatagactgcgcggagaggccagaaagaccttcgtcgaactcatgcggcgcggcgacctgcctgtgtggctgagctacaaagtcgcttccgaggggtttcagtattctgatagacggtggtgcttcgacggcgaacgcaacaatcaagtgctcgaggaaaacatggatgttgagatttggacaaaggagggagaacgcaagaaacttcggccgagatggctggacgcccgcacctacagcgaccccctggctctccgggagtttaaggagttcgccgcgggcagacgctccgtgtctggggatctgatccttgagattggaaaactgcctcagcacctcacacagcgggcccagaatgctctggacaacctggtgatgctccacaatagcgaacaaggcgggagagcctatcggcatgctatggaggagcttcccgataccatcgaaacactgatgctgctcgccctgatcgccgtccttaccggaggcgttacgctgtttttcctctccggccgcgggctgggaaagacaagcattggcctgctctgtgtgatggcttcttccgtgcttctgtggatggcgagcgtcgagcctcactggatcgccgcttctattatcctggaatttttcctcatggtgctgcttattcccgagccggacagacagcggacccctcaggataaccagctggcctacgttgtgatcgggctcctgtttatgatcctgaccgtcgccgctaatgagatgggactccttgaaacaaccaaaaaggacctgggcattgggcatgtggccgtcgagaaccaccaccatgcggccatgctggatgtggacctccaccccgcttccgcctggacactgtacgctgttgccacgaccatcattacacctatgatgcgccataccatcgaaaacacaaccgcgaatattagccttacggccatcgctaaccaagccgctattctgatgggactcgataaaggctggcccatctctaagatggacatcggcgtgcctctgctggccctcgggtgctatagccaggtcaatccccttaccctgacagctgccgtgctgatgctcgttgcgcactacgccattatcggaccgggcctgcaggctaaggccaccagagaggctcaaaaacggacagccgccgggattatgaagaaccctaccgtggatggaatcgtcgcgattgaccttgatcccgtggtgtatgacgctaaattcgaaaagcagctgggccagatcatgctcctgatcctgtgtacgtcccagattctccttatgcgcacaacctgggccctgtgcgagtctatcacactggctaccgggcccctcaccacactgtgggagggaagccctggcaaattctggaatacgaccattgccgtttccatggccaacatctttagaggcagctaccttgctggggccggactggcgttctccctcatgaagtctctgggcgggggacggcgcggcacaggggcccaaggagaaaccctgggcgagaagtggaaaagacagctcaatcagcttagcaagtccgaatttaacacatataaacggtctggcattatggaggtcgacagaagcgaagctaaggaggggctgaaacgcggagagaccacgaagcatgccgtgtcccggggcacagctaagctgagatggttcgtggaacgcaatctcgtcaaaccggaggggaaggttatcgatctgggatgtggcagagggggatggtcttactattgcgccggccttaaaaaggtgaccgaagtgaaaggctacaccaaagggggacccggccacgaggaacctatccccatggcgacatacgggtggaacctggtcaaactccacagcggaaaggacgtgtttttcattcctcccgagaagtgtgataccctgctgtgcgacatcggcgagtccagccctaatccgacaattgaagaggggagaacgctccgcgttcttaaaatggtggaaccctggctgcggggaaaccagttttgtatcaagattctgaatccttatatgccctctgtcgtggagaccctcgagcaaatgcagagaaaacatggcggcatgctggttcgcaaccctctttcccggaatagcacacacgaaatgtactgggtgtcttgcgggaccggaaacatcgtctccgccgtgaatatgacaagcagaatgctgctcaaccgcttcaccatggctcatcggaagcccacgtatgagagagatgtggacctgggcgccgggacccgccacgtcgctgttgaaccggaggtggccaacctggatattatcggacagagaatcgaaaatattaaacacgagcataagtctacatggcactacgacgaggataacccttataagacctgggcttaccatggctcctatgaagtgaaacccagcgggtccgccagctctatggtcaatggagtggttaagctcctgacaaaaccctgggacgtgatccctatggtcacccagattgcgatgacagataccacgccctttggccaacagcgggtgttcaaggagaaagttgacacacgcacccctaaggccaagagaggcaccgctcagatcatggaagtgacagccaaatggctttgggggtttctgagccggaacaagaaaccgagaatttgtacgcgggaggagttcacccgcaaggtcagatccaatgctgccatcggagccgtgtttgttgacgagaaccaatggaactctgcgaaagaggctgtggaagatgagcggttctgggacctcgtccaccgcgaaagagagctgcataagcagggcaagtgcgccacatgcgtgtacaacatgatggggaaacgggaaaagaaacttggagagttcggcaaggccaaagggagccgcgctatctggtacatgtggctgggcgccagatttctcgagttcgaagctctgggatttatgaatgaggatcactggttctcccgggaaaactctctgagcggcgtcgagggggagggactccacaagctgggctatattcttcgcgacatctccaaaattcccgggggaaatatgtacgccgatgacaccgcgggctgggatacaagaatcaccgaagacgatctgcagaacgaggccaagattacagacatcatggaacctgagcatgctctcctggccaagtctatctttaaacttacctatcagaataaggtggttcgggtgcaacgccccgctaaaaacgggacggtcatggatgtgattagcagacgggaccagcgcggctccggacaggtgggcacctacgggctgaatacattcaccaacatggaagcccagctcatcagacaaatggagagcgagggaatcttttctccttccgaactggagacacccaacctggcgggccgggttctcgattggctggaaaagcacggggtggagagacttaaacgcatggccatcagcggagacgactgtgtcgtgaagccgattgatgaccggttcgctaccgccctgacggctctcaatgatatgggcaaggttagaaaagacgtgcctcagtgggaaccctctaaggggtggaacgattggcagcaggtccctttttgctcccatcacttccaccaactgatcatgaaagacggccgcgagatcgtggtcccctgtcggaatcaggatgagcttgtgggcagagcccgcgttagccagggagctgggtggtccctgcgggaaacagcctgcctcggaaagtcttatgcgcagatgtggcaactgatgtactttcatagacgcgacctgcggctcgccgctaacgccatttgtagcgccgtgcctgtcgattgggtgcccacctccagaacaacctggagcatccacgctcatcaccagtggatgacgaccgaggacatgctgtctgtttggaatcgcgtgtggattgaagagaacccgtggatggaagataaaacacatatctccagctggggcgacgtcccttatcttgggaagcgggaggaccagtggtgcggatctctgattggcctcaccgccagagcgacatgggctaccaatatccaagtggccattaaccaggtgcggagactgatcgggaatgagaactaccttgattacatgacaagcatgaagcgcttcaaaaatgaatccgaccccgagggcgccctgtggtga

SEQ ID NO: 18956 - RNA, 9879 nt, synthetic construct
  misc_feature 1..9879: note = derived and/or modified CDS sequence (opt5) from DENV-1__FJ410251__SS-prME
  source 1..9879: mol_type = other RNA
agcgtgaccatgctgctcatgctgatgcccaccgcccttgctttccacctgacgacccggggaggggagcctcatatgatcgtcacaaagcaggaacggggaaaatccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggaggcaaagctcttaagctctcttggttcaagaaagggagctccattggcaagatgtttgaagccacagctagaggagcccgccggatggcgatcctgggcgataccgcctgggacttcgggtctgtgggaggcgtttttacaagcgtcgggaaactggtgcatcagatcttcggaaccgcttacggcgtgctcttttccggggtcagctggacgatgaagattggcatcggagtgctgcttacctggctgggcctcaattctagatccacaagcctgtctatgacctgtattgccgttgggctggtgacactttacctcggagtcatggtgcaggctgattccggctgcgttatcaactggaaagggcgcgagctgaagtgtggaagcggcattttcgtgaccaatgaagtccacacatggaccgagcaatataagtttcaggccgactcccctaaacggctgtctgcggccatcgggaaggcttgggaagagggcgtgtgcggaattagaagcgccacgcgcctcgagaacatcatgtggaaacagatctccaacgaactgaatcatattcttctggagaacgacatgaagttcacagttgtggtcggcgatgtggtggggatcctcgctcagggcaaaaagatgattcggccgcaacccatggaacacaaatactcttggaaaagctggggcaaggccaagatcattggggccgacgtccagaataccacctttatcatcgatggacctaacacacccgagtgtcctgacgatcagagagcttggaatatttgggaagttgaggactatggcttcggcatctttaccacgaacatttggctgaagctgcgcgattcctacacacaggtgtgcgaccaccggcttatgagcgcggccatcaaagattctaaggctgtgcatgccgacatggggtattggattgagtccgagaaaaatgagacctggaagctcgccagagctagcttcatcgaagtcaagacatgtatctggcccaaatctcacaccctgtggtccaacggagtgctggagagcgaaatgattatcccgaagatttacggcgggcctatctctcaacataattatcgccccggatacttcacacagaccgccggcccttggcacctcgggaaactggagcttgattttgacctgtgcgagggaacgaccgttgtggtcgatgaacactgcggcaaccggggccccagcctcagaacaaccacagtgaccgggaagattatccatgagtggtgttgccggtcctgtacgctgcctcccctgcgcttcaaaggagaagacggctgctggtacgggatggagatcagaccggttaaggagaaggaagagaatcttgtgaaaagcatggtctctgcgggatccggcgaagtggacagcttttccctcgggctgctgtgtatttctatcatgattgaggaagttatgcggagcagatggtcccgcaagatgctcatgacaggaaccctggctgtgttccttctgctcatcatgggccagctgacatggaacgatctgattcggctttgcatcatggtcggcgccaatgcctctgacagaatggggatgggaaccacctatctggctctcatggccacatttaaaatgcgccctatgttcgcggtgggcctgctctttagacggctgacgagccgcgaggtgcttctgctcaccattgggctgtccctggtcgcttctgttgagcttcccaacagcctggaagaactgggagatggcctggccatggggatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctgggaagcctcggctgcaaaccgctgacaatgtttcttattacggaaaataagatctggggcagaaaatcttggcccctgaacgaggggattatggctgtgggagttgtgtccatcctcctgagctccctcctgaagaacgatgtccctcttgccggccccctgatcgccgggggaatgctgattgcctgttatgtgatcagcggctctagcgctgacctctccctggaaaaagccgctgaggtttcttgggaggaagaggccgaacacagcggggcctcccataatattcttgtggaggtccaggatgacggaaccatgaagatcaaagatgaggaacgggacgatacactgaccattctcctgaaggctacactcctggcggtgtctggcgtctaccctcttagcatccccgccaccctgttcgtgtggtatttttggcaaaagaaaaagcagcgctccggcgttctgtgggacacgccttctcccccggaggtggaaagagctgtcctcgatgacgggatctaccggattatgcagcgcggactgcttggcagaagccaggtgggggttggagtgttccaagagaacgtcttccacaccatgtggcacgtgacacggggcgccgtgctgatgtatcaggggaaacgcctcgaaccttcctgggccagcgttaagaaagacctgatctcttacggaggcggctggagactccaggggtcctggaataccggagaggaggtccaggtgattgctgtggaacccggcaagaaccctaagaatgtccaaacagcccccgggacctttaaaacaccggagggagaagtgggcgcgatcgctctggatttcaagcctgggacgagcggatctcccattgttaaccgggagggcaaaatcgtgggcctttacgggaatggagtcgtgaccacatccggcacctatgttagcgccattgcccaggctaaggcctcccaggaagggcctctgcccgagatcgaggacgaagtgtttagaaaacgcaacctgaccatcatggatctccatcccggatctggcaagacacggagatacctgcctgcgattgtccgcgaggctatcaagcggaaacttagaacgctgattctcgccccgacccgcgtggttgccagcgaaatggctgaggccctgaaggggatgcccatccggtatcaaacaaccgctgtgaaatccgaacacacaggcaaggagattgtcgacctgatgtgccatgccaccttcacgatgagactccttagccctgtgcgcgtgcccaattacaacatgatcatcatggatgaggcgcactttacagacccttcttccattgccgctcggggatatatcagcaccagagtcggcatgggggaagccgctgccattttcatgaccgccacaccccctggatctgttgaggcttttccgcagagcaatgcggtgatccaggatgaggaacgggacattcccgaacgctcctggaactctggctacgagtggatcaccgatttccctgggaaaacagtgtggtttgtccccagcatcaagtccggaaatgacattgccaactgtctgagaaagaatggcaaacgggtgatccagctgtctcgcaagaccttcgatacggagtatcagaaaaccaagaacaacgactgggactacgttgtgaccacagatattagcgaaatgggggctaattttagagccgaccgggtcatcgatcctagacgctgcctcaaacccgtgattctgaaggacggcccggagcgggttatccttgccggacctatgcccgtgaccgtcgcttccgccgcgcagagacgcggccggattgggagaaaccataataaggaaggagatcagtacatctatatgggccagcccctgaacaatgacgaggatcacgctcactggacggaggccaaaatgctcctggacaacatcaatacccctgaagggattatccccgccctgttcgagcctgaacgcgaaaagagcgctgccattgatggagaataccggctcagaggcgaggcgcgcaaaacattcgtggagcttatgagaagaggggacctgccggtctggctgtcttataaggtggcctccgaaggctttcaatacagcgatcgcagatggtgcttcgacggagagcggaacaatcaggttctcgaagagaacatggatgtggaaatctggaccaaagagggcgagcgcaagaaactgagaccccggtggcttgacgctagaacatattccgaccctctggccctccgcgaatttaaggagttcgctgccgggcggagatctgtgagcggagatctgattctggaaatcggcaagctcccccagcatcttacccagcgcgctcaaaatgccctggacaacctggtcatgctccacaattccgagcaagggggacgggcgtacagacatgccatggaggaactgcctgatacaatcgagacccttatgctgctcgctctgattgccgttctgacgggcggcgtgacactctttttcctttctgggcggggactgggcaaaaccagcatcgggctgctctgtgtgatggcttccagcgtcctgctttggatggcctctgtggaaccccactggattgccgcttccatcattctggagtttttcctcatggttctgctgatcccggaacctgaccgccagagaacaccccaggataaccaactcgcgtatgtggtcatcggacttctgtttatgattctgacagtggccgctaatgagatgggcctcctggagaccacaaagaaagaccttgggatcggacacgtcgccgtggaaaaccatcaccatgccacgatgctggatgttgacctccaccctgctagcgcctggaccctgtacgcggtggccacaaccattatcacacccatgatgcggcataccattgagaacacgaccgctaatatctctctgacagccattgctaaccaggccgcgatcctcatgggccttgataagggctggcctatctccaaaatggacattggggtccccctgctggccctcggatgctacagccaggtgaatccgctgacccttacagctgccgttctgatgctcgtggctcactatgccatcattggccctgggctgcaagctaaggccacccgcgaagcgcagaagagaacggccgctggaatcatgaaaaaccccacagtcgatggcattgtggccatcgacctggatcccgtggtttacgacgctaagttcgagaaacagctcgggcagatcatgcttctgattctgtgtacctctcaaatcctcctgatgcggacaacctgggccctttgcgaaagcattaccctggccacaggacctctcacgaccctgtgggagggctccccgggcaagttttggaatacaaccatcgcggtctctatggctaacattttccgcgggagctatctggccggagctggcctcgccttttcccttatgaaaagcctcgggggaggcagacgggggacaggagcccagggcgagaccctgggcgaaaagtggaagcgccagctcaatcagctgtccaaatctgagttcaacatctacaagagaagcgggatcatggaagtggaccggtccgaggctaaagaaggacttaagagaggcgagacgacacgccacgccgtgtctcgggggaccgcgaaactgagatggttcgtcgagcgcaatctcgttaagcccgaaggaaaggtgattgatctgggctgtgggcggggaggctggagctattactgcgccggcctgaaaaaggtgaccgaggtcaaagggtatacaaagggaggccctgggcatgaggagcccatccctatggctacctacggatggaacctcgtgaaacttcactccggcaaggacgtctttttcacaccccctgaaaaatgtgatacgctgctgtgcgacattggggagtctagcccgaatcccaccatcgaggaaggaagaacactccgcgtgctgaagatggtcgagccttggcttcggggcaaccaattttgtattaagatcctgaatccctacatgccttccgtggttgaaaccctcgagcagatgcagagaaaacatggcgggatgctggtgcgcaaccccctgagcagaaattctacacacgagatgtattgggtctcctgcggaaccggcaacattgtgagcgccgtgaatatgacgtctagaatgctcctgaaccgcttcaccatggctcaccggaagccgacatacgaaagagatgtcgaccttggggccggaacccgccatgttgcggtggagcctgaagtggccaacctggatatcatcggccagagaattgagaatatcaaacacgaacataagtccacatggcactatgacgaggataacccctacaaaacctgggcttatcatgggagctacgaggtcaagccctctggatccgccagctccatggtgaatggcgttgtgaagctcctgacaaaaccttgggacgtcattcccatggtgacccaaatcgctatgacggatacaaccccttttggccagcagcgggttttcaaggaaaaagtggacacccgcacaccgaaggccaaaagagggacggctcaaattatggaggtcaccgcccggtggctttggggatttctgagcagaaacaagaagccccggatctgtacacgcgaagagttcaccagaaaagtgcggtctaatgcggccatcggcgctgtttttgtggacgaaaaccagtggaatagcgccaaggaggctgtcgaggatgaacgcttctgggacctcgtgcagaaagagagagaactgcacaagcaggggaaatgcgccacatgcgtctataacatgatgggaaagcgggagaagaaactgggcgaatttgggaaggccaaaggctcccgcgcgatttggtacatgtggctcggagctagattcctggagtttgaggcccttggcttcatgaatgaagatcactggttctctcgggagaacagcctgtccggggtggaaggagagggcctccataagctggggtacatccttcgcgacatttctaaaatccctggaggcaatatgtatgccgatgacaccgctgggtgggatacaagaattaccgaggacgatctgcaaaacgaagccaagatcacggacatcatggagcccgaacacgctctcctggccaccagcatttttaaactgacataccagaataaggttgtgcgggtccagcgccctgcgaagaacggcaccgtgatggatgtgatctccagacgggaccagcgcggatctggccaagttgggacatatggactcaataccttcacgaacatggaggcccagctgattagacagatggaaagcgagggcatctttcttccctccgagctggaaacaccgaacctcgctgagcgggtgctggattggcttgaaaaatacggggtcgagagactgaagcgcatggccattagcggagacgactgtgtggttaaacctatcgatgaccggttcgctaccgccctcacagcgctgaatgatatgggcaaggtgagaaaagacatcccccagtgggaaccttctaaggggtggaacgattggcaacaggtccccttttgctcccatcacttccaccagctgattatgaaggacggccgcgagatcgtggtcccttgtcggaatcaggatgagctcgtgggacgggcgcgcgttagccaaggcgctgggtggtctctgcgggaaaccgcctgccttggaaaatcctatgctcagatgtggcagctgatgtactttcatagacgcgacctccggctggccgctaacgccatttgtagcgcggtgcccgtcgattgggtgccgacgtccagaaccacatggtctatccacgcccatcaccaatggatgaccacagaggacatgcttagcgtttggaatcgcgtgtggattgaagagaacccttggatggaagataagacccatgtctccagctggggcgacgtgccctatctggggaaacgggaggaccagtggtgcggatctctcatcggcctgacagctagagccacctgggcctccaatattcaggtggctatcaaccaggttcggagactgatcgggaatgagaactacctcgattacatgacgagcatgaagcgcttcaaaaatgaaggcgaccccgagggagccctgtggtga

SEQ ID NO: 18957 - RNA, 9879 nt, synthetic construct
  misc_feature 1..9879: note = derived and/or modified CDS sequence (opt5) from DENV-1__FJ410252__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacactggtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcctgacacaagatgaaaagggggtgacccagaacggacggcttatcacagctaatcccattgtcacggacaaagagaagcctgtgaacatcgaagccgagccgccctttggcgagagctatattgtgatcggggccggagaaaaagctctcaagctgtcttggttcaagaaaggcagctccattgggaagatgtttgaggccaccgctagaggcgcccgccggatggcgatcctgggagatacagcctgggacttcggctctatcgggggagtttttaccagcgtcggcaaactcgtgcatcagattttcgggacagcttacggagtgctgttttccggcgtcagctggaccatgaagatcgggattggcgtgcttctgacgtggctcggactcaattctagatccaccagcctgtctatgacatgtatcgccgttggccttgtgaccctctacctgggggtcatggtgcaggctgattccggatgcgttattaactggaaaggccgcgaactgaagtgtgggagcggaatcttcgtgacaaatgaggtccacacctggacagaacaatataagtttcaggccgactcccctaaacggctctctgcggccattggcaaggcttgggaggagggggtgtgcggcatcagaagcgccacccgcctggaaaacatcatgtggaaacagatttccaacgagcttaatcatatcctgctcgaaaacgacatgaagttcacggttgtggtcggagatgtggctggcattctggcccaggggaaaaagatgatccggccgcaacccatggagtacaaatattcttggaaaagctggggaaaggccaagattatcggcgctgacgtgcagaatacaacctttatcattgatgggcctaacacccccgaatgtcctgacgatcagagagcgtggaatatctgggaggtcgaggactacggattcggcatttttacaaccaacatctggctgaaacttcgcgattcctatacgcaggtttgcgactaccggctcatgagcgccgctattaaagattctaaggccgtgcacgccgacatgggctattggatcgaatccgagaaaaatgaaacatggaagctggctagagccagcttcatcgaggtgaagacctgtatttggcccaaatctcacacactgtggtccaacggggtcctcgaaagcgagatgatcattccgaagatctacggaggccctatttctcaacataattaccgccccgggtatttcacccagacagcgggaccttggcacctgggcaaacttgagctggattttgacctctgcgaagggaccacggtggttgtggatgagcattgcggaaaccggggccccagcctgagaaccacaaccgtcacaggcaagatcatccacgaatggtgttgccggtcctgtaccctgcctccccttcgcttcaaaggggaggacggatgctggtacggcatggagattagaccggtgaaggaaaaggaggaaaatctcgttaaaagcatggtgtctgctgggtccggagaggtcgacagcttttccctgggcctgctctgtatctctattatgatcgaagaggtgatgcggagcagatggtcccgcaagatgctgatgacggggacacttgccgttttctttctgctcattatgggacagctgacctggaacgatctgatccggctttgcattatggtgggcgccaatgcttctgacagaatgggcatggggacaacctatctggccctcatggcgaccttcaaaatgcgccctatgtttgctgtcggactgctgttcagacggctgacaagccgcgaggtgcttctgctcacgatcggcctgtccctggtggcctctgtcgaacttcccaacagcctggaggaactcggggatggactggccatgggcatcatgattctcaagctgcttaccgactttcaatcccaccagctgtgggctacactcctgagcctgaccttcatcaaaacaaccttttctcttcattacgcctggaagacgatggctatggttctgtccattgtgagcctcttccccctgtgtctctctacaacctcccagaagaccacatggctgcctgtgcttctggggagcctgggatgcaaaccgctcaccatgtttctgatcgccgagaataagatttggggcagaaaatcttggccccttaacgaaggcatcatggcggtcgggatcgtgtccattctgctcagctccctgctcaagaacgatgttcctctggccggaccccttatcgctggcgggatgctgattgcctgttatgtgatcagcggatctagcgctgacctgtccctcgagaaagccgccgaggtctcttgggaagaggaagctgagcacagcggcgcgtcccataatattctggtggaagttcaggatgacgggacaatgaagatcaaagatgaggagcgggacgatacgcttaccatcctgctcaaggccacactgctcgctgtgtctggagtctaccctctgagcattcccgccacccttttcgtgtggtatttctggcaaaagaaaaagcagcgctccggcgtcctgtgggacacaccttctcccccggaagtggagagagccgttctggatgacggcatctaccggattatgcagcgcgggctcctgggaagaagccaggtgggcgtcggggtgtttcaagaaaacgttttccacaccatgtggcatgtgacgcggggagctgtccttatgtaccagggcaaacgcctggagccttcctgggccagcgtgaagaaagacctcatctcttatgggggaggctggagactgcagggctcctggaataccggggaggaagtgcaggttattgcggtcgagcccggaaagaaccctaagaatgtgcaaacagctcccggcacctttaaaacaagcgaaggggaggtgggagccatcgccctcgatttcaagccgggcacctctgggtcccctattgtcaaccgggaaggaaaaatcgtgggcctgtacggcaatggggttgtgacaacgagcggaacctatgtctccgctatcgcccaggcgaaggcttctcaggagggcccccttcctgagattgaagacgaggtgtttagaaaacgcaacctgacaatcatggatctgcaccccgggagcggaaagacccggagatacctccccgccattgttcgcgaagccatcaagcggaaactgagaacccttattctggctcctacacgcgtggtcgcctccgagatggctgaagccctcaagggcatgccgatccggtatcaaacgaccgcggtgaaaagcgagcacacagggaaggagatcgttgacctgatgtgccatgccaccttcacaatgagactgctctctcccgtgcgcgtccctaattacaacatgattatcatggatgaagctcactttaccgacccctccagcattgccgctcggggctatatctctacgagagtgggaatgggcgaggccgccgctattttcatgacagcgacccctcccgggagcgtggaagcctttcctcagtccaatgctgtcatccaggatgaggaacgggacatcccggagcgctcttggaacagcggatacgagtggattaccgatttccccggcaaaacagtttggtttgtgccttccatcaagtctgggaatgacattgccaactgtcttagaaagaatggaaaacgggtgatccagctgagccgcaagaccttcgatacagaataccagaagaccaagaacaacgactgggactatgtcgtgacgacagatatttccgagatgggcgccaatttcagagctgaccgggttatcgatcccagacgctgcctgaaacctgtgattctcaaggacgggcccgaacgggtcatcctggccggcccgatgcctgtgaccgttgcgagcgctgcccagagacgcggacggatcggcagaaaccataataaggagggggatcagtacatttatatgggacagccccttaacaatgacgaggatcacgcccattggacagaagctaaaatgctgctcgacaacatcaatacccccgagggcattatccctgccctgtttgaacccgagcgcgaaaagtctgcggccattgatggggagtaccggctgagaggagaggctcgcaaaacgttcgtggaactcatgagacggggcgaccttcctgtctggctgtcctataaggtggccagcgaggggtttcaatactccgatcgcagatggtgcttcgacggcgaacggaacaatcaggtcctggaggaaaacatggatgtggagatctggaccaaagagggagaacgcaagaaactcagaccgcggtggctggacgctagaacatattctgacccccttgccctgcgcgagtttaaggagttcgctgccggccggagaagcgtttccggggatctcatcctggagattggaaagctgcctcagcacctcacccagcgcgcgcaaaatgcccttgacaacctggtgatgctgcacaattctgaacagggcgggcgggcttacagacatgccatggaggagctccccgatacaatcgaaaccctgatgcttctggctctcattgccgtgctgacaggaggcgtcaccctgtttttcctcagcggccgggggcttggaaaaacgtccatcggcctgctgtgtgttatggccagctctgtgctcctgtggatggcttccgtggagcctcactggattgcggccagcatcatccttgaatttttcctgatggtcctcctgattcccgagccggaccgccagagaacacctcaggataaccaactggcttacgtggttatcgggctcctttttatgattctgaccgtggccgccaatgagatgggactgctcgaaaccacaaagaaagacctgggcatcgggcatgtcgctgtggagaaccaccaccatgccgcgatgcttgatgtcgacctgcaccccgcctctgcttggaccctctatgccgtggctacaacgattatcacccctatgatgcggcatacaattgaaaacaccacagccaatatctccctgaccgcgatcgccaaccaggctgccattctgatgggactcgataagggctggcccatcagcaaaatggacattggcgttcctcttctggctctggggtgctactctcaggtgaatcccctcacgctgaccgccgctgtccttatgctggtggcccactatgcgatcattggaccgggcctccaagccaaggctacacgcgaggcccagaagagaaccgctgccgggatcatgaaaaaccctacagttgatggaatcgtggccattgacctggatcccgtcgtgtacgacgcgaagttcgaaaaacagctgggccagatcatgctccttattctgtgtaccagccaaatcctgctcatgcggacgacatgggctctgtgcgagtccattacccttgccacagggcccctgaccaccctctgggagggatctcctggcaagttttggaatacaacgatcgctgtgagcatggccaacatcttccgcggctcctatctggccggggctggactggccttcagcctcatgaaatcccttggcgggggaagacggggcaccggggcgcagggagaaacactgggcgagaagtggaagcgccagctgaatcagctctctaaaagcgaatttaacacctacaagagatccggcattatggaggttgaccggtctgaagccaaagaggggctgaagagaggagagacaaccaaacatgctgtcagccgcggcacggccaaacttcggtggttcgtggaaagaaatctggtgaagccggaggggaaagtcatcgatctcggatgtggccgcgggggatggtcctattactgcgctggcctgaagaaagttacagaagtgaagggctacaccaaagggggacccggccacgaggaacctattcccatggccacctatgggtggaacctggtgaagctccactctggaaaagacgtctttttcatccctcccgagaagtgtgatacacttctgtgcgacattggcgagagctcccctaatccgaccatcgaagaggggcggacactgagagtgctcaagatggttgaaccctggctgcgcggaaaccaattttgtattaaaatccttaatccttacatgcccagcgtggtcgagacgctggagcagatgcagcggaagcatggcggcatgctcgtgagaaaccctctgtctcgcaattccacccacgaaatgtattgggttagctgcgggacaggaaacatcgtgtctgcggtcaatatgacctcccggatgctgctcaacagattcacaatggcccatcgcaaacccacctacgagcgggatgtggacctgggcgctgggacgagacacgtggccgtcgaaccggaggttgctaaccttgatattatcggacagcgcattgaaaatatcaagcacgagcataaaagcacctggcactatgacgaggataacccttacaagacatgggcctatcatggctcttacgaagtgaagccctccgggagcgcttccagcatggtgaatggagtcgtgaaactgctcaccaagccctgggacgttattcctatggtgacacaaatcgccatgaccgatacaaccccctttggccagcagagagtcttcaaagagaaggtggacacgcggacacctaaagcgaagcgcggcaccgcccaaatcatggaagttaccgctaagtggctgtgggggtttctttctagaaacaaaaagccgcggatttgtacaagagaggagttcacgcggaaagtgcgcagcaatgccgctatcggagccgtctttgtggacgagaaccagtggaactccgccaaggaggcggttgaagatgagagattctgggacctggtgcaccgggaacgcgagctccataaacagggcaagtgcgctacctgcgtctacaacatgatggggaagagagagaagaagctgggagagtttggcaaagccaaggggtctcgggccatttggtatatgtggctgggcgctcgcttcctcgagttcgaagccctgggatttatgaatgaggatcactggttcagcagagaaaactccctttctggcgtggagggggagggactgcacaaactcggctacatcctgcgggacattagcaagatccccgggggaaatatgtatgctgatgacacagccggctgggatacccgcatcacagaagacgatcttcagaacgaggcgaaaattaccgacatcatggaacctgagcatgccctgctcgctaagtccatttttaagctgacataccaaaataaagtcgtgagagttcagcggcccgccaagaacgggaccgtgatggatgtcatctctcgcagagaccagcggggcagcggacaggtgggcacgtatgggctgaataccttcacaaacatggaagctcaactcattcgccagatggagtccgagggaatctttagcccttctgaactggagacccccaaccttgccggcagagtgctggattggctcgaaaaacacggggttgagcggctgaagagaatggcgatctccggagacgactgtgtggtcaaaccgattgatgaccgcttcgccacagctcttaccgccctgaatgatatgggcaaggtgcggaaggacatccctcagtgggaacccagcaaagggtggaacgattggcagcaagttcctttttgctctcatcacttccaccagctcattatgaaggacggcagagagatcgtggtcccctgtcgcaatcaggatgagctggtgggacgggctagagtctcccagggcgccgggtggagcctgcgcgaaacggcttgcctcggaaaatcctacgcccaaatgtggcagctgatgtattttcatcggagagaccttcgcctggcggccaacgctatttgttctgccgtgcctgttgattgggtgcccacaagccggaccacatggtccatccacgcccatcaccagtggatgaccacggaggacatgctcagcgtctggaatagagtgtggattgaagagaacccgtggatggaagataagacccatatctcttcctggggcgacgttccttacctggggaaacgcgaggaccaatggtgcggaagccttatcggcctgacagctcgggccacctgggcgacaaatattcaggtggctatcaaccaggtcagacggctcattgggaatgagaactacctggattatatgacctctatgaagagattcaagaatgaaagcgaccccgagggcgccctgtggtga

SEQ ID NO: 18958 - RNA, 9879 nt, synthetic construct
  misc_feature 1..9879: note = derived and/or modified CDS sequence (opt5) from DENV-1__FJ461331__SS-prME
  source 1..9879: mol_type = other RNA
agcgtgaccatgctgctcatgctgatgcccaccgcccttgctttccacctgacgaccagaggaggggagcctcatatgatcgtgtccaagcaggaacggggaaaatctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttacgtgatttccggcagctctgctgacctgagcctcgagaaggccgccgaggtttcctgggaagaggaagctgagcattctggggcgagccacaatatcctggtggaagtccaggatgacggaacgatgaaaatcaaggatgaggagcgcgacgatacccttacaattctgctcaaagccaccctgctcgctgtgtccggcgtttatcctctgtctatccccgccacacttttcgtgtggtacttctggcaaaagaagaaacagagaagcggcgtcctgtgggacacccctagccctcccgtggtcgaacgggccgtgctggatgacgggatttatcgcatcatgcagagaggactcctgggccggtctcaggttggggtgggagtctttcaagagaacgtgttccatacgatgtggcacgttacccgcggcgctgtgcttatgtaccaggggaagagactggaacccagctgggcctccgtcaaaaaggacctcattagctacggaggcggctggcggctgagagggtcttggaatacaggagaggaggtccaggtgatcgcggttgaacccggcaaaaaccctaagaatgtccagaccgctcccgggacatttaagaccccggagggagaagtgggcgccattgccctcgatttcaaacctgggacatccggaagccccatcgtgaaccgcgagggcaagatcgtcggcctgtatgggaatggagtggttacgacctctggcacatacgtgtccgctattgcccaagcgaaagctagccaggaagggcctcttcccgagatcgaggacgaagtctttcggaagagaaacctgaccattatggatctgcaccccggatccggcaaaacccgccggtatctccctgccatcgtgagagaggccattaagcgcaagctgcggacacttatcctggctccgacgagagttgtggcctctgaaatggctgaggccctcaaagggatgcccatccgctaccagaccacagcggtcaagagcgaacataccggcaaagagattgtggacctgatgtgccacgccacattcaccatgcggctgctctcccctgttagagtgcccaattataacatgatcattatggatgaggctcattttacggaccctagctctatcgccgctcggggatacatttccacacgcgtcggcatgggggaagccgccgctatcttcatgaccgcgacaccccctggaagcgtggaggcctttccgcaatctaatgctgtgatccaggatgaagagagagacattcccgaacggagctggaactccggccacgagtggatcacagatttccctgggaagaccgtctggtttgttccctctattaaaagcggaaatgacatcgccaactgtcttcgcaagaatggcaagagagtgattcagctgtcccggaaaacattcgataccgagtatcagaagacgaaaaacaacgactgggactacgtggtcacaaccgatatctctgaaatgggggccaatttcagagctgaccgcgtgattgatcctcggagatgcctgaagcccgttatcctcaaagacggcccggagcgcgtgatcctggccggacctatgcccgtcacagtggcgagcgctgcccaacggagaggccgcattgggcggaaccataataaggaaggagatcagtacatctatatgggccagccccttaacaatgacgaggatcacgcccactggaccgaggctaagatgctgctcgacaacattaatacgcctgaagggatcattcccgccctgtttgagcctgaaagagagaaatccgcggccgttgatggagaataccgcctgagaggcgaggctcggaagaccttcgtggagctcatgcgcagaggggaccttccggtctggctgagctataaagtggcctctgaaggctttcagtactccgatcggcgctggtgcttcgacggagagagaaacaatcaagtcctggaagagaacatggatgtggaaatctggacaaaggagggcgagcggaaaaagctcagaccccgctggctggacgctcggacctatagcgaccctcttgccctgagagaatttaaagagttcgctgccgggcgccggtccgtttctggagatctcatcctggaaattggcaagctgccccagcatctcacacagagagcgcagaatgcccttgacaacctggtgatgctgcacaatagcgagcaagggggacgggcttaccgccatgccatggaggaactccctgataccatcgagacactgatgcttctggctctcattgccgtgctgaccggcggcgtcacgctgtttttcctctccgggagaggacttggcaagacatctatcgggctgctgtgtgttatggccagctccgtgctcctgtggatggctagcgtggaaccccactggattgcggcctctatcatccttgagtttttcctgatggtcctcctgattccggaacctgaccggcagcgcacaccccaggataaccagctggcttatgtggttatcggactcctttttatgattctgaccgtggccgccaatgagatgggcctgctcgagacaaccaaaaaggacctggggatcggacacgtcgctgtggaaaaccatcaccatgccgcgatgcttgatgtcgacctgcaccctgcctccgcttggacactctacgccgtggctacgaccattatcacacccatgatgagacataccattgagaacacaaccgccaatatcagcctgacggcgatcgccaaccaagctgccattctgatgggcctcgataaaggctggcctatctctaagatggacattggggttccccttctggctctgggatgctactcccaggtgaatccgctcaccctgacagccgctgtccttatgctggtggcccactatgcgatcattggccctgggctccaggccaaagctacccgggaagcccaaaagcgcacagctgccggaatcatgaagaaccccaccgttgatggcatcgtggccattgacctggatcccgtcgtgtacgacgcgaaattcgagaagcagctggggcagatcatgctccttattctgtgtacgagccagatcctgctcatgagaacaacctgggctctgtgcgaatctattacacttgccaccggacctctgaccacactctgggagggcagcccgggcaaattttggaatacgaccatcgctgtgtccatggccaacatcttccgggggtcttatctggccggagctggcctggccttcagcctcatgaagtcccttgggggaggccgcagagggacaggagcgcaaggcgagaccctgggcgaaaaatggaagcggcagctgaatcagctcagcaagtccgagtttaacacatacaaaagatctgggattatggaagttgaccgcagcgaggccaaggaaggactgaaacggggcgagaccacgaagcacgctgtctccagagggacagccaaacttcgctggttcgtggagcggaatctggtgaagcccgaaggaaaggtcatcgatctcggctgtgggagaggaggctggtcttattactgcgctggcctgaaaaaggttaccgaggtgaaagggtataccaagggaggccctgggcatgaggaacccattcctatggccacatacggatggaacctggtgaaactccacagcggcaaggacgtctttttcattccccctgaaaaatgtgatacccttctgtgcgacatcggggagtcctctccgaatcccacaatcgaggaaggacgcacgctgcgggtgctcaagatggttgagccttggctgagaggcaaccagttttgtattaagatccttaatccctacatgcctagcgtggtcgaaaccctggagcaaatgcagcgcaaacatggcgggatgctcgtgcggaaccccctgtccagaaatagcacacacgagatgtattgggtttcttgcggaaccggcaacatcgtgtccgcggtcaatatgacaagccgcatgctgctcaaccggttcaccatggcccacagaaagccgacgtacgaacgcgatgtggacctggggaccggaacaagacatgtggctgtcgagcctgaagttgccaaccttgatattatcggccagcggattgagaatatcaaacacgaacataagtctacctggcactatgacgaggataacccctacaaaacatgggcttatcatgggtcctacgaggtgaagcccagcggatctgcctccagcatggtgaatggcgtcgtgaagctgctcaccaaaccttgggacgttattcccatggtgacacagatcgctatgaccgatacgacaccttttggccaacagcgcgtcttcaaggaaaaagtggacaccagaaccccgaaggccaaacgggggacagcgcagatcatggaggttacggccagatggctgtggggatttctttcccggaacaagaagccccgcatttgtaccagagaagagttcacacggaaagtgcgcagcaatgctgccatcggcgctgtctttgtggacgaaaaccaatggaactctgccaaggaggccgttgaggatgaaagattctgggacctggtgcaccgggagcgcgaactccacaaacaggggaagtgcgcgacctgcgtctataacatgatgggaaaaagagagaagaagctgggcgaatttgggaaagctaagggcagccgggccatttggtacatgtggctgggagcccgcttcctcgagttcgaggctctgggctttatgaatgaagatcattggttctccagagagaactctcttagcggggtggaaggagagggcctgcacaaactcgggtacatcctgcgggacatttccaagatccctggaggcaatatgtatgccgatgacacagctgggtgggatacccgcatcacagaggacgatcttcagaacgaagccaaaattaccgacatcatggagcccgaacatgcgctgctcgccaaggctatttttaaactgacgtaccagaataaggtcgtgagagttcaacggcctgccaagaacggcaccgtgatggatgtcatctctcgcagagaccagcggggaagcggccaggtggggacatatggactgaataccttcacaaacatggaggctcagctcattagacaaatggaatccgagggcatcttttctcccagcgagctggaaaccccgaaccttgccgagcgcgcgctggattggctcgaaaaatacggggtggagcggctgaagagaatggccatctccggagacgactgtgttgtgaaacctattgatgaccgcttcgctacggcccttacagctctgaatgatatgggcaaggtccggaaagacatcccccagtgggaacctagcaaggggtggaacgattggcaacaggtgcccttttgctctcaccacttccatcaactcattatgaaggacggcagagagatcgttgtgccttgtcgcaatcaggatgagctggtcggacgggccagagtgtcccagggcgctgggtggagcctgcgcgaaaccgcctgcctcggaaaatcttatgcgcagatgtggcaactgatgtactttcaccggagagaccttcgcctggccgctaacgccatttgttccgccgtccccgtggattgggttccgacaagccggaccacgtggtccatccatgctcaccatcagtggatgaccacagaggacatgctctctgtgtggaatagagtctggattgaagagaacccttggatggaagataagacccacatcagctcctgggaggacgtgccctatctgggcaaacgggaggaccagtggtgcgggagccttatcggactgacagccagagcgacctgggctacaaatattcaagttgccatcaaccaggtgcgccggctcattggcaatgaaaactacctggattacatgacctctatgaagagattcaaaaatgagtccgaccccgaaggggccctgtggtga

SEQ ID NO: 18959 - RNA, 9879 nt, synthetic construct
  misc_feature 1..9879: note = derived and/or modified CDS sequence (opt5) from DENV-1__FJ410256__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacacaaactttgtgtgcagacggaccttcgtcgatcgcggctggggcaatgggtgtggactgtttggcaaggggtctctcattacatgcgctaagttcaaatgcgtgacgaagctggagggaaaaatcgttcagtacgaaaaccttaagtattccgtgatcgtcaccgtgcacacaggcgaccagcatcaagttgggaatgagagcaccgaacacggaacaaccgccacgattacaccccaggctccttctacagagatccagctgaccgactacggcgccctcacactggattgttcccccagaaccggcctggactttaacgaaatggtgctcctgacgatgaaagaaaagagctggcttgtccataaacagtggttcctggatctccctctgccctggacatccggggcctctaccagccaagagacatggaatcggaaggaccttctggtgacctttaagaccgctcacgcgaaaaagcaggaagtcgtggttctcggatcccaggagggcgccatgcacacagctctgacgggggccaccgaaattcaaacaagcggaaccacaaccatcttcgccggccatctgaaatgccgcctcaagatggataaactgacgcttaaggggatgtcttatgtgatgtgtacaggctccttcaagctggagaaagaagtcgctgagacccagcacggaaccgtgctcgttcagattaagtacgagggcacagacgccccgtgcaaaatcccttttagcacccaggatgaaaagggggtgacacaaaacggaagactgatcacggcgaatcccattgtcaccgacaaagagaagcctgtgaacatcgaagctgagccgcccttcggcgagtcttatattgtgatcggggccggagaaaaggccctgaaacttagctggtttaagaaaggctcctctattgggaagatgttcgaggctacagcccggggcgctagacgcatggccatcctcggagataccgcgtgggactttggcagcatcgggggagttttcacatccgtcggcaaactggtgcatcagatttttgggaccgcctacggagtgctgttcagcggcgtctcttggacgatgaagatcgggattggcgtgctcctgacctggcttggactcaattcccggagcacatctctctccatgacctgtatcgctgttggcctggtgacactgtaccttggggtcatggtgcaggccgatagcggatgcgttattaactggaagggcagagaactcaaatgtgggtccggaatctttgtgaccaatgaggtccacacatggaccgaacagtataagttccaagctgactctcctaaacgcctgagcgccgcgattggcaaggcctgggaggagggggtgtgcggcatccggtccacgacaagactggaaaacatcatgtggaaacagatttctaacgagctcaatcatatcctgcttgaaaacgacatgaagtttaccgttgtggtcggagatgtggctggcattctggcccaggggaaaaagatgatccgcccgcagcccatggagtacaagtatagctggaaatcctggggaaaggctaaaattatcggcgccgacgtgcaaaataccacattcatcattgatgggcctaacacccccgaatgtcctgacgatcagcgggcctggaatatctgggaggtcgaggactacggatttggcattttcacgacaaacatctggctcaagctgagagatagctatacccaggtttgcgaccaccgcctgatgtctgctgcgattaaagattccaaggccgtgcacgctgacatgggctactggatcgaaagcgagaagaatgaaacatggaaacttgcccgggcctctttcatcgaggtgaagacctgtatttggcccaaatcccatacactctggagcaacggggtcctggaatctgagatgatcattccgaagatctatggaggccctattagccagcacaattacagacccgggtactttacccaaacggctggaccttggcatctgggcaaactcgagctggatttcgacctttgcgaagggaccacagtggttgtggatgagcactgcggaaaccgcggcccctccctgcggaccacaaccgtcacgggcaagatcatccacgaatggtgttgcagaagctgtacactccctcccctgcggtttaagggggaggacggatgctggtatggcatggagattcgcccggtgaaagaaaaggaggaaaatctggttaaatctatggtgtccgccgggagcggagaggtcgactccttctctcttggcctcctgtgtatcagcattatgatcgaagaggtgatgagatcccggtggtctagaaagatgctgatgaccgggacactcgcggtctttttcctgcttattatgggacagctgacctggaacgatctcatccgcctgtgcattatggtgggcgctaatgccagcgaccggatgggcatggggaccacatacctggcccttatggctacgtttaaaatgagacctatgttcgccgtcggactgctctttcgcagactgacctcccgggaggtgctcctgcttacaatcggcctgtctctcgtggcgagcgtcgaactgcccaactccctggaggaacttggggatggactggctatgggcatcatgattctcaagctgctcaccgacttccagagccatcaactgtgggccacacttctgtctctcacctttatcaagacgacattctccctgcactatgcctggaaaaccatggctatggttctgagcattgtgtctctttttcccctgtgtctctccaccacaagccagaagaccacatggctgcctgtgctcctggggtctcttggatgcaaaccgctgacgatgttcctgatcgccgagaataagatttggggccgcaaatcctggcccctcaacgaaggcatcatggctgtcgggatcgtgagcattctgctttccagcctgctcaagaacgatgttcctctggccggacccctcatcgcgggcgggatgctgattgcctgttacgtgatctctggaagctccgctgacctttctctggagaaagccgctgaggtcagctgggaagaggaagccgagcattccggcgcctctcacaatattctggtggaagttcaggatgacgggaccatgaagatcaaggatgaggagagagacgatacactcaccatcctgcttaaagctacactgctcgcggtgagcggagtctatcctctgtccattcccgccaccctcttcgtgtggtacttttggcagaagaaaaagcaacggtctggcgtcctgtgggacacgcctagccctcccgaagtggagcgcgctgttcttgatgacggcatctatagaattatgcagcgggggctgctgggacgctcccaggtgggcgtcggggtgttccaggaaaacgtttttcataccatgtggcacgtgacaagaggagccgtcctcatgtaccaaggcaaacggctggagcccagctgggcctctgtgaagaaggaccttatctcctacgggggaggctggcgcctgcagggcagctggaataccggggaggaagtgcaggttattgctgtcgagcccggcaaaaatcctaagaatgtgcagacagcccccggcaccttcaaaacatctgaaggggaggtgggagcgatcgctctcgattttaagccgggcacgtccgggagccctattgtcaacagagaaggaaaaatcgtgggcctgtatggcaatggggttgtgaccacatccggaacctacgtctctgccatcgcccaagctaaggccagccaggagggccccctccctgagattgaagacgaggtgttccggaagagaaacctgaccatcatggatcttcaccccgggtccggaaaaacacgccggtatctgcccgcgattgttagagaagctatcaagcgcaaactgcggacgctcattctggcccctaccagagtggtcgccagcgagatggctgaagcccttaagggcatgccgatccgctaccagacaaccgctgtgaaatctgagcatacagggaaggagatcgttgacctgatgtgccacgccacctttacgatgcggctcctgtcccccgtgagagtccctaattataacatgattatcatggatgaagcgcatttcacagaccccagctctattgccgctcgcggctacatcagcacccgggtgggaatgggcgaggccgctgccatttttatgaccgccacacctcccgggtccgtggaggctttccctcaatctaatgcggtcatccaggatgaggaaagagacatcccggagcggagctggaactccggatatgagtggattaccgattttcccggcaagacagtttggttcgtgccttctatcaaaagcgggaatgacattgccaactgtctgcgcaagaatggaaaaagagtgatccagctctcccggaagaccttcgatacggaataccagaaaacaaagaacaacgactgggactacgtcgtgaccacagatattagcgagatgggcgctaattttcgcgccgacagagttatcgatccccggagatgccttaagcctgtgattctgaaagacgggcccgaacgcgtcatcctggccggcccgatgcctgtgaccgttgcttctgccgcgcaacggagaggacgcatcggccggaaccacaataaggagggggatcagtatatttacatgggacagcccctcaacaatgacgaggatcatgctcactggacggaagccaaaatgctgcttgacaacatcaatacccccgagggcattatccctgccctgttcgaacccgagagagaaaagtccgctgccattgatggggagtatcgcctccggggagaggcgagaaaaacatttgtggaactgatgcgcagaggcgacctgcctgtctggctcagctacaaggtggcctccgaggggttccagtattctgatcggcgctggtgctttgacggcgaaagaaacaatcaagtccttgaggaaaacatggatgtggagatctggaccaaagagggagaacggaagaagctgcgcccgagatggctggacgctcggacatacagcgaccccctcgccctgagagagttcaaagaatttgctgccggccgccggtccgtttctggggatcttatcctggagattggaaagctccctcagcacctgacccagagagctcagaatgccctggacaacctcgtgatgcttcataatagcgaacaaggcgggcgcgcgtatcggcacgccatggaggagctgcccgatacaatcgaaaccctgatgctcctggctcttattgccgtgctgacgggaggcgtcacactcttctttctgtccggcagagggctgggaaaaaccagcatcggcctcctttgtgttgtggcttcttccgtgctgctgtggatggccagcgtcgagcctcattggattgccgcttctatcatcctcgagttctttctgatggtgcttctgattcccgagccggaccggcagcgcacccctcaggataaccagctcgcgtacgttgtgatcgggctgctgttcatgattctcacagtcgccgctaatgagatgggacttctggaaaccacaaagaaagacctgggcatcgggcacgtggccgccgagaaccaccatcacgctgccatgctcgatgtcgacctgcatcccgcgtccgcctggacgctttacgctgtggccaccacaattatcacccctatgatgagacacacaattgaaaacaccacggctaatatcagcctgaccgccatcgcgaaccaagccgctattctcatgggactggataagggctggcccatctctaagatggacattggcgttcctctgctcgcccttgggtgctatagccaggtgaatcccctgacactgaccgctgccgtcctcatgctggtggctcattacgccatcattggaccgggccttcaggcgaaagccacacgggaggctcaaaagcgcaccgccgctgggatcatgaaaaaccctacggttgatggaatcgtggccattgacctggatcccgtcgtgtatgacgccaagtttgaaaaacagctcggccagatcatgctgctgattctctgtacatcccagatccttctgatgagaaccacatgggcgctgtgcgagtctattaccctcgctaccgggcccctgacaacgctttgggagggaagccctggcaagttctggaataccacaatcgccgtgtccatggctaacatcttccggggcagctacctggccggggccggactcgctttttccctgatgaagtctctgggcgggggacgcagaggcaccggggcccaaggagaaacactcggcgagaaatggaagcggcagcttaatcagctgagcaaatccgagttcaacacctataagcgctctggcattatggaggttgacagaagcgaagcgaaagaggggctgaagcggggagagacgacaaagcacgccgtctccagaggcaccgctaaactccgctggtttgtggaacggaatctggtgaagccggaggggaaagtcatcgatcttggatgtggcagagggggatggtcttactattgcgccggcctgaagaaagttaccgaagtgaagggctacacaaaagggggacccggccacgaggaacctattcccatggctacctacgggtggaacctcgtgaagctgcatagcggaaaggacgtcttctttatccctcccgagaaatgtgatacactgctctgcgacattggcgagtccagccctaatccgacgatcgaagaggggcgcacccttcgggtgctgaagatggttgaaccctggctgagaggaaaccagttctgtattaaaatcctcaatccttatatgccctctgtggtcgagacactggagcaaatgcagcgcaagcacggcggcatgcttgtgcggaaccctctgtccagaaatagcacccatgaaatgtactgggtttcttgcgggacaggaaacatcgtgtccgccgtcaatatgaccagccgcatgctcctgaaccggtttacgatggcgcacagaaaacccacctatgagcgcgatgtggacctgggcgccgggacacggcacgtggctgtcgaaccggaggttgccaacctcgatattatcggacagagaattgaaaatatcaagcatgagcacaagtctacctggcattacgacgaggataacccttataaaacatgggcttaccacggctcctatgaagtgaagcccagcgggtccgccagctctatggtgaatggagtcgtgaaactgcttaccaagccctgggacgttattcctatggtgacacagatcgctatgaccgatacgacacccttcggccaacagcgcgtctttaaagagaaggtggacaccagaacccctaaggccaaacggggcacagcgcagatcatggaagttacggccaagtggctgtgggggttcctcagccgcaacaaaaagccgagaatttgtacccgggaggaatttacaagaaaagtgcggtccaatgctgccatcggagctgtcttcgtggacgagaaccaatggaactctgccaaggaggccgttgaagatgagcgcttttgggacctggtgcatagagaacgggagcttcacaagcagggcaaatgcgcgacctgcgtctacaacatgatggggaagcgcgagaaaaagctgggagagttcggcaaagctaaggggagcagagccatttggtacatgtggctcggcgcccggttcctggagtttgaagctctgggattcatgaatgaggatcactggttttcccgcgaaaactctctcagcggcgtggagggggagggactgcataaacttggctatatcctgagagacatttccaagatccccgggggaaatatgtacgccgatgacacagctggctgggatacccggatcacagaagacgatctccagaacgaggccaagattaccgacatcatggaacctgagcacgcgctgcttgccaaatctattttcaagctgacgtatcagaataaagtcgtgcgcgttcaaagacccgctaagaacgggaccgtgatggatgtcatcagccggcgcgaccagagaggctccggacaggtgggcacatacgggctcaatacctttacaaacatggaagcccagctgattcggcaaatggagagcgagggaatcttctctccttccgaactggagacccccaacctcgctggccgcgtgctggattggcttgaaaaacatggggccgagagactgaagcggatggcgatcagcggagacgactgtgttgtgaagccgattgatgacagatttgccacggctctcacagccctgaatgatatgggcaaagtccgcaaggacatccctcagtgggaaccctctaaagggtggaacgattggcaacaggtgcctttctgctcccaccactttcatcaacttattatgaaggacggccgggagatcgttgtgccctgtagaaatcaggatgagctggtcggacgcgctcgggtgagccagggcgccgggtggtccctcagagaaaccgcttgcctgggaaaatcttatgcccagatgtggcaactgatgtacttccaccgccgggacctcagactggcggccaacgctatttgtagcgccgtccctgtggattgggttcccacatcccgcaccacgtggagcatccatgcccaccatcagtggatgaccacagaggacatgctttctgtgtggaatcgggtctggattgaagagaacccgtggatggaagataagacccacatctccagctggggcgacgtgccttatctggggaagagagaggaccagtggtgcggatctctcatcggcctgacagctcgcgccacctgggcgacaaatattcaagttgctatcaaccaggtgcggagacttattgggaatgagaactacctggattacatgaccagcatgaaacggtttaagaatgaatccgaccccgagggcgccctctggtga

SEQ ID NO: 18960 - RNA, 9879 nt, synthetic construct
  misc_feature 1..9879: note = derived and/or modified CDS sequence (opt5) from DENV-1__FJ410257__SS-prME
  source 1..9879: mol_type = other RNA
agcgtgacaatgctgctgatgctgatgcccacagcccttgctttccacctgacgacaagaggaggggagcctcatatgatcgtgtccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttcaccacacaagatgaaaagggggtgacgcagaacggacggctgatcaccgctaatcccattgtcacagacaaagagaagcctgtgaacatcgaagccgagccgccctttggcgagtcctatattgtgatcggggccggagaaaaagctcttaagctcagctggttcaagaaaggctctagcattgggaagatgtttgaggccaccgctagaggcgcccgccggatggcgatcctgggagatacagcctgggacttcggctccatcgggggagtttttacctctgtcggcaaactggtgcatcagattttcgggacggcttacggagtgctctttagcggcgtctcctggaccatgaagatcgggattggcgtgctgcttacatggctgggactcaatagcagatctacctccctgagcatgacatgtatcgccgttggcctggtgaccctttacctcggggtcatggtgcaggctgattctggatgcgttattaactggaaaggccgcgaactgaagtgtgggtccggaatcttcgtgacaaatgaggtccacacctggacggaacaatataagtttcaggccgacagccctaaacggctgtccgcggccattggcaaggcttgggaggagggggtgtgcggcatcagatctgccacacgcctcgaaaacatcatgtggaaacagattagcaacgagctgaatcatatccttctggaaaacgacatgaagctcaccgttgtggtcggagatgtggctggcattctggggcagggcaagaagatgatccggccgcaacccatggagtacaaatattcctggaagtcttggggcaaggccaaaattatcggggccgacgctcagaataccacattcatcattgatggacctaacacccccgaatgtcctgacgatcagagagcgtggaatatctgggaggtggaggactacggctttggcattttcacgacaaacatctggctgaaacttcgcgatagctatacccaggtctgcgaccaccggctcatgtccgccgctattaaagatagcaaggccgttcacgccgacatggggtactggatcgaatctgagaaaaatgaaacatggaagctggctagagcctcctttatcgaggtgaagacctgtatttggcccaaaagccatacactgtggtctaacggagtgctcgaatccgagatgatcattccgaagatctatggcgggcctattagccaacacaattaccgccccggatacttcacccagacggcgggcccttggcatctggggaaacttgagctggatttcgacctctgcgaaggaaccacagtcgtggttgatgagcactgcggcaaccggggcccctctctgagaaccacaaccgtgacggggaagatcatccacgaatggtgttgccggagctgtacactgcctccccttcgctttagaggagaggacggctgctggtatgggatggagattcggccggtcaaagaaaaggaggaaaatctcgtgaagtccatggttagcgctggatctggcgaggtggactccttcagcctggggctgctctgtatctccattatgatcgaagaggtcatgagatctcgctggagccggaaaatgctgatgaccggaacacttgccgtgtttttcctgctcattatgggccagctgacctggaacgatctgatcagactttgcattatggttggcgccaatgcttccgaccgcatggggatgggaaccacatacctggccctcatggcgacgtttaagatgagacctatgttcgctgtgggcctgctctttcggcgcctgacctctagagaggtccttctgctcacaatcgggctgagcctggtggcctccgtggaacttcccaactctctggaggaactcggagatggcctggccatggggatcatgattctcaaactgcttaccgacttccaaagccatcagctgtgggctacactcctgtccctgacctttatcaagacgacattcagccttcactatgcctggaaaaccatggctatggtcctgtctattgtttccctctttcccctgtgtctcagcaccacatctcagaagaccacatggctgcctgtgcttctgggatccctgggctgcaagccgctcacgatgttcctgatcgccgagaataaaatttggggccggaagtcctggccccttaacgaagggatcatggcggtgggaatcgtctctattctgctctccagcctgctcaaaaacgatgtgcctctggccggcccccttatcgctgggggaatgctgattgcctgttacgttatctccggcagctctgctgacctgagcctcgagaaggccgccgaggtgtcctgggaagaggaagctgagcattctggggcgagccacaatattctggtcgaagtgcaggatgacggaaccatgaaaatcaaggatgaggagcgcgacgatacacttaccatcctgctcaaagccacactgctcgctgtttccggcgtgtatcctctgtctattcccgccaccctttttgtctggtacttctggcaaaagaagaaacagagaagcggcgtgctgtgggacacgcctagccctcccgaagtcgagcgggccgtgctggatgacgggatctatcgcattatgcagagaggactcctgggccggtctcaggttggggtgggagtcttccaagaaaacgtgtttcataccatgtggcacgttacacgcggcgctgtgcttatgtaccaggggaagagactggagcccagctgggcctccgtcaaaaaggacctcatcagctacggaggcggctggcggctgagagggtcttggaataccggagaggaagtccaggtgattgcggttgagcccggcaaaaaccctaagaatgtccagacagctcccgggaccttcaagacaccggaaggagaggtgggcgccatcgccctcgattttaaacctgggacgtccggaagccccattgtgaaccgcgaaggcaagatcgtcggcctgtatgggaatggagtggttaccacatctggcacctacgtgtccgctatcgcccaagcgaaagctagccaggaggggcctcttcccgagattgaagacgaggtcttccggaagagaaacctgaccatcatggatctgcaccccggatccggcaaaacacgccggtatctccctgccattgtgagagaagccatcaagcgcaagctgcggacgcttattctggctccgaccagagttgtggcctctgagatggctgaagccctcaaagggatgcccatccgctaccagacaaccgcggtcaagagcgagcatacaggcaaagagatcgtggacctgatgtgccacgccacctttacgatgcggctgctctcccctgttagagtgcccaattataacatgattatcatggatgaagctcatttcacagaccctagctctattgccgctcggggatacatctccacccgcgtcggcatgggggaggccgccgctatttttatgaccgcgacaccccctggaagcgtggaagccttcccgcaatctaatgctgtgatccaggatgaggaaagagacatccccgagcggagctggaactccggctatgagtggattaccgatttttctgggaagacagtctggttcgttcctagcatcaaatccggaaatgacattgccaactgtcttcgcaagaatggcaagagagtgatccagctgtctcggaaaacctttgatacggaataccagaagaccaagaacaacgactgggactacgtggtcaccacagatattagcgagatgggggccaatttcagagctgaccgcgtgatcgatccccggagatgcctgaagcctgttattctcaaagacggccccgaacgcgtgatcctggccggaccgatgcctgtcaccgtggcgtccgctgcccaacggagaggccgcatcgggcggaactataataaggagggagatcagtacatttatatgggccagccccttaacaatgacgaggatcacgcccattggacggaagctaagatgctgctcgacaacatcaatacccccgaggggattatccctgccctgttcgaacccgagagagagaaaagcgcggccgttgatggagagtaccgcctgagaggcgaggctcggaagacatttgtggaactcatgcgcagaggggaccttcctgtctggctgtcttataaagtggcctccgagggcttccagtacagcgatcggcgctggtgctttgacggagaaagaaacaatcaagtcctggaggaaaacatggatgtggagatttggaccaaggagggcgaccggaaaaagctcagaccgcgctggctggacgctcggacatattccgatccccttgccctgagagaactcaaagagttcgctgccgggcgccggtctgttagcggagacctgatcctggaaatcggcaagctccctcagcaccttacccagagagcgcagaatgccctggataacctggtgatgctccacaattccgagcaagggggacgggcttaccgccatgccatggaggaactgcccgacacaattgagacccttatgctgctcgctctgatcgccgtgctgacgggcggcgtcacactctttttcctttctgggagaggactgggcaagaccagcattgggctgctctgtgttatggcctccagcgtgctgctttggatggcttctgtggaacctcactggatcgcggcctccattatcctggagtttttcctcatggtcctgctgatccccgaaccggatcggcagcgcacccctcaggacaaccagctcgcttacgtggttattggacttctgtttatgatcctgacagtggccgccaatgagatgggcctcctggagaccaccaaaaaggatcttgggattggacatgtcgctgtggaaaaccaccaccatgccgcgatgctggacgtcgatctccaccccgccagcgcttggacgctgtatgccgtggctaccacaatcattacccctatgatgagacatacaatcgagaacaccacggccaatatttctctgaccgcgatcgccaaccaagctgccatcctcatgggccttgacaaaggctggcccatttccaagatggatatcggggttcctctgctggctctcggatgctacagccaggtgaatcccctgacacttaccgccgctgtcctgatgctcgtggcccactatgcgattatcggcccggggctgcaggccaaagctacacgggaagcccaaaagcgcaccgctgccggaattatgaagaaccctacggttgacggcatcgtggccatcgatctggaccccgtcgtgtacgacgcgaaattcgagaagcagctcgggcagattatgcttctgatcctgtgtacatctcagattctcctgatgagaaccacatgggctctttgcgaaagcatcaccctggccaccggacccctcacaacgctgtgggagggctcccctggcaaattttggaataccacaattgctgtgtctatggccaacatcttccgggggagctatctggccggagctggcctcgccttttcccttatgaaaagcctcgggggaggccgcagagggaccggagcgcaaggcgagacactgggcgaaaaatggaagcggcagctcaatcagctgtccaagtctgagttcaacacctacaaaagaagcgggatcatggaagttgatcgctccgaggccaaggaaggacttaaacggggcgagacgacaaagcatgctgtctctagagggaccgccaaactgcgctggttcgtggagcggaatctcgtgaagccggaaggaaaggtcattgacctgggctgtgggagaggaggctggagctattactgcgctggcctgaaaaaggttaccgaggtgaaagggtacacaaagggaggccccgggcacgaggaacctatccccatggccacctatggatggaacctcgtgaaacttcactccggcaaggatgtctttttcattcctcccgaaaaatgtgacacactgctgtgcgatatcggggagtctagccctaatccgacgattgaggaaggacgcaccctccgggtgctgaagatggttgagccctggcttagaggcaaccagttttgtatcaagattctgaatccttacatgccctccgtggtcgaaacactcgagcaaatgcagcgcaaacatggcgggatgctggtgcggaaccctctgagcagaaattctacccacgagatgtattgggtttcctgcggaacaggcaacatcgtgagcgcggtcaatatgacctctcgcatgctcctgaaccggttcacgatggcccatagaaagcccacctacgaacgcgacgtggatcttgggacaggaaccagacacgtggctgtcgagccggaagttgccaacctggacatcattggccagcggatcgagaatattaaacacgaacataagtccacatggcactatgatgaggacaacccttacaaaacctgggcttatcatgggagctacgaggtgaagccctctggatccgccagctccatggtgaatggcgtcgtgaagctcctgacaaaaccctgggatgttatccctatggtgacccagattgctatgacggacacaaccccctttggccaacagcgcgtcttcaaggaaaaagtggacaccagaacacctaaggccaaacgggggacggcgcagatcatggaggttaccgccagatggctttggggatttctgagccggaacaagaagccgcgcatctgtacaagagaagagttcacccggaaagtgcgctctaatgctgccattggcgctgtctttgtggatgaaaaccaatggaatagcgccaaggaggccgttgaggacgaaagattctgggatctcgtgcaccgggagcgcgaactgcataaacaggggaagtgcgcgacatgcgtctacaacatgatgggaaaaagagagaagaagctgggcgaatttgggaaagctaagggctcccgggccatctggtatatgtggctcggagcccgcttcctggagtttgaggctcttggcttcatgaatgaagaccactggttctctagagagaacagcctgtccggggtggaaggagagggcctccacaaactggggtacattcttcgggatatctctaagattcccggaggcaatatgtatgccgacgataccgctgggtgggacacacgcatcaccgaggatgacctgcagaacgaagccaaaatcacggatattatggagcctgaacatgcgctcctggccaaggctatctttaaactgacctaccagaataaggtcgtgagagttcaacggcccgccaagaacggcacagtgatggacgtcattagccgcagagatcagcggggatccggccaggtggggacctatggactcaatacattcaccaacatggaggctcagctgatcagacaaatggaatctgagggcatttttagcccttccgagcttgaaacgcccaacctggccgagcgcgcgctcgactggctggaaaaatacggggtggagcggcttaagagaatggccatcagcggagacgattgtgttgtgaaaccgatcgacgatcgcttcgctacagccctgaccgctctcaatgacatgggcaaggtccggaaagatattcctcagtgggaaccctctaaggggtggaacgactggcaacaggtgcctttttgctcccaccatttccaccaactgatcatgaaggatggcagagagattgttgtgccctgtcgcaatcaggacgagctggtcggacgggccagagtgagccagggcgctgggtggtctctccgcgaaacagcctgcctgggaaaatcctatgcgcagatgtggcaacttatgtactttcaccggagagatctgcgcctcgccgctaacgccatctgtagcgccgtccctgtggactgggttcccacctcccggacgacctggtctattcatgctcaccatcagtggatgacaaccgaggatatgctgagcgtgtggaatagagtctggatcgaagagaacccgtggatggaagacaagacacacatttccagctgggaggacgtgccttaccttggcaaacgggaggatcagtggtgcgggtctctgatcggactcaccgccagagcgacatgggctaccaatatccaagttgccattaaccaggtgcgccggctgatcggcaatgaaaactatctggactacatgacgtccatgaagagattcaaaaatgagagcgatcccgaaggggccctctggtga

SEQ ID NO: 18961 - RNA, 9879 nt, synthetic construct
  misc_feature 1..9879: note = derived and/or modified CDS sequence (opt5) from DENV-1__FJ461332__SS-prME
  source 1..9879: mol_type = other RNA
agcgtgaccatgctgctcatgctgatgcccaccgcccttgctttccacctgacgaccagaggaggggagcctcatatgatcgtgtccaagcaggaacggggaaaatctctcctgtttaagaccagcgccggcgttaatatgtgcacccttattgccatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaggaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttacgtgatttccggcagctctgctgacctgagcctcgagaaggccgccgaggtttcctgggaagaggaagctgagcattctggggcgagccacaatatcctggtggaagtccaggatgacggaacgatgaaaatcaaggatgaggagcgcgacgatacccttacaattctgctcaaagccaccctgctcgctgtgtccggcgtttatcctctgtctatccccgccacacttttcgtgtggtacttctggcaaaagaagaaacagagaagcggcgtcctgtgggacacccctagccctcccgtggtcgaacgggccgtgctggatgacgggatttatcgcatcatgcagagaggactcctgggccggtctcaggttggggtgggagtctttcaagagaacgtgttccatacgatgtggcacgttacccgcggcgctgtgcttatgtaccaggggaagagactggaacccagctgggcctccgtcaaaaaggacctcattagctacggaggcggctggcggctgagagggtcttggaatacaggagaggaggtccaggtgatcgcggttgaacccggcaaaaaccctaagaatgtccagaccgctcccgggacatttaagaccccggagggagaagtgggcgccattgccctcgatttcaaacctgggacatccggaagccccatcgtgaaccgcgagggcaagatcgtcggcctgtatgggaatggagtggttacgacctctggcacatacgtgtccgctattgcccaagcgaaagctagccaggaagggcctcttcccgagatcgaggacgaagtctttcggaagagaaacctgaccattatggatctgcaccccggatccggcaaaacccgccggtatctccctgccatcgtgagagaggccattaagcgcaagctgcggacacttatcctggctccgacgagagttgtggcctctgaaatggctgaggccctcaaagggatgcccatccgctaccagaccacagcggtcaagagcgaacataccggcaaagagattgtggacctgatgtgccacgccacattcaccatgcggctgctctcccctgttagagtgcccaattataacatgatcattatggatgaggctcattttacggaccctagctctatcgccgctcggggatacatttccacacgcgtcggcatgggggaagccgccgctatcttcatgaccgcgacaccccctggaagcgtggaggcctttccgcaatctaatgctgtgatccaggatgaagagagagacattcccgaacggagctggaactccggccacgagtggatcacagatttccctgggaagaccgtctggtttgttccctctattaaaagcggaaatgacatcgccaactgtcttcgcaagaatggcaagagagtgattcagctgtcccggaaaacattcgataccgagtatcagaagacgaaaaacaacgactgggactacgtggtcacaaccgatatctctgaaatgggggccaatttcagagctgaccgcgtgattgatcctcggagatgcctgaagcccgttatcctcaaagacggcccggagcgcgtgatcctggccggacctatgcccgtcacagtggcgagcgctgcccaacggagaggccgcattgggcggaaccataataaggaaggagatcagtacatctatatgggccagccccttaacaatgacgaggatcacgcccactggaccgaggctaagatgctgctcgacaacattaatacgcctgaagggatcattcccgccctgtttgagcctgaaagagagaaatccgcggccgttgatggagaataccgcctgagaggcgaggctcggaagaccttcgtggagctcatgcgcagaggggaccttccggtctggctgagctataaagtggcctctgaaggctttcagtactccgatcggcgctggtgcttcgacggagagagaaacaatcaagtcctggaagagaacatggatgtggaaatctggacaaaggagggcgagcggaaaaagctcagaccccgctggctggacgctcggacctatagcgaccctcttgccctgagagaatttaaagagttcgctgccgggcgccggtccgtttctggagatctcatcctggaaattggcaagctgccccagcatctcacacagagagcgcagaatgcccttgacaacctggtgatgctgcacaatagcgagcaagggggacgggcttaccgccatgccatggaggaactccctgataccatcgagacactgatgcttctggctctcattgccgtgctgaccggcggcgtcacgctgtttttcctctccgggagaggacttggcaagacatctatcgggctgctgtgtgttatggccagctccgtgctcctgtggatggctagcgtggaaccccactggattgcggcctctatcatccttgagtttttcctgatggtcctcctgattccggaacctgaccggcagcgcacaccccaggataaccagctggcttatgtggttatcggactcctttttatgattctgaccgtggccgccaatgagatgggcctgctcgagacaaccaaaaaggacctggggatcggacacgtcgctgtggaaaaccatcaccatgccgcgatgcttgatgtcgacctgcaccctgcctccgcttggacactctacgccgtggctacgaccattatcacacccatgatgagacataccattgagaacacaaccgccaatatcagcctgacggcgatcgccaaccaagctgccattctgatgggcctcgataaaggctggcctatctctaagatggacattggggttccccttctggctctgggatgctactcccaggtgaatccgctcaccctgacagccgctgtccttatgctggtggcccactatgcgatcattggccctgggctccaggccaaagctacccgggaagcccaaaagcgcacagctgccggaatcatgaagaaccccaccgttgatggcatcgtggccattgacctggatcccgtcgtgtacgacgtgaaattcgagaagcagctggggcagatcatgctccttattctgtgtacgagccagatcctgctcatgagaacaacctgggcgctgtgcgaatctattacacttgctaccggacctctgaccacactctgggagggcagcccgggcaaattttggaatacgaccatcgccgtttccatggctaacatcttccgggggtcttatctggccggagccggcctggctttcagcctcatgaagtcccttgggggaggccgcagagggacaggagcccaaggcgagaccctgggcgaaaaatggaagcggcagctgaatcagctcagcaagtccgagtttaacacatacaaaagatctgggattatggaagtcgaccgcagcgaggcgaaggaaggactgaaacggggcgagaccacgaagcacgccgtgtccagagggacagctaaacttcgctggttcgtggagcggaatctggtcaagcccgaaggaaaggttatcgatctcggctgtgggagaggaggctggtcttattactgcgccggcctgaaaaaggtgaccgaggtgaaagggtataccaagggaggccctgggcatgaggaacccattcctatggctacatacggatggaacctggtcaaactccacagcggcaaggacgtgtttttcattccccctgaaaaatgtgatacccttctgtgcgacatcggggagtcctctccgaatcccacaatcgaggaaggacgcacgctgcgggttctcaagatggtggagccttggctgagaggcaaccagttttgtattaagatccttaatccctacatgcctagcgtcgtggaaaccctggagcaaatgcagcgcaaacatggcgggatgctcgttcggaaccccctgtccagaaatagcacacacgagatgtattgggtgtcttgcggaaccggcaacatcgtctccgccgtgaatatgacaagccgcatgctgctcaaccggttcaccatggcgcacagaaagccgacgtacgaacgcgatgtggacctggggaccggaacaagacatgtcgccgttgagcctgaagtggctaaccttgatattatcggccagcggattgagaatatcaaacacgaacataagtctacctggcactatgacgaggataacccctacaaaacatgggcctatcatgggtcctacgaggtgaagcccagcggatctgcttccagcatggtcaatggcgtggttaagctgctcaccaaaccttgggacgtgattcccatggtcacacagatcgccatgaccgatacgacaccttttggccaacagcgcgtgttcaaggaaaaagttgacaccagaaccccgaaggctaaacgggggacagcccagatcatggaggtgacggcgagatggctgtggggatttctttcccggaacaagaagccccgcatttgtaccagagaagagttcacacggaaagtccgcagcaatgccgctatcggcgccgtgtttgttgacgaaaaccaatggaactctgctaaggaggccgtggaggatgaaagattctgggacctggtccaccgggagcgcgaactccacaaacaggggaagtgcgcgacctgcgtgtataacatgatgggaaaaagagagaagaagctgggcgaatttgggaaagcgaagggcagccgggctatttggtacatgtggctgggagcccgcttcctcgagttcgaggccctgggctttatgaatgaagatcattggttctccagagagaactctcttagcggggtcgaaggagagggcctgcacaaactcgggtacatcctgcgggacatttccaagatccctggaggcaatatgtatgctgatgacacagccgggtgggatacccgcatcacagaggacgatcttcagaacgaagctaaaattaccgacatcatggagcccgaacatgccctgctcgcgaaggccatttttaaactgacgtaccagaataaggtggttagagtgcaacggcctgctaagaacggcaccgtcatggatgtgatctctcgcagagaccagcggggaagcggccaggtggggacatatggactgaataccttcacaaacatggaggcccagctcattagacaaatggaatccgagggcatcttttctcccagcgagctggaaaccccgaaccttgctgagcgcgccctggattggctcgaaaaatacggggttgagcggctgaagagaatggcgatctccggagacgactgtgtggtcaaacctattgatgaccgcttcgccacggctcttacagccctgaatgatatgggcaaggtgcggaaagacatcccccagtgggaacctagcaaggggtggaacgattggcagcaggttcccttttgctctcaccacttccatcaactcattatgaaggacggcagagagatcgtggtcccttgtcgcaatcaggatgagctggtgggacgggctagagtctcccagggcgccgggtggagcctgcgcgaaaccgcttgcctcggaaaatcttatgcccagatgtggcaactgatgtactttcaccggagagaccttcgcctggcggccaacgctatttgttccgccgtgcccgttgattgggtgccgacaagccggaccacgtggtccatccatgcccaccatcagtggatgaccacagaggacatgctctctgtctggaatagagtgtggattgaagagaacccttggatggaagataagacccacatcagctcctgggaggacgttccctatctgggcaaacgggaggaccagtggtgcgggagccttatcggactgacagctagagccacctgggcgacaaatattcaagtggctatcaaccaggtccgccggctcattggcaatgaaaactacctggattacatgacctctatgaagagattcaaaaatgagtccgaccccgaaggggccctgtggtga

SEQ ID NO: 18962 - RNA, 9879 nt, synthetic construct
  misc_feature 1..9879: note = derived and/or modified CDS sequence (opt5) from DENV-1__FJ461333__SS-prME
  source 1..9879: mol_type = other RNA
agcgtgaccatgctgctgatgctgatgcccacagcccttgctttccacctgacgaccagaggcggggagcctcatatggtggtttccaagcaggaacggggaaagtctctcctgtttaagaccagcgccggcgtgaacatgtgcacccttatcgcgatggacctgggggagctctgtgaagatacaatgacctacaaatgcccccgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggctgggcgtgcttctgacctggctcggactcaattctagatccacaagcctgtctatgacctgtattgccgttggccttgtgacactctacctgggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctctctgcggccatcggcaaggcttgggaggagggggtgtgcggcattagaagcgccacgcgcctggaaaacgttatgtggaaacagatctccaacgagcttaatcatatcctgctcgaaaacgacatgaagttcacagtggtcgtgggagatgtggctggcattctggcccaggggaaaaagatgatccggccgcaacccatggagcacaaatactcttggaaaagctggggaaaggccaagattatcggcgctgacgtccagaataccacctttattatcgatgggcctaacacacccgaatgtcctgacgatcagagagcgtggaatatctgggaggttgaggactatggattcggcatttttaccacgaacatctggctgaaacttcgcgattcctacacacaggtgtgcgaccaccggctcatgagcgccgctattaaagattctaaggccgtgcatgccgacatgggctattggatcgaatccgagaaaaatgaaacctggaagctggctagagccagcttcattgaggtcaagacatgtatctggcccaaatctcacaccctgtggtccaacggggtgctcgaaagcgagatgatcattccgaagatctacggaggccctatttctcaacataattatcgccccgggtacttcacacagaccgcgggaccttggcacctgggcaaacttgagctggattttgacctctgcgaagggacgaccgttgtggtcgatgagcactgcggaaaccggggccccagcctgagaacaaccacagtgaccggcaagatcattcatgaatggtgttgccggtcctgtacgctgcctccccttcgcttcagaggggaggacggatgctggtacggcatggagatccggccggttaaagaaaaggaggaaaatctcgtcaagagcatggtctctgctgggtccggagaggtggacagcttttccctgggcctgctctgtatctctattatgatcgaagaggttatgagaagccgctggtcccggaaaatgctgatgacagggacccttgccgtgttcctgctcctgattatgggacagctgacatggaacgatcttatcagactgtgcattatggtcggcgccaatgcttctgaccgcatgggcatggggaccacctatctcgccctgatggcgacatttaagatgagacctatgttcgctgtgggactcctgtttcggcgccttacgagcagagaggtgctgctcctgaccatcggcctgtcccttgtcgcctctgttgaactgcccaacagcctcgaggaactgggggatggactcgccatgggcattatgatcctgaaacttctgacagacttccaatcccaccagctctgggctaccctgctgagccttacatttatcaagaccacgttctctctgcattacgcctggaaaacaatggctatggtgctctccattgtgagcctgtttcccctctgtctgtctaccacctcccagaagacaacctggcttcctgtcctgctggggagcctcggatgcaagccgctgacaatgttccttatcgccgagaataaaatttggggccggcgctcttggcccctgaacgaaggcatcatggcggtggggattgtttccatcctcctgagctccctcctgaagaacgatgtgcctcttgccggacccctgatcgctggcgggatgctgattgcctgttatgtcatcagcggatctagcgctgacctctccctggagaaagccgccgaggtgtcttgggaagaggaagctgagcacagcggcgcgtcccataatattcttgttgaagtgcaggatgacgggacgatgaagatcaaagatgaggagagagacgataccctgacaattctcctgaaggccaccctcctggctgtctctggagtgtaccctcttagcatccccgccacactgtttgtctggtatttctggcagaagaagaagcagcggtccggcgtgctgtgggacaccccttctcccccggaagttgagcgcgccgtgctcgatgacggcatctacagaattatgcagcgggggctgcttggacgcagccaggtcggcgtgggggttttccaagaaaacgtgtttcacacgatgtggcacgtcaccagaggagctgtgctgatgtatcagggcaaacggctcgagccttcctgggccagcgtgaagaaagacctgatctcttacgggggaggctggagactccagggctcctggaatacaggggaggaagttcaggtcattgcggtggagcccggaaagaaccctaaaaatgtgcaaaccgctcccggcacattcaagaccccggaaggggaggtcggagccatcgccctggattttaagcctggcacaagcgggtctcccattgtgaaccgcgaaggaaaaatcgttggcctttacggcaatggggtggtcacgacctccggaacatatgtgagcgctattgcccaggcgaaggcttcccaggagggccctctgcccgagatcgaagacgaggttttccggaaaagaaacctgaccatcatggatctccatcccgggtctggaaagacccgccggtacctgcctgccattgtgagagaagccatcaaacgcaaacttcggacactgattctcgctccgacgagagtcgtggccagcgagatggctgaagccctgaagggcatgcccatccgctatcaaaccacagcggttaaatccgagcacaccgggaaggagattgtggacctgatgtgccatgccacatttaccatgcggctccttagccctgtcagagtgcccaattacaacatgatcatcatggatgaagctcacttcacggacccttcttccattgccgctcggggctatatcagcacacgcgtgggaatgggcgaggccgccgctatttttatgaccgcgacaccccctgggtctgtcgaagccttcccgcagagcaatgctgttatccaggatgaggaaagagacattcccgagcggtcctggaactctggatacgagtggatcacagattttcctggcaaaaccgtgtggttcgtgcccagcatcaagtccgggaatgacattgccaactgtctgcgcaaaaatggaaagagagtcatccagctgtctcggaagacatttgataccgaatatcagaagacgaagaacaacgactgggactacgtggttacaaccgatattagcgagatgggcgccaatttcagagctgaccgcgtgatcgatcctcggagatgcctcaaacccgtcattctgaaggacgggccggaacgcgtgatccttgccggccctatgcccgttacagtggcgtccgctgcccagcggagaggacgcattggccggaaccataataaagagggggatcagtacatctatatgggacagcccctgaacaatgacgaggatcacgcccactggaccgaagctaagatgctcctggacaacatcaatacgcctgagggcattatccccgccctgttcgaacctgagagagaaaagagcgcggccattgatggggagtaccgcctcagaggagaggctcggaaaacctttgtcgaacttatgcgcagaggcgacctgccggtgtggctgtcttataaggtcgcctccgaggggttccaatacagcgatcggcgctggtgctttgacggcgaaagaaacaatcaggtgctcgaggaaaacatggatgttgagatctggacaaaagagggagaacggaagaaactgagaccccgctggcttgacgctcggacctattccgaccctctggccctcagagagttcaaggaatttgctgccggccgccggtctgtgagcggggatctgattctggagatcggaaaactcccccagcatcttacacagagagcgcaaaatgccctggacaacctggtgatgctccacaattccgaacagggcgggcgggcttaccgccatgccatggaggagctgcctgataccatcgaaacacttatgctgctcgctctgattgccgtcctgaccggaggcgttacgctgttctttctttctggcagagggctgggaaagacaagcatcggcctgctctgtgtgatggcctccagcgtgctgctttggatggcttctgtcgagccccactggattgcggcctccatcattctggagttctttctcatggtgctgctgatcccggagcctgaccggcagcgcacaccccaagataaccaactcgcttatgttgtgatcgggcttctgttcatgattctgaccgtcgccgccaatgagatgggactcctggaaaccaccaagaaagaccttggcatcgggcacgctgccgtgggaaaccatcaccatgcggccatgctggatgtcgacctccaccctgctagcgcctggacactgtacgctgtggccacgaccattatcacacccatgatgagacataccattgagaacacaaccgcgaatatctctctgacggccattgctaaccaggccgctatcctcatgggccttgataagggctggcctatctccaaaatggacattggggttcccctgctggccctcggatgctacagccaggtgaatccgctgacccttacagctgccgtcctgatgctcgtggcgcactatgccatcattggccctgggctgcaagctaaggccacccgggaagctcagaaacgcacagccgccggaatcatgaagaaccccaccgttgatggcattgtggcgatcgacctggatcccgtcgtgtacgacgctaagtttgagaaacagctcgggcagatcatgcttctgattctgtgtacgtctcaaatcctcctgatgagaacaacctgggccctttgcgaaagcattacactggctaccggacctctcaccacactgtgggagggctccccgggcaagttctggaatacgaccatcgccgtgtctatggccaacatttttcgggggagctatctggctggagccggcctcgcgttctcccttatgaaaagcctcgggggaggccgcagagggacaggagcccagggcgagaccctgggcgaaaagtggaaacggcagctcaatcagctgtccaagtctgagttcaacacatacaagagaagcgggatcatggaagttgaccgctccgaggctaaagaaggacttaagcggggcgagaccacgaaacacgccgtctctagagggacagctaagctgcgctggtttgtggagcggaatctcgtgaaacccgaaggaaaggtcatcgatctgggctgtgggagaggaggctggagctattactgcgccggcctgaagaaagttaccgaggtgaaggggtataccaaaggaggccctgggcatgaagaacccattcctatggcgacatacggatggaacctcgtgaaacttcactccggcaaagacgtcttctttattccccctgaaaagtgtgataccctgctgtgcgacatcggggagtctagcccgaatcccacaatcgaggaaggacgcacgctccgggtgctgaaaatggttgagccttggcttagaggcaaccaattctgtattaagatcctgaatccctacatgccttccgtggtcgaaaccctcgagcagatgcagcgcaagcatggcgggatgctggtgcggaaccccctgagcagaaattctacacacgagatgtattgggtttcctgcggaaccggcaacattgtgagcgccgtcaatatgacatctcgcatgctcctgaaccggtttaccatggctcacagaaaaccgacgtacgaacgcgatgtggaccttggggccggaaccagacatgtggctgtcgagcctgaagttgccaacctggatatcatcggccagcggattgagaatatcaagcacgaacataaatccacatggcactatgacgaggataacccctacaagacctgggcttatcatgggagctacgaggtgaaaccctctggatccgccagctccatggtgaatggcgtcgtgaagctcctgacaaagccttgggacgttattcccatggtgacccaaatcgcgatgacagataccacgcctttcggccagcagcgcgtctttaaagaaaaggtggacacaagaaccccgaaagccaagcgggggaccgctcaaattatggaggttacagccaaatggctttggggattcctgagcagaaacaagaagccccggatctgtacgcgcgaagagtttaccagaaaagtgcggtctaatgctgccatcggcgccgtcttcgtggacgaaaaccagtggaatagcgcgaaggaggctgttgaggatgaacgcttttgggacctcgtgcacagagagcgggaactgcacaaacaggggaagtgcgccacatgcgtctataacatgatgggaaaacgcgagaagaagctgggcgagttcgggaaagccaagggctccagagctatttggtacatgtggctcggagcccggtttctggagttcgaggctcttggcttcatgaatgaagatcattggttttctcgcgagaacagcctgtccggggtggaaggagagggcctccacaaactggggtacatccttagagacatttctaagatccctggaggcaatatgtatgccgatgacaccgcggggtgggatacacggattaccgaggacgatctgcagaacgaagcccgcatcacagacatcatggagcccgaacatgctctcctggccaaaagcattttcaagctgacctaccaaaataaagtcgtgagagttcagcggcctgctaagaacggcacggtgatggatgtcatctcccgcagagaccagcggggatctggccaggtggggacctatggactcaatacatttaccaacatggaggcccaactgattagacagatggaaagcgagggcatcttctcccccagcgagcttgaaacaccgaacctggcggagcgcgtgctcgattggctggaaaagtacggggttgagcggcttaaaagaatggccatttctggagacgactgtgtggtcaagcctatcgatgaccgctttgctaccgccctgacggctctcaatgatatgggcaaagtgcggaaggacatcccccagtgggaaccttccaaagggtggaacgattggcagcaagttcccttctgcagccaccactttcatcagctgattatgaaggacggcagagagatcgtggtcccttgtcgcaatcaggatgagctggtgggacgggccagagtctctcagggcgctgggtggtccctccgcgaaacagcctgcctgggaaagagctatgcgcaaatgtggcagcttatgtacttccaccggagagacctgcgcctcgccgctaacgccatttgttccgccgtgcccgttgattggatcccgacctctcggacaacctggagcattcatgctcaccatcagtggatgacgaccgaggacatgctgtccgtgtggaatagagtctggatcgaagagaacccttggatggaagataaaacacacattagctcttggggcgacgtgccctatcttgggaagcgggaggaccaatggtgcggatccctgatcggcctcaccgccagagcgacatgggctaccaatgttcaggtggccatcaaccaggtccgccggctgattgggaatgagaactacctggattacatgacaagcatgaaaagatttaagaatgaatctgaccccgagggcgccctctggtga

SEQ ID NO: 18963 - RNA, 9879 nt, synthetic construct
  misc_feature 1..9879: note = derived and/or modified CDS sequence (opt5) from DENV-1__FJ410262__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgggctttgcgaaggaacgaccgtggttgtggacgagcactgcggcaaccggggcccctccctgagaacaaccacagtcaccgggaaaattatccacgaatggtgttgccggagctgtacgctccctcccctgcgctttaagggagaggatggctgctggtatgggatggagatcagaccggtgaaggaaaaagaggaaaatctggttaagtctatggtgtccgctggaagcggcgaggtcgactccttctctcttgggctcctgtgtattagcatcatgattgaagaggtgatgcggtccagatggtctcgcaaaatgctgatgacaggaaccctcgccgtctttttcctgcttatcatgggccagctgacatggaacgacctcattcggctgtgcatcatggtgggcgccaatgctagcgatagaatggggatgggaaccacctacctggcccttatggcgacatttaagatgcgccctatgttcgctgtcggcctgctctttagacggctgacgtcccgcgaggtgctcctgcttaccattgggctgtctctcgtggccagcgtcgaactgcccaactccctggaggaacttggagacggcctggccatggggatcatgatcctcaaactgctcacagatttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctgggatctcttggctgcaagccgctgacaatgttcctgattgccgagaataaaatctggggcagaaagtcctggcccctcaacgaagggattatggcggtcggaatcgtgagcatcctgctttccagcctgctcaaaaacgacgttcctctggccggccccctcattgctgggggaatgctgatcgcctgttacgtgatttctggcagctccgctgatctttctctggagaaggccgccgaggtcagctgggaagaggaagctgagcattccggggcgtctcacaatatcctggtggaagttcaggacgatggaacgatgaaaattaaggacgaggagcgggatgacaccctcacaatcctgcttaaggccaccctgctcgctgtgagcggcgtctatcctctgtccatccccgccacactcttcgtgtggtacttttggcagaaaaagaaacaacgctctggcgtcctgtgggataccccttcccctcccgaagtggagagagccgttcttgacgatgggatttatcggatcatgcagcgcggactgctgggcagatcccaggtgggggtcggagtgttccaggaaaacgtttttcatacgatgtggcacgtgacccggggcgctgtcctcatgtaccaagggaagcgcctggagcccagctgggcctctgtgaaaaaggaccttatttcctacggaggcggctggagactgcaggggagctggaatacaggagaggaagtgcaggttatcgcggtcgagcccggcaagaaccctaaaaatgtgcagaccgctcccgggacattcaagacctctgaaggagaggtgggcgccattgccctcgactttaaaccggggacatccggaagccctatcgtcaaccgggaaggcaagattgtgggcctgtatgggaatggagttgtgacgacctccggcacatacgtctctgctatcgcccaagcgaaagctagccaggaggggcccctccctgagatcgaagatgaggtgttcagaaagcgcaacctgaccattatggaccttcaccccggatccggcaagacccggagatatctgcccgccatcgttcgcgaagccattaaacggaagctgagaacactcatcctggctcctacgcgcgtggtcgccagcgagatggctgaagcccttaaagggatgccgattcggtaccagaccacagcggtgaagtctgagcataccggcaaagagatcgttgatctgatgtgccacgccacatttaccatgagactcctgtcccccgtgcgcgtccctaattataacatgatcattatggacgaagctcatttcacggatcccagctctatcgccgctcggggatacattagcacaagagtgggcatgggggaggccgccgctatctttatgaccgcgacccctcccggatccgtggaagccttccctcaatctaatgctgtcattcaggacgaggaacgggatatcccggagcgcagctggaactccggctatgagtggatcacagactttcccgggaagaccgtttggttcgtgccttctattaagagcggaaatgatatcgccaactgtctgcgcaagaatggcaagcgggtgattcagctctcccgcaaaacattcgacaccgaataccagaagacgaaaaacaacgattgggactacgtcgtgacaaccgacatcagcgagatgggggccaattttagagctgatcgggttattgaccccagacgctgccttaagcctgtgatcctgaaggatggccccgaacgggtcattctggccggaccgatgcctgtgacagttgcgtctgctgcccaaagacgcggccggatcgggagaaaccacaataaagagggagaccagtatatctacatgggccagcccctcaacaatgatgaggaccatgcccactggaccgaagctaagatgctgcttgataacattaatacgcccgaggggatcattcctgccctgttcgaacccgagcgcgaaaaatccgcggccatcgacggagagtatcggctcagaggcgaggctcgcaagacctttgtggaactgatgagaagaggggatctgcctgtctggctcagctacaaagtggcctccgagggcttccagtattctgaccgcagatggtgctttgatggagaacggaacaatcaagtccttgaggaaaacatggacgtggagatttggacaaaggagggcgaacgcaaaaagctgagaccgcggtggctggatgctagaacctacagcgaccccctcgccctgcgcgagttcaaggaatttgctgccgggcggagatccgtttctggagaccttatcctggagatcggcaaactccctcagcacctgacacagcgcgcgcagaatgccctggataacctcgtgatgcttcataatagcgaacaagggggacgggcttatagacacgccatggaggagctgcccgacaccattgaaacactgatgctcctggctcttatcgccgtgctgaccggcggcgtcacgctgttctttctgtccgggcggggactgggcaagacaagcattgggctcctttgtgttatggcctcttccgtgctgctgtggatggctagcgtggagcctcattggatcgcggcctctattatcctcgagttctttctgatggtccttctgatccccgagccggatcgccagagaacccctcaggacaaccagctcgcttacgtggttattggactgctgttcatgatcctcaccgtggccgccaatgagatgggccttctggaaacaaccaaaaaggatctggggattggacacgtcgctgtggagaaccaccatcacgccgcgatgctcgacgtcgatctgcatcccgcctccgcttggacactttacgccgtggctacgaccatcattacacctatgatgcggcacaccatcgaaaacacaaccgccaatattagcctgacggcgatcgccaaccaagctgccatcctcatgggcctggacaaaggctggcccatttctaagatggatatcggggttcctctgctcgctcttggatgctatagccaggtgaatcccctgaccctgacagccgctgtcctcatgctggtggcccattacgcgattatcggcccggggcttcaggccaaggctacccgcgaggcccagaagcggacagctgccggaattatgaagaaccctaccgttgacggcatcgtggccatcgatctggaccccgtcgtgtatgatgcgaaatttgaaaagcagctcgggcagattatgctgctgatcctctgtacgtcccagattcttctgatgcggacaacctgggctctgtgcgagtctatcacactcgccaccggacccctgaccacactttgggagggcagccctggcaaattctggaatacgaccattgctgtgtccatggccaacatcttccgcgggagctacctggccggagctggcctcgccttttccctgatgaagtctctcgggggcgggagacgggggacaggagcgcaaggcgaaaccctcggcgagaagtggaaacgccagcttaatcagctgagcaagtccgagttcaacacatataaaagatctgggatcatggaggttgaccggagcgaagccaaggagggactgaaaagaggcgagaccacgaagcacgctgtctcccgcgggacagccaagctccggtggtttgtggaaagaaatctggtgaaaccggagggaaaggtcattgaccttggctgtgggcgcggaggctggtcttactattgcgctggcctgaaaaaggttaccgaagtgaaagggtacaccaagggaggccccgggcacgaggaacctatccccatggccacatacggatggaacctcgtgaaactgcatagcggcaaggatgtcttctttattcctcccgagaagtgtgacaccctgctctgcgatatcggggagtccagccctaatccgacaattgaagagggacggacgcttagagtgctgaaaatggttgaaccctggctgcgcggcaaccagttctgtatcaagattctcaatccttatatgccctctgtggtcgagaccctggagcaaatgcagcggaaacacggcgggatgcttgtgagaaaccctctgtcccgcaatagcacacatgaaatgtactgggtttcttgcggaaccggcaacatcgtgtccgcggtcaatatgacaagccggatgctcctgaacagatttaccatggcccaccgcaagcccacgtatgagcgggacgtggatctgggggctggaaccagacacgtggccgtcgaaccggaggttgctaacctcgacatcattggccagcgcatcgaaaatattaaacatgagcacaagtctacatggcattacgatgaggacaacccttataagacctgggcctaccacgggtcctatgaagtgaaacccagcggatccgctagctctatggtgaatggcgtcgtgaagctgcttacaaaaccctgggatgttatccctatggtgacccagattgccatgacagacaccacgcccttcggccaacagagagtctttaaggagaaagtggatacacggacccctaaggcgaagcgcgggaccgcccagatcatggaagttacagctaaatggctgtggggattcctcagcagaaacaagaaaccgcggatctgtacgagagaggaatttacccggaaggtgcgctccaatgccgctattggcgccgtcttcgtggacgagaaccaatggaactctgccaaagaggcggttgaagacgagagattttgggatctggtgcatcgggaacgcgagcttcacaagcaggggaagtgcgctacatgcgtctacaacatgatgggaaaaagagaaaagaaactgggcgagttcgggaaggccaaaggcagccgggccatctggtacatgtggctcggagctcgcttcctggagtttgaagccctgggcttcatgaatgaggaccactggttttccagagaaaactctctcagcggggtggagggagagggcctgcataaacttgggtatattctgcgggatatctccaaaattcccggaggcaatatgtacgctgacgataccgccgggtgggacacacgcatcaccgaagatgacctccagaacgaggcgaagatcacagatattatggaacctgagcacgccctgcttgctaagtctatcttcaaactgacctatcagaataaggtcgtgagagttcaacggcccgccaaaaacggcacggtgatggacgtcattagccgcagagatcagcggggatccggccaggtggggacctacggactcaatacatttaccaacatggaagctcagctgatccgccaaatggagagcgagggcattttctctccttccgaactggagacacccaacctcgccgggagagtgctggactggcttgaaaagcatggagttgagcggctgaaaagaatggcgatcagcggcgatgactgtgtggtcaagccgatcgacgatcgctttgccaccgctctcacggccctgaatgacatggggaaggtgcggaaagatattcctcagtgggaaccctctaagggctggaacgactggcagcaggttcctttctgctcccaccactttcatcaacttatcatgaaagatggaagagagattgtggtcccctgtcgcaatcaggacgagctggtgggccgggctagagtcagccagggggccggatggtccctccgcgaaacagcttgcctgggcaagtcttatgcccagatgtggcaactgatgtacttccaccggagagatctccgcctggcggccaacgctatctgtagcgccgtgcctgttgactgggtgcccacctcccggacaacctggagcattcatgcccaccatcagtggatgacgaccgaggatatgctttctgtctggaatagagtgtggatcgaagagaacccgtggatggaagacaaaacacacatttccagctggggagatgttccttatctgggaaagcgcgaggaccagtggtgcggctctctcatcgggctgaccgctcgggccacatgggcgaccaatatccaagtggctattaaccaggtcagacggcttatcggcaatgagaactacctggactacatgacaagcatgaagagatttaaaaatgaatccgatcccgagggagccctctggtga

SEQ ID NO: 18964 - RNA, 9879 nt, synthetic construct
  misc_feature 1..9879: note = derived and/or modified CDS sequence (opt5) from DENV-1__FJ410263__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagaccagcgccggcgttaacatgtgcacccttatcgcgatggacctgggggaactctgtgaagatatcatgacatacaaatgccccagaattaccgagacagaacccgacgatgtggactgttggtgcaatgctaccgatacgtgggtgacctatggaacatgttcccaaaccggcgagcacagacgggacaagcgctctgtcgccctggcccctcatgtggggctgggactcgagacaagaaccgaaacgtggatgagctccgagggcgcttggaaacagatccagcgggttgaaacatgggccctgcgccaccccggcttcaccgtgattgctctttttctggcccatgcgatcgggacatctatcacccagaagggaattatcttcattctcctgatgcttgtcacccctagcatggccatgagatgcgtgggcatcgggtcccgggattttgttgagggactgagcggcgctacatgggtggacgtcgtgctcgagcacgggtcttgtgtgacgaccatggccaaggataaacccacactggacattgaactgctcaagaccgaggtcacaaaccctgctgttctgcgcaaactttgcatcgaagccaagatttccaataccacgacagatagcagatgtccgacccaaggagaggcgaccctggtggaagaacaggacgccaacttcgtgtgccggcgcacatttgtcgatagaggctggggcaatgggtgtggactcttcggcaaagggtctctgattacctgcgctaagtttaagtgcgtgacaaaacttgagggaaagatcgttcagtacgaaaacctgaaatattccgtgattgtcacggtgcacaccggcgaccagcatcaagttgggaatgagagcacagaacacggaaccacagccaccatcacgccccaggctcctaccacagagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaatccagacatccggaaccacaaccatttttgccggccatctcaaatgcagactgaagatggataaacttacgctgaaggggatgagctatgtgatgtgtacaggctctttcaaactcgagaaggaagtcgctgagacccagcacggaaccgtgctggttcagatcaagtacgagggcacagacgccccgtgcaaaatccctttctccacccaagatgaaaagggggtgacacagaacggacggctgattacggcgaatcccatcgtcaccgacaaagagaagcctgtgaacattgaagctgagccgccctttggcgagagctatatcgtgattggggccggagaaaaagcccttaagctctcttggttcaagaaaggcagctccatcgggaagatgtttgaggctacagccagaggcgctcgccggatggccatcctgggagataccgcgtgggacttcggctctattgggggagtttttacaagcgtcggcaaactggtgcatcagatcttcgggaccgcctacggagtgctcttttccggcgtcagctggacgatgaagattgggatcggcgtgctgcttacctggctgggactcaattctagatccacaagcctgtctatgacctgtattgctgttggcctggtgacactttacctcggggtcatggtgcaggccgattccggatgcgttatcaactggaaaggccgcgaactgaagtgtgggagcggaattttcgtgaccaatgaggtccacacatggaccgaacaatataagtttcaggctgactcccctaaacggctgtctgccgcgatcggcaaggcctgggaggagggggtgtgcggcatcagaagcgctacgcgcctcgaaaacattatgtggaaacagatctccaacgagctgaatcatattcttctggaaaacgacatgaagttcacagttgtggtcggagatgtggccggcatcctcgctcaggggaaaaagatgattcggccgcaacccatggagtacaaatattcttggaaaagctggggaaaggccaagatcatcggcgccgacgtgcagaataccacctttattatcgatgggcctaacacacccgaatgtcctgacgatcagagagcttggaatatttgggaggtcgaggactacggattcggcatctttaccacgaacatttggctgaagctgcgcgattcctatacacaggtttgcgaccaccggcttatgagcgcggccatcaaagattctaaggctgtgcacgccgacatgggctactggatcgaatccgagaaaaatgaaacctggaagctcgccagagctagcttcattgaggtgaagacatgtatctggcccaaatctcataccctgtggtccaacggggtcctggaaagcgagatgattatcccgaagatttatggaggccctatctctcaacacaattaccgccccgggtacttcacacaggccgcgggaccttggcatctcggcaaactggagcttgattttgacctgtgcgaagggaccacggtggttgtggatgagcactgcggaaaccggggccccagcctcagaaccacaaccgtcacaggcaagatcattcacgaatggtgttgccggtcctgtaccctgcctcccctgcgcttcagaggggaggacggatgctggtatggcatggagatccggccggtgaaagaaaaggaggaaaatcttgttaagagcatggtgtctgctgggtccggagaggtcgacagcttttccctcggcctgctgtgtatttctatcatgattgaagaggtgatgagaagccgctggtcccggagaatgctcatgacggggacactggccgttttctttcttctgatcatgggacagctcacctggaacgatctgattcgcctgtgcatcatggtgggcgccaatgcttctgacagaatgggcatggggacaacctaccttgccctgatggcgaccttcaaaatgcggcctatgtttgctgtcggactcctgttccgcagactcacaagccgggaggtgctgcttctgacgatcggcctctccctggtggcctctgtcgaactgcccaacagccttgaggaactgggggatggactcgccatgggcattatgatcctgaagctcctgaccgactttcaatcccatcagctttgggctacactgctcagcctgaccttcattaaaacaaccttttctctgcactatgcctggaagacgatggctatggttctttccatcgtgagcctgttccccctctgtctgtctacaacctcccagaaaaccacatggctccctgtgctgcttgggagcctgggatgcaagccgctgaccatgtttctcattgccgagaataagatctggggccgcagatcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacaatgaaaatcaaggatgaggagcgggacgatacgctgaccattcttctgaaagccacactcctggctgtgtctggagtctatcctctcagcatccccgccaccctgttcgtgtggtacttctggcaaaagaaaaagcagcgctccggcgtcctttgggacacaccttctcccccggaagtggagagagccgttctggatgacggcatttatcggatcatgcagcgcgggctgctcggaagaagccaggtgggcgtcggggtgtttcaagaaaacgttttccataccatgtggcacgtgacgcggggagctgtcctgatgtaccagggcaagagacttgagccttcctgggccagcgtgaaaaaggacctgatttcttacgggggaggctggcgcctccagggctcctggaataccggggaggaagtgcaggttatcgcggtcgagcccggcaagaaccctaagaatgtgcaaacagctcccggcacctttaaaacaccggaaggggaggtgggagccattgccctggatttcaagcctggcaccagcgggtctcccatcgtcaaccgggaaggaaagatcgtgggcctctatggcaatggggttgtgacaacgtccggaacctacgtcagcgctattgcccaggcgaaggcttcccaggagggccctctgcccgagatcgaagacgaggtgtttagaaagcgcaaccttacaattatggatctgcaccccgggtctggaaaaacccggagatatctgcctgccatcgttcgcgaagccattaagcggaaactcagaaccctgatccttgctccgacacgcgtggtcgccagcgagatggctgaagccctgaagggcatgcccatccggtaccaaacgaccgcggtgaagtccgagcatacagggaaagagattgttgacctcatgtgccacgccaccttcacaatgagactgctgagccctgtgcgggtccccaattataacatgatcattatggatgaagctcattttaccgacccttcttccatcgccgctcgcggctacattagcacgagagtgggaatgggcgaggccgccgctatcttcatgacagcgacaccccctgggtctgtggaagcctttccgcagagcaatgctgtcatccaggatgaggaacgggacattcccgagcgctcctggaactctggatatgagtggatcaccgatttccctggcaagacagtttggtttgtgcccagcattaaatccgggaatgacatcgccaactgtctcagaaagaatggaaaacgggtgattcagctttctagaaagaccttcgatacagaataccaaaagaccaaaaacaacgactgggactacgtcgtgacgacagatatcagcgagatgggcgccaatttccgcgctgaccgggttattgatcctagacgctgcctgaagcccgtgatcctgaaagacgggccggaacgggtcatcctcgccggccctatgcccgtgaccgttgcgtccgctgcccagagacgcggacggattggcagaaaccacaataaggagggggatcagtatatctacatgggacagcccctgaacaatgacgaggatcatgcccactggacagaagctaaaatgcttctggacaacattaatacccctgagggcatcattcccgccctctttgaacctgagcgcgaaaagagcgcggccatcgatggggagtatagactgcggggagaggctcgcaagacgttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggaccaaggagggagaacgcaagaaactgcgcccccggtggctcgacgctagaacatactccgaccctctggcccttcgcgagtttaaagagttcgctgccggccggagatctgttagcggggatctgattctcgagatcggaaagctgccccagcacctgacccagcgggcgcaaaatgccctcgacaaccttgtgatgctgcataattccgaacagggcgggcgcgcttatagacacgccatggaggagctgcctgatacaattgaaaccctcatgctgcttgctctgatcgccgtgctcacaggaggcgtcaccctgtttttcctgtctggccgggggctcggaaaaacgagcattggccttctgtgtgttatggcctccagcgtgctgctctggatggcttctgtggagccccattggatcgcggcctccatcattctggaatttttccttatggtcctgctcatcccggagcctgaccgccagagaacaccccaggataaccaactggcttacgtggttattgggctgctctttatgatccttaccgtggccgccaatgagatgggactgctggaaaccacaaagaaggacctcggcattgggcacgtcgctgtggagaaccaccatcacgccgcgatgctggatgtcgaccttcatcctgccagcgcttggaccctgtacgccgtggctacaacgatcattacccccatgatgcggcacacaatcgaaaacaccacagccaatatctctctcaccgcgattgccaaccaggctgccatcctgatgggactggataaaggctggcctatttccaagatggacatcggcgttcccctccttgctctggggtgctatagccaggtgaatccgctgacgctcaccgccgctgtcctgatgcttgtggcccattacgcgattatcggacctggcctgcaagccaaagctacacgcgaggcccagaagagaaccgctgccgggatcatgaaaaaccccacagttgatggaattgtggccatcgacctcgatcccgtcgtgtatgacgcgaagttcgaaaagcagctgggccagattatgctgctcatcctttgtacctctcaaattctgctgatgcggacgacatgggctctctgcgagagcatcaccctggccacagggcctcttaccaccctgtgggagggatccccgggcaaattttggaatacaacgatcgctgtgtctatggccaacattttccgcggcagctacctcgccggggctggactggccttctccctgatgaaaagcctcggcgggggaagacggggcaccggggcgcagggagaaacacttggcgagaaatggaagagacagctgaatcagctgtccaaatctgaatttaacacctataagcgcagcggcatcatggaggttgaccggtccgaagccaaggaggggctcaaaagaggagagacaaccaagcacgctgtctctcgcggcacggccaaactgcggtggttcgtggaaagaaatcttgtgaagcccgaggggaaagtcattgatctgggatgtggccgcgggggatggagctactattgcgctggcctcaagaaggttacagaagtgaaaggctacaccaaaggcgggcctgggcacgaggaacccatccctatggccacctacgggtggaacctggtgaaactgcattccggaaaggacgtctttttcattccccctgagaaatgtgatacactcctttgcgacatcggcgagtctagcccgaatcccaccattgaagaggggcggacactgagagtgctgaagatggttgaaccttggctccgcggaaaccaattttgtatcaaaatcctgaatccctatatgccttccgtggtcgagacgcttgagcagatgcagcggaagcacggcggcatgctggtgagaaaccccctcagccgcaattctacccatgaaatgtactgggtttcctgcgggacaggaaacattgtgagcgcggtcaatatgacctctcggatgctgctgaacagattcacaatggcccaccgcaagccgacctatgagagagatgtggacctcggcgctgggacgcggcacgtggccgtcgaacctgaggttgctaacctggatatcattggacagcgcatcgaaaatattaaacatgagcacaagtccacctggcattacgacgaggataacccctataaaacatgggcctaccacggcagctatgaagtgaagccctctgggtccgctagctccatggtgaatggagtcgtgaaacttctgaccaagccttgggacgttatccccatggtgacacaaatcgccatgaccgatacaaccccttttggccagcagagagtcttcaaggagaaagtggacacgcggacaccgaaggcgaaaagaggcaccgcccaaattatggaagttaccgctaagtggctctgggggtttctgagccggaacaaaaagccccgcatctgtacaagagaggagttcacgcggaaggtgcgctctaatgccgctattggagccgtctttgtggacgagaaccagtggaatagcgccaaagaggcggttgaagatgagagattctgggaccttgtgcatcgggaacgcgagctgcacaagcagggcaaatgcgctacctgcgtctacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtggagggggagggacttcataagctgggctatattctccgggacatctctaaaatccctgggggaaatatgtacgctgatgacacagccggctgggatacccgcattacagaagacgatctgcagaacgaggcgagaatcaccgacattatggaacccgagcacgcccttctggctaagagcatctttaaactcacatatcaaaataaggtcgtgcgggttcagcgccctgccaaaaacgggaccgtgatggatgtcatttccagacgggaccagagaggctctggacaggtgggcacgtacgggctgaataccttcacaaacatggaagctcaactgatccgccagatggagagcgagggaatcttttcccccagcgaactcgagaccccgaacctggccgaacgggtgcttgattggctggagaagtatggcgttgaaagactcaagcgcatggcgatttctggggacgactgtgtggtcaaacctatcgatgaccggttcgccacagctctgaccgcccttaatgatatgggaaaggtgagaaaagacattccccagtgggagccttccaagggctggaacgattggcagcaagttcccttttgcagccatcacttccaccagctgatcatgaaagacgggcgcgagattgtggtcccttgtcggaatcaggatgaactcgtgggcagagctcgcgtctctcagggagccggctggtccctgcgggagacggcttgcctgggaaagagctacgcccaaatgtggcagctcatgtattttcatagacgcgacctgcggcttgcggccaacgctatctgttccgccgtgcccgttgattggattccgacatctagaaccacatggagcatccacgcccatcaccagtggatgaccacggaagacatgctgtccgtgtggaatcgggtctggatcgaggaaaacccttggatggaggataagacccatattagctcttggggagacgtgccctacctcggcaaaagagaggaccaatggtgcgggtccctgatcggacttacagctcgcgccacctgggcgacaaatattcaggttgctatcaaccaggtgcggagactgattggcaatgaaaactacctcgattatatgaccagcatgaagcgcttcaaaaatgagtctgaccccgaaggggccctgtggtga

SEQ ID NO: 18965 - RNA, 9879 nt, synthetic construct
  misc_feature 1..9879: note = derived and/or modified CDS sequence (opt5) from DENV-1__FJ410264__SS-prME
  source 1..9879: mol_type = other RNA
agcgtgaccatgctgctcatgctgatgcccaccgcccttgctttccacctgacgacccggggcggggaacctcatatgatcgtgaccaagcaggaacggggaaaatccctcctgtttaagacctctgccggcgttaacatgtgcacccttattgccatggacctgggggaactctgtgaagataccatgacgtacaaatgcccccgcatcaccgaagctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggccggagaaaaagctcttaagctctcttggttcaagaaaggcagctccatcgggaagatgtttgaggccaccgctagaggcgcccgccggatggcgatcctgggagatacagcctgggacttcggctctgtcgggggagtttttaccagcgtcggcaaactggtgcatcagattttcgggacagcttacggagtgctcttttccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatcttcgtgacaaatgaggtccacacctggacagaacaatataagtttcaggccgactcccctaaacggctgtctgcggccattggcaaggcttgggaggagggggtgtgcggcatcagaagcgccacccgcctcgaaaacatcatgtggaaacagatttccaacgagctgaatcatatccttctggaaaacgacatgaagttcacggttgtggtcggagatgtggtgggcattctcgctcaggggaaaaagatgatccggccgcaacccatggagcacaaatactcttggaaaagctggggaaaggccaagattatcggcgccgacgtccagaatacaacctttatcattgatgggcctaacacccccgaatgtcctgacgatcagagagcttggaatatctgggaggttgaggactatggattcggcatttttacaaccaacatctggctgaagctgcgcgattcctacacacaggtgtgcgaccaccggcttatgagcgcggccattaaagattctaaggctgtgcatgccgacatgggctattggatcgaatccgagaaaaatgaaacatggaagctcgccagagctagcttcatcgaggtcaagacctgtatttggcccaaatctcacacactgtggtccaacggggtgctggaaagcgagatgatcattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcacagagaataagatttggggcagaaaatcttggcccctgaacgaaggcatcatggctgtgggggttgtgtccatcctcctgagctccctcctgaagaacgatgtccctcttgccggacccctgattgcgggcgggatgctgatcgcctgttatgtgattagcggatctagcgctgacctctccctggagaaagccgctgaggtttcttgggaagaggaagccgagcacagcggcgcctcccataatatccttgtggaagtccaggatgacgggacgatgaagattaaagatgaggagcgggacgataccctgacaatcctcctgaaggctaccctcctggcggtgtctggagtctaccctcttagcatccccgccacactgttcgtgtggtatttttggcaaaagaaaaagcagcgctccggcgttctgtgggacaccccttctcccccggaagtggagagagctgtcctcgatgacggcatttaccggatcatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggccagcgttaagaaagacctgatttcttacgggggaggctggagactccagggctcctggaatacaggggaggaagtccaggtgatcgctgtggagcccggaaagaaccctaagaatgtccaaaccgcccccggcacatttaaaaccccggaaggggaggtgggagcgattgctctggatttcaagcctggcacaagcgggtctcccatcgttaaccgggaaggaaaaattgtgggcctttacggcaatggggtcgtgacgacctccggaacatatgttagcgccatcgcccaggctaaggcctcccaggagggccctctgcccgagatcgaagacgaggtgtttagaaaacgcaacctgaccattatggatctccatcccgggtctggaaagacccggagatacctgcctgcgatcgtccgcgaagctattaagcggaaacttagaacactgatcctcgccccgacgcgcgtggttgccagcgagatggctgaagccctgaagggcatgcccattcggtatcaaaccacagctgtgaaatccgagcacaccgggaaggagatcgtcgacctgatgtgccatgccacattcaccatgagactccttagccctgtgcgcgtgcccaattacaacatgatcattatggatgaagcgcactttacggacccttcttccatcgccgctcggggctatattagcacaagagtcggaatgggcgaggccgctgccatcttcatgaccgccacaccccctgggtctgttgaggcttttccgcagagcaatgcggtgattcaggatgaggaacgggacatccccgagcgctcctggaactctggatacgagtggatcacagatttccctggcaaaaccgtgtggtttgtccccagcattaagtccgggaatgacatcgccaactgtctgagaaagaatggaaaacgggtgattcagctgtctcgcaagacattcgataccgaatatcagaagacgaagaacaacgactgggactacgttgtgacaaccgatatcagcgagatgggcgctaattttagagccgaccgggtcattgatcctagacgctgcctcaaacccgtgatcctgaaggacgggccggaacgggttattcttgccggccctatgcccgtgacagtcgcttccgccgcgcagagacgcggacggatcggcagaaaccataataaggagggggatcagtacatctatatgggacagcccctgaacaatgacgaggatcacgctcactggaccgaagccaaaatgctcctggacaacattaatacgcctgagggcatcattcccgccctgttcgaacctgagcgcgaaaagagcgctgccatcgatggggagtaccggctcagaggagaggcgcgcaaaaccttcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatttggacaaaagagggagaacgcaagaaactgagaccccggtggcttgacgctagaacctattccgaccctctggccctccgcgagtttaaggagttcgctgccggccggagatctgtgagcggggatctgatcctggagatcggaaagctcccccagcatcttacacagcgcgctcaaaatgccctggacaacctggtcatgctccacaattccgaacagggcgggcgggcgtacagacatgccatggaggagctgcctgataccattgaaacacttatgctgctcgctctgatcgccgttctgaccggaggcgtgacgctctttttcctttctggccgggggctgggaaaaacaagcattggcctgctctgtgtgatggcttccagcgtcctgctttggatggcctctgtggagccccactggatcgccgcttccattatcctggaatttttcctcatggttctgctgatcccggagcctgaccgccagagaacaccccaggataaccaactcgcgtatgtggtcattgggcttctgtttatgatcctgaccgtggccgctaatgagatgggactcctggaaacaaccaagaaagaccttggcattgggcacgtcgccgtggagaaccatcaccatgccacaatgctggatgttgacctccaccctgctagcgcctggacgctgtacgcggtggccaccacaatcattacccccatgatgcggcatacaatcgaaaacaccacggctaatatttctctgaccgccatcgctaaccaggccgcgatcctcatgggacttgataagggctggcctatttccaaaatggacatcggcgtccccctgctggccctcgggtgctacagccaggtgaatccgctgacacttaccgctgccgttctgatgctcgtggctcactatgccattatcggacctggcctgcaagctaaggccacacgcgaggcgcagaagagaaccgccgctgggattatgaaaaaccccacggtcgatggaatcgtggccatcgacctggatcccgtggtttacgacgctaagttcgaaaaacagctcggccagattatgcttctgatcctgtgtacatctcaaattctcctgatgcggaccacatgggccctttgcgagagcatcaccctggccaccgggcctctcacaacgctgtgggagggatccccgggcaagttttggaataccacaattgcggtctctatggctaacatcttccgcggcagctatctggccggggctggactcgccttttcccttatgaaaagcctgggcgggggaagacggggcaccggggcccagggagaaacactgggcgagaagtggaagcgccagctcaatcagctgtccaaatctgagttcaacatctacaagagaagcggcattatggaggtggaccggtccgaagctaaagaggggcttaagagaggagagaccacgcgccacgccgtgtctcggggcacagcgaaactgagatggttcgtcgaacgcaatctcgttaagcccgaggggaaggtgatcgatctgggatgtggcagagggggatggagctattactgcgccggcctgaaaaaggtgaccgaagtcaaaggctataccaaagggggacctggccatgaggaacccattcctatggctacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggtcgaaccttggcttcggggaaaccaattttgtatcaagattctgaatccctacatgccttccgtggttgagacactcgagcagatgcagagaaaacatggcggcatgctggtgcgcaaccccctgagcagaaattctacccacgaaatgtattgggtctcctgcgggacaggaaacatcgtgagcgccgtgaatatgacctctagaatgctcctgaaccgcttcacgatggctcaccggaagccgacctacgagagagatgtcgaccttggcgccgggacacgccatgttgcggtggaacctgaggtggccaacctggatatcattggacagagaatcgaaaatattaaacacgagcataagtccacctggcactatgacgaggataacccctacaaaacatgggcttatcatggcagctacgaagtcaagccctctgggtccgccagctccatggtgaatggagttgtgaagctcctgaccaaaccttgggacgtcatccccatggtgacacaaattgctatgaccgatacgacaccttttggccagcagcgggttttcaaggagaaagtggacacccgcaccccgaaggccaaaagaggcacagctcaaatcatggaagtcacggcccggtggctttgggggtttctgagcagaaacaagaagccccggatctgtacccgcgaggagttcacaagaaaagtgcggtctaatgcggccattggagctgtttttgtggacgagaaccagtggaatagcgccaaggaggctgtcgaagatgagcgcttctgggacctcgtgcagaaagaaagagagctgcacaagcagggcaaatgcgcgacctgcgtctataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgccgatgacacagctggctgggataccagaatcacagaagacgatctgcaaaacgaggccaagatcaccgacattatggaacccgagcacgctctcctggccacgagcatctttaaactgacctaccagaataaggttgtgcgggtccagcgccctgcgaagaacgggacagtgatggatgtgatttccagacgggaccagcgcggctctggacaagttggcacctatgggctcaatacattcaccaacatggaagcccagctgatcagacagatggagagcgagggaatttttcttccctccgaactggagacgccgaacctcgctgaacgggtgctggattggcttgagaaatacggcgtcgaaagactgaagcgcatggccatcagcggggacgactgtgtggttaaacctatcgatgaccggttcgctacagccctcaccgcgctgaatgatatgggaaaggtgagaaaagacattccccagtgggagccttctaagggctggaacgattggcaacaggtccccttttgctcccatcacttccaccagctgatcatgaaggacgggcgcgagattgtggtcccttgtcggaatcaggatgaactcgtgggcagagcccgcgttagccaaggagctggctggtctctgcgggagacagcctgccttgggaaatcctatgctcagatgtggcagctgatgtactttcatagacgcgacctccggctggccgctaacgccatctgtagcgcggtgcccgtcgattgggtgccgacctccagaacgacctggtctattcacgcccatcaccaatggatgacaaccgaagacatgcttagcgtttggaatcgcgtgtggatcgaggaaaacccttggatggaggataagacacatgtctccagctggggagacgtgccctatctgggcaaacgggaggaccagtggtgcgggtctctcattggactgaccgctagagccacatgggcctccaatatccaggtggctatcaaccaggttcggagactgattggcaatgaaaactacctcgattacatgaccagcatgaagcgcttcaaaaatgagggggaccccgaaggcgccctgtggtga

SEQ ID NO: 18966 - RNA, 9879 nt, synthetic construct
  misc_feature 1..9879: note = derived and/or modified CDS sequence (opt5) from DENV-1__FJ410265__SS-prME
  source 1..9879: mol_type = other RNA
agcgtgaccatgctgctcatgctgatgcccaccgcccttgctttccacctgacgaccagaggaggggaacctcatatgattgtctccaagcaggaacggggaaaatctctcctgtttaagacaagcgccggcgttaacatgtgcacccttattgcgatggacctgggggaactctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaaaattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtacatctatcatgattgaagaggtgatgagaagccgctggtcccggagaatgctcatgaccgggacactggccgttttctttcttctgatcatgggacagctcacctggaacgatctgattcgcctgtgcatcatggtgggcgccaatgcttctgacagaatgggcatggggaccacataccttgccctgatggcgacgttcaaaatgcggcctatgtttgctgtcggactcctgttccgcagactcaccagccgggaggtgctgcttctgacaattggcctctccctggtggcctctgtcgaactgcccaacagccttgaggaactgggggatggactcgccatgggcatcatgatcctgaagctcctgaccgactttcaatcccatcagctttgggctacactgctcagcctgaccttcattaaaacgacattttctctgcactatgcctggaagaccatggctatggttctttccatcgtgagcctgttccccctctgtctgtctaccacatcccagaaaaccacatggctccctgtgctgcttgggagcctgggatgcaagccgctgacgatgtttctcattgccgagaataagatctggggccgcagatcttggcccctgaacgaaggcattatggcggtcgggatcgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggaccatgaaaattaaggatgaggagcgggacgatacactgaccatccttctgaaagccacactcctggctgtgtctggagtctatcctctcagcatccccgccaccctgttcgtgtggtacttctggcaaaagaaaaagcagcgctccggcgtcctttgggacacgccttctcccccggaagtggagagagccgttctggatgacggcatttatcggatcatgcagcgcgggctgctcggaagaagccaggtgggcgtcggggtgtttcaagaaaacgttttccataccatgtggcacgtgacacggggagctgtcctgatgtaccagggcaagagacttgagccttcctgggccagcgtgaaaaaggacctgatttcttacgggggaggctggcgcctccagggctcctggaataccggggaggaagtgcaggttatcgcggtcgagcccggcaagaaccctaagaatgtgcaaacagctcccggcacctttaaaacaccggaaggggaggtgggagccattgccctggatttcaagcctggcacgagcgggtctcccatcgtcaaccgggaaggaaagattgtgggcctctatggcaatggggttgtgaccacatccggaacctacgtcagcgctatcgcccaggcgaaggcttcccaggagggccctctgcccgagatcgaagacgaggtgtttagaaagcgcaaccttaccattatggatctgcaccccgggtctggaaaaacacggagatatctgcctgccatcgttcgcgaagccattaagcggaaactcagaacgctgatccttgctccgacccgcgtggtcgccagcgagatggctgaagccctgaagggcatgcccattcggtaccaaacaaccgcggtgaagtccgagcatacagggaaagagatcgttgacctcatgtgccacgccaccttcacgatgagactgctgagccctgtgcgggtccccaattataacatgatcattatggatgaagctcattttacagacccttcttccatcgccgctcgcggctacattagcaccagagtgggaatgggcgaggccgccgctatcttcatgaccgcgacaccccctgggtctgtggaagcctttccgcagagcaatgctgtcattcaggatgaggaacgggacatccccgagcgctcctggaactctggatatgagtggatcaccgatttccctggcaagacagtttggtttgtgcccagcattaaatccgggaatgacatcgccaactgtctcagaaagaatggaaaacgggtgattcagctttctagaaagaccttcgatacggaataccaaaagaccaagaacaacgactgggactacgtcgtgaccacagatatcagcgagatgggcgccaatttccgcgctgaccgggttattgatcctagacgctgcctgaagcccgtgatcctgaaagacgggccggaacgggtcattctcgccggccctatgcccgtgaccgttgcgtccgctgcccagagacgcggacggatcggcagaaaccacaataaggagggggatcagtatatctacatgggacagcccctgaacaatgacgaggatcatgcccactggacggaagctaaaatgcttctggacaacattaatacccctgagggcatcattcccgccctctttgaacctgagcgcgaaaagagcgcggccatcgatggggagtatagactgcggggagaggctcgcaagacattcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatttggaccaaggagggagaacgcaagaaactgcgcccccggtggctcgacgctagaacatactccgaccctctggcccttcgcgagtttaaagagttcgctgccggccggagatctgttagcggggatctgatcctcgagatcggaaagctgccccagcacctgacccagcgggcgcaaaatgccctcgacaaccttgtgatgctgcataattccgaacagggcgggcgcgcttatagacacgccatggaggagctgcctgatacaattgaaaccctcatgctgcttgctctgatcgccgtgctcacgggaggcgtcacactgtttttcctgtctggccgggggctcggaaaaaccagcattggccttctgtgtgttatggcctccagcgtgctgctctggatggcttctgtggagccccattggatcgcggcctccattatcctggaatttttccttatggtcctgctcatcccggagcctgaccgccagagaacaccccaggataaccaactggcttacgtggttattgggctgctctttatgatccttacagtggccgccaatgagatgggactgctggaaaccacaaagaaggacctcggcattgggcacgtcgctgtggagaaccaccatcacgccgcgatgctggatgtcgaccttcatcctgccagcgcttggacgctgtacgccgtggctaccacaatcattacccccatgatgcggcacacaatcgaaaacaccacggccaatatttctctcaccgcgatcgccaaccaggctgccatcctgatgggactggataaaggctggcctatttccaagatggacatcggcgttcccctccttgctctggggtgctatagccaggtgaatccgctgacactcaccgccgctgtcctgatgcttgtggcccattacgcgattatcggacctggcctgcaagccaaagctacacgcgaggcccagaagagaaccgctgccgggattatgaaaaaccccacggttgatggaatcgtggccatcgacctcgatcccgtcgtgtatgacgcgaagttcgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattttggaataccacaattgctgtgtctatggccaacatcttccgcggcagctacctcgccggggctggactggccttctccctgatgaaaagcctcggcgggggaagacggggcaccggggcgcagggagaaacacttggcgagaaatggaagagacagctgaatcagctgtccaaatctgaatttaacacctataagcgcagcggcatcatggaggttgaccggtccgaagccaaggaggggctcaaaagaggagagacgacaaagcacgctgtctctcgcggcaccgccaaactgcggtggttcgtggaaagaaatcttgtgaagcccgaggggaaagtcattgatctgggatgtggccgcgggggatggagctactattgcgctggcctcaagaaggttaccgaagtgaaaggctacacaaaaggcgggcctgggcacgaggaacccatccctatggccacctacgggtggaacctggtgaaactgcattccggaaaggacgtctttttcattccccctgagaaatgtgatacactcctttgcgacatcggcgagtctagcccgaatcccacgattgaagaggggcggaccctgagagtgctgaagatggttgaaccttggctccgcggaaaccaattttgtatcaaaattctgaatccctatatgccttccgtggtcgagacacttgagcagatgcagcggaagcacggcggcatgctggtgagaaaccccctcagccgcaattctacccatgaaatgtactgggtttcctgcgggacaggaaacatcgtgagcgcggtcaatatgacctctcggatgctgctgaacagattcacgatggcccaccgcaagccgacctatgagagagatgtggacctcggcgctgggacacggcacgtggccgtcgaacctgaggttgctaacctggatatcattggacagcgcatcgaaaatattaaacatgagcacaagtccacctggcattacgacgaggataacccctataaaacatgggcctaccacggcagctatgaagtgaagccctctgggtccgctagctccatggtgaatggagtcgtgaaacttctgaccaagccttgggacgttatccccatggtgacacaaattgccatgaccgatacgacaccttttggccagcagagagtcttcaaggagaaagtggacacccggaccccgaaggcgaaaagaggcacagcccaaatcatggaagttacggctaagtggctctgggggtttctgagccggaacaaaaagccccgcatctgtaccagagaggagttcacacggaaggtgcgctctaatgccgctattggagccgtctttgtggacgagaaccagtggaatagcgccaaagaggcggttgaagatgagagattctgggaccttgtgcatcgggaacgcgagctgcacaagcagggcaaatgcgctacctgcgtctacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtggagggggagggacttcataagctgggctatattctccgggacatctctaaaattcctgggggaaatatgtacgctgatgacacagccggctgggatacccgcatcacagaagacgatctgcagaacgaggcgaagatcaccgacattatggaacccgagcacgcccttctggctaaaagcatctttaagctcacgtatcaaaataaagtcgtgagagttcagcggcctgccaagaacgggaccgtgatggatgtcatttcccgcagagaccagcggggctctggacaggtgggcacatacgggctgaataccttcacaaacatggaagctcaactgatcagacagatggagagcgagggaatcttttcccccagcgaactcgagaccccgaacctggccgaacgcgcgcttgattggctggagaagtatggcgtggaacggctcaaaagaatggccatctctggggacgactgtgttgtgaagcctatcgatgaccgcttcgctacggccctgacagctcttaatgatatgggaaaagtccggaaggacattccccagtgggagccttccaaaggctggaacgattggcagcaagtgcccttttgcagccatcacttccaccagctgatcatgaaggacgggagagagattgttgtgccttgtcgcaatcaggatgaactcgtcggccgggccagagtgtctcagggagctggctggtccctgcgcgagaccgcctgcctgggaaagagctacgcgcaaatgtggcagctcatgtattttcatcggagagacctgcgccttgccgctaacgccatctgttccgccgtccccgtggattggattccgacatctcggaccacgtggagcatccacgctcatcaccagtggatgaccacagaagacatgctgtccgtttggaatagagtgtggattgaggaaaacccttggatggaggataaaacccatatcagctcttggggagacgtcccctacctcggcaagcgggaggaccaatggtgcgggtccctgatcggacttacagccagagcgacctgggctacaaatattcaggtggccatcaaccaggttcgccggctgattggcaatgaaaactacctcgattatatgaccagcatgaaaagattcaagaatgagtctgaccccgaaggggccctgtggtga

SEQ ID NO: 18967 - RNA, 9879 nt, synthetic construct
  misc_feature 1..9879: note = derived and/or modified CDS sequence (opt5) from DENV-1__FJ461336__SS-prME
  source 1..9879: mol_type = other RNA
tccgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccagacaggcgagcacagacgggacaagcgctctgttgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggaaccgggattttgttgagggactgtccggcgctacgtgggtggacgtcgtgctcgagcacgggagctgtgtgaccacaatggccaaggataaacccaccctggacatcgaactgctcaagacagaggtcaccaatcctgctgttctgcgcaaactttgcattgaagccaagatctctaacacgacaaccgattccagatgtccgacccaaggagaggcgacactggtggaggaacaagacgccaatttcgtgtgccggcgcacctttgtcgatagaggctggggcaacgggtgtggactcttcggcaaagggagcctgattacatgcgctaagtttaagtgcgtgacgaaacttgagggaaagatcgttcagtacgaaaatctgaaatattctgtgatcgtcaccgtgcacacaggcgaccagcatcaagttgggaacgagtccaccgaacacggaacaaccgccacgattacaccccaagctcctaccaccgagatccagctcacagactacggcgccctgaccctggattgtagcccccggacgggcctcgacttcaatgaaatggtgctgcttacaatgaaggagaaatcttggctggtccataagcagtggtttctcgatctgcctcttccctggacctccggggccagcacatcccaagagacctggaaccgccaggacctgctcgtgaccttcaaaacagctcacgcgaagaagcaggaagtcgtggttctgggatctcaagagggcgccatgcacacggctctgaccggggccacagaaattcagaccagcggaacaaccacgatctttgccggccatctcaaatgcagactgaagatggataaacttacactgaaggggatgtcctatgtgatgtgtaccggcagcttcaaactcgagaaggaagtcgctgagacccagcacggaacagtgctggttcagattaagtacgagggcaccgacgccccgtgcaaaatccctttctctacacaagatgaaaagggggtgacgcagaatggacggctgatcaccgcgaaccccattgtcacagacaaagagaagcctgtgaatatcgaagctgagccgccctttggcgagtcctatattgtgatcggggccggagaaaaagcccttaagctcagctggttcaagaaaggctctagcattgggaagatgtttgaggctaccgccagaggcgctcgccggatggccatcctgggagatacagcgtgggacttcggctccatcgggggagttctgacctctgtcggcaaactcgtgcatcagatttttgggacggcctacggagtgctgttcagcggcgtctcctggaccatgaagatcgggattggcgtgcttctgacatggctcggactgaacagcagatctacctccctgagcatgacatgtatcgctgttggccttgtgaccctctacctgggggtcatggtgcaggccgattctggatgcgttattaattggaaaggccgcgaactgaagtgtgggtccggaatctttgtgacaaacgaggtccacacctggacggaacaatataagttccaggctgacagccctaaacggctctccgccgcgattggcaaggcctgggaggagggggtgtgcggcatcagatctgctacacgcctggaaaacatcatgtggaaacagattagcaatgagcttaaccatatcctgctcgaaaatgacatgaagtttaccgttgtggtcggagatgtggccggcattctggctcaggggaaaaagatgatccggccgcaacccatggagtacaaatattcctggaagtcttggggaaaggccaaaattatcggcgccgacgtgcagaacaccacattcatcattgatgggcctaatacccccgaatgtcctgacgatcagagagcttggaacatctgggaggtcgaggactacggatttggcattttcacgacaaatatctggctgaaacttcgcgatagctatacccaggtttgcgaccaccggctcatgtccgcggccattaaagatagcaaggctgtgcacgccgacatgggctactggatcgaatctgagaaaaacgaaacatggaagctggccagagcttcctttatcgaggtgaagacctgtatttggcccaaaagccatacactgtggtctaatggggtcctcgaatccgagatgatcattccgaagatctatggaggccctattagccaacacaactaccgccccgggtacttcacccagacggccggaccttggcatctgggcaaacttgagctggatttcgacctctgcgaagggaccacagtggttgtggatgagcactgcggaaatcggggcccctctctgagaaccacaaccgtcacgggcaagatcatccacgaatggtgttgccggagctgtacactgcctccccttcgctttagaggggaggacggatgctggtatggcatggagattcggccggtgaaagaaaaggaggaaaacctcgttaagtccatggtgagcgcggggtctggagaggtcgactccttcagcctgggcctgctctgtatctccattatgatcgaagaggtgatgagatctcgctggagccggaaaatgctgatgaccgggacacttgctgtctttttcctgctcattatgggacagctgacctggaatgatctgatcagactttgcattatggtgggcgccaacgcctccgaccgcatgggcatggggaccacatacctggctctcatggccacgtttaagatgagacctatgttcgcggtcggactgctctttcggcgcctgacctctagagaggtgcttctgctcacaatcggcctgagcctggtggcttccgtcgaacttcccaattctctggaggaactcggggatggactggccatgggcatcatgattctcaaactgcttaccgacttccaaagccatcagctgtgggccacactcctgtccctgacctttatcaagacgacattcagccttcactatgcttggaaaaccatggccatggttctgtctattgtgtccctctttcccctgtgtctcagcaccacatctcagaagaccacatggctgcctgtgcttctggggtccctgggatgcaagccgctcacgatgttcctgatcgctgagaacaaaatttggggccggcgcagctggccccttaacgaaggcatcatggccgtcgggatcgtgtctattctgctctccagcctgctcaagaatgatgttcctctggcgggaccccttatcgccggcgggatgctgattgcttgttacgtgatctccggaagctctgccgacctgagcctcgagaaagctgccgaggtctcctgggaagaggaagccgagcattctggcgctagccacaacattctggtggaagttcaggatgacgggaccatgaagatcaaagatgaggagagagacgatacacttaccatcctgctcaaggcgacactgctcgccgtgtccggagtctatcctctgtctattcccgctaccctttttgtgtggtacttctggcagaagaagaagcagcggagcggcgtcctgtgggacacgcctagccctcccgaagtgggccgcgccgttctggatgacgggatctatagaattatgcagcggggactcctgggccgctctcaggtgggggtcggagtgttccaagagaatgtttttcataccatgtggcacgtgacaagaggcgccgtccttatgtaccaggggaaacggctggaacccagctgggcttccgtgaagaaagacctcatcagctacggaggcggctggagactgcaggggtcttggaacaccggagaggaggtgcaggttattgccgtcgaacccggcaagaatcctaaaaacgtgcaaacagcgcccgggaccttcaagacaccggagggagaagtgggcgctatcgccctcgattttaagcctgggacgtccggaagccccattgtcaatcgcgagggcaaaatcgtgggcctgtatgggaacggagttgtgaccacatctggcacctacgtctccgccatcgctcaggccaaggcgagccaggaagggcctcttcccgagattgaggacgaagtgttccggaaaagaaatctgaccatcatggatctgcaccccggatccggcaagacacgccggtatctccctgctattgttagagaggccatcaaacgcaagctgcggacgcttattctggccccgaccagagtggtcgcttctgaaatggccgaggctctcaaggggatgcccatccgctaccaaacaaccgccgtgaaaagcgaacatacaggcaaggagatcgttgacctgatgtgccacgcgacctttacgatgcggctgctctcccctgtgagagtccccaactataatatgattatcatggatgaggcccatttcacagaccctagctctattgctgcccggggatacatctccacccgcgtgggcatgggggaagctgccgccatttttatgaccgctacaccccctggaagcgtggaggcgttcccgcagtctaacgccgtcatccaggatgaagagagagacatccccgaacggagctggaactccggctatgagtggattaccgattttcctgggaaaacagtttggttcgtgccctctatcaagagcggaaacgacattgctaattgtcttcgcaaaaacggcaagagagtgatccagctgtcccggaagacctttgatacggagtaccagaagaccaagaacaatgactgggactacgtcgtgaccacagatatttctgaaatgggggccaacttcagagccgaccgcgttatcgatcctcggagatgcctgaaacccgtgattctcaaggacggcccggagcgcgtcatcctggctggacctatgcccgtgaccgttgccagcgcggctcagcggagaggccgcatcgggcggaatcacaacaaagaaggagatcagtatatttacatgggccagccccttaataacgacgaggatcatgcccactggacggaggccaagatgctgctcgacaatatcaacacccctgaagggattatccccgctctgttcgagcctgaaagagagaagtccgccgcgattgatggagaatatcgcctgagaggcgaggcccggaaaacatttgtggagctcatgcgcagaggggaccttccggtctggctgagctacaaggtggcttctgaaggcttccaatattccgatcggcgctggtgctttgacggagagagaaataaccaggtcctggaagagaatatggatgtggaaatctggaccaaagagggcgagcggaagaaactcagaccccgctggctggacgcccggacatacagcgaccctcttgctctgagagagttcaaggagtttgccgctgggcgccggtccgtttctggagatctcatcctggaaattggcaaactgccccagcacctcacccagagagcccaaaacgcgcttgacaatctggtgatgctgcataacagcgagcaagggggacgggcctatcgccacgctatggaagaactccctgatacaatcgagaccctgatgcttctggccctcattgctgtgctgacgggcggcgtcacactgttctttctctccgggagaggacttggcaagacctctatcgggctgctgtgtgttatggccagctccgtgctcctgtggatggccagcgtggaaccccattggattgctgcgtctatcatccttgagttctttctgatggtcctcctgattccggaacctgaccggcagcgcacaccccaggataatcaactggcctacgtggttatcggactccttttcatgattctgacagtggctgccaacgagatgggcctgctcgagaccacaaagaaagacctggggatcggacacgtcgccgtggaaaaccaccatcacgctgccatgcttgatgtcgacctgcatcctgcgtccgcctggacgctctacgctgtggccaccacaattatcacccccatgatgagacacacaattgagaataccacggctaacatcagcctgaccgccatcgcgaatcaggccgctattctgatgggcctcgataagggctggcctatctctaaaatggacattggggttccccttctggccctgggatgctattcccaggtgaacccgctcacactgaccgctgccgtccttatgctggtggctcattacgccatcattggccctgggctccaagcgaaggccacacgggaagctcagaaacgcaccgccgctggaatcatgaagaatcccacggttgatggcatcgtggccattgacctggatcccgtcgtgtatgacgccaagtttgagaaacagctggggcagatcatgctccttattctgtgtacaagccaaatcctgctcatgagaaccacatgggcgctgtgcgaatctattacccttgctaccggacctctgacaacgctctgggagggcagcccgggcaagttctggaacaccacaatcgccgtgtccatggctaatatctttcgggggtcttacctggccggagccggcctggctttcagcctcatgaaatcccttgggggaggccgcagagggaccggagcccagggcgagacactgggcgaaaagtggaaacggcagctgaaccagctcagcaagtccgagttcaatacctataagagatctgggattatggaagttgaccgcagcgaggcgaaagaaggactgaagcggggcgagacgacaaaacacgccgtctccagagggaccgctaaacttcgctggtttgtggagcggaacctggtgaaacccgaaggaaaggtcatcgatctcggctgtgggagaggaggctggtcttactattgcgccggcctgaagaaagttaccgaggtgaaggggtacacaaaaggaggccctgggcacgaggaacccattcctatggctacctacggatggaatctggtgaagctccatagcggcaaagacgtcttctttattccccctgaaaagtgtgatacacttctgtgcgacatcggggagtcctctccgaaccccacgatcgaggaaggacgcaccctgcgggtgctcaaaatggttgagccttggctgagaggcaatcaattctgtattaagatccttaacccctatatgcctagcgtggtcgaaacactggagcagatgcagcgcaagcacggcgggatgctcgtgcggaatcccctgtccagaaacagcacccatgagatgtactgggtttcttgcggaacaggcaatatcgtgtccgccgtcaacatgaccagccgcatgctgctcaaccggtttacgatggcgcacagaaaaccgacctatgaacgcgatgtggacctgggggccggaacaagacacgtggctgtcgagcctgaagttgccaatcttgatattatcggccagcggattgagaacatcaagcatgaacacaaatctacctggcattacgacgaggataatccctataagacatgggcttaccacgggtcctatgaggtgaaacccagcggatctgcctccagcatggtgaacggcgtcgtgaagctgctcaccaagccttgggacgttattcccatggtgacacaaatcgctatgaccgatacgacacctttcggccagcagcgcgtctttaaagaaaaggtggacaccagaaccccgaaagccaagcgggggacagcgcaaatcatggaggttacggccaaatggctgtggggattcctttccagaaataagaagccccggatttgtacccgcgaagagtttacaagaaaagtgcggagcaacgctgccatcggcgctgtcttcgtggacgaaaatcagtggaactctgccaaggaggccgttgaggatgaacgcttttgggacctggtgcatagagagcgggaactccacaaacaggggaagtgcgcgacctgcgtctacaatatgatgggaaaacgcgagaagaagctgggcgagttcgggaaagctaagggcagcagagccatttggtacatgtggctgggagcccggtttctcgagttcgaggctctgggcttcatgaacgaagatcactggttttcccgcgaaaattctcttagcggggtggaaggagagggcctgcataaactcgggtatatcctgagagacatttccaacatccctggaggcaatatgtacgccgatgacacagctgggtgggatacccggatcacagaggacgatcttcagaacgaagcccgcattaccgacatcatggagcccgaacacgcgctgctcgccaagtctattttcaaactgacgtatcaaaataaggtcgtgagagttcagcggcctgctaaaaacggcaccgtgatggatgtcatcagccgcagagaccagcggggatccggccaggtggggacatacggactgaacacctttacaaatatggaggcccaactcattagacagatggaatctgagggcatcttcagcccctccgagctggaaaccccgaaccttgctgagcgcgtgctggattggctcgaaaagtatggggttgagcggctgaagagaatggccatcagcggagacgactgtgtggtcaaacctattgatgaccgctttgcgacggcccttacagctctgaatgatatgggcaaggtgcggaaagacatcccccagtgggaaccttctaaggggtggaacgattggcagcaagttcccttctgctcccatcactttcaccagctcattatgaaagacggcagagagatcgtggtcccttgtcgcaatcaggatgagctggtgggacgggccagagtcagccagggcgctgggtggtctctgcgcgaaaccgcctgcctcggaaagtcctacgctcaaatgtggcagctgatgtatttccatcggagagaccttcgcctggccgcgaacgccatttgtagcgctgtgcccgttgattggatcccgacatcccggaccacgtggtctattcacgcccatcaccagtggatgaccacagaggacatgctcagcgtgtggaatagagtctggatcgaagagaacccttggatggaagataagacccatatctccagctggggcgacgtgccctacctggggaaacgggaggaccaatggtgcggatctcttattggcctgacagccagagctacctgggccacaaatatccaggttgcgattaaccaggtgcgccggctcatcgggaatgagaactacctggattatatgacctccatgaagagatttaaaaatgaaagcgaccccgagggcgctctgtggtga

SEQ ID NO: 18968 - RNA, 9879 nt, synthetic construct
  misc_feature 1..9879: note = derived and/or modified CDS sequence (opt5) from DENV-1__FJ410266__SS-prME
  source 1..9879: mol_type = other RNA
agcgtgaccatgctgctcatgctgatgcccaccgcccttgctttccacctgacgaccagaggcggggaacctcatatgatcgtcaccaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaagcccctaccagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtccaagaaaatgctcatgacagggaccctggctgttttccttctgctcattatgggacagctgacatggaacgatctgatccgcctttgcattatggtgggcgccaatgcctctgaccggatgggcatggggaccacctatctggctctcatcgccacatttaagatgagacctatgttcgcggtcggactgctctttcgcagactgacgagccgggaggtgcttctgctcaccatcggcctgtccctggtggcttctgtcgaacttcccaacagcctggaggaactcggggatggactggccatgggcattatgatcctcaaactgcttacagacttccaatcccaccagctgtgggccaccctcctgagctttacattcattaagaccacgctgtctcttcattacgcttggaagacaatggccatggttctgtccatcgtgagcctctttcccctgtgtctctctaccacctcccagaaaacaacctggctgcctgtgcttctggggagcctgggatgcaagccgctcacaatgttcctgattgctgagaataaaatctggggccgcaagtcttggccccttaacgaaggcatcatggccgtcggggtggtttccattctgctcagctccctgctcaaaaacgatgtgcctctggcgggaccccttatcgccggcgggatgctgattgcttgttatgtcatcagcggatctagcgccgacctgtccctcgagaaggctgccgaggtgtcttgggaagaggaagccgagcacagcggcgcttcccataatattctggttgaagtgcaggatgacgggacgatgaaaatcaaggatgaggagagagacgatacccttacaatcctgctcaaggcgaccctgctcgccgtctctggagtgtaccctctgagcattcccgctacactttttgtctggcacttctggcagaagaagaaacagcggtccggcgtgctgtgggacaccccttctcccccggaagttgagcgcgccgtgctggatgacggcatctatagaattatgcagcgggggctcctgggacgcagccaggtcggcgtgggggttttccaagaaaacgtgtttcacacgatgtggcatgtcaccagaggagccgtgcttatgtaccagggcaagcggctggagccttcctgggctagcgtgaaaaaggacctcatctcttatgggggaggctggcgcctgcagggctcctggaatacaggggaggaagttcaggtcattgccgtggagcccggaaagaaccctaaaaatgtgcaaaccgcgcccggcacattcaagaccccggaaggggaggtcggagctatcgccctcgattttaaacctggcacaagcgggtctcccattgtgaacagagaaggaaagatcgttggcctgtacggcaatggggtggtcacgacctccggaacatacgtgagcgccatcgctcaggccaaagcgtcccaggagggccctcttcccgagattgaagacgaggttttccggaagagaaacctgaccatcatggatctgcaccccgggtctggaaagacccgccggtatctccctgctattgtgagagaagccatcaaacgcaagctgcggacacttattctggccccgacgagagtcgtggctagcgagatggccgaagctctcaaaggcatgcccatccgctaccaaaccacagccgttaagtccgagcataccgggaaagagatcgtggacctgatgtgccacgcgacatttaccatgcggctgctcagccctgtcagagtgcccaattataacatgattatcatggatgaagcccatttcacggacccttcttccattgctgcccgcggctacatcagcacacgggtgggaatgggcgaggctgccgccatttttatgaccgctacaccccctgggtctgtcgaagcgttcccgcagagcaatgccgttatccaggatgaggaaagagacatccccgagcggtcctggaactctggatatgagtggattacagattttcctggcaagaccgtgtggttcgtgcccagcatcaagtccgggaatgacattgctaactgtcttcgcaaaaatggaaagagagtcatccagctgtctcggaaaacatttgataccgaataccaaaagacgaaaaacaacgactgggactatgtggttacaaccgatattagcgagatgggcgccaatttccgcgccgacagagtgatcgatcctcggagatgcctgaagcccgtcattctcaaggacgggccggaacgcgtgatcctggctggccctatgcccgttacagtggcctccgcggctcagcggagaggacgcatcggccggaaccacaataaagagggggatcagtacatttacatgggacagccccttaacaatgacgaggatcacgcccattggaccgaagccaagatgctgctcgacaacatcaatacgcctgagggcattatccccgctctgttcgaacctgagagagaaaagagcgccgcgattgatggggagtatcgcctgcggggagaggccagaaagacctttgtcgagctcatgcgcagaggcgaccttccggtgtggctgtcttacaaagtcgcttccgaggggttccaatatagcgatcggcgctggtgctttgacggcgaaagaaacaatcaggtgctggaggaaaacatggatgttgagatctggacaaaggagggagaacggaaaaagctccgccccagatggctggacgcccggacctactccgaccctcttgctctgagagagttcaaggaatttgccgctggccgccggtctgtgagcggggatctcatcctggagattggaaaactgccccagcacctcacacagagagcccaaaatgcgcttgacaacctggtgatgctgcataattccgaacagggcgggcgcgcctatcggcacgctatggaggagctccctgataccatcgaaacactgatgcttctggccctcattgctgtcctgaccggaggcgttacgctgttctttctctctggcagagggcttggaaagacaagcatcggcctgctgtgtgtgatggcctccagcgtgctcctgtggatggcctctgtcgagccccactggattgctgcgtccatcatccttgagttctttctgatggtgctcctgattccggagcctgaccggcagcgcacaccccaggataaccaactggcctacgttgtgatcgggctccttttcatgattctgaccgtcgctgccaatgagatgggactgctcgaaacaaccaaaaaggacctgggcatcgggcatgtggccgtcgagaaccaccatcacgctacaatgcttgatgtggacctgcatcctgccagcgcgtggacgctctatgccgttgctaccacaattatcacccccatgatgagacacacaattgaaaacaccacggccaatatctctctgaccgctatcgccaaccaggcggccattctgatgggactcgataaaggctggcctatctccaagatggacattggcgtgccccttctggctctggggtgctacagccaggtcaatccgctcacactgaccgccgctgtgcttatgctggttgcccactacgctatcattggacctggcctccaagccaaggcgacacgggaggcccagaaacgcaccgctgccgggatcatgaagaaccccacggtggatggaatcgtcgctattgacctggatcccgtggtgtatgacgccaaatttgaaaagcagctgggccagatcatgctccttattctgtgtacatctcaaatcctgctcatgagaaccacatgggccctgtgcgagagcattacccttgcgaccgggcctctgacaacgctctgggagggatccccgggcaaattctggaataccacaatcgctgtttctatggccaacatctttcggggcagctacctggctggggccggactggccttctccctcatgaaaagccttggcgggggacgcagaggcaccggggctcagggagaaacactgggcgagaagtggaaacggcagctgaatcagctctccaagtctgagttcaacacctataaacgcagcggcattatggaggtcgacagatccgaagccaaggaggggctgaaacggggagagacgacaagacatgcggtgtctcgcggcaccgccaaacttcggtggtttgtggaaagaaatctggtcaagcccgaggggaaagttatcgatctcggatgtggccgcgggggatggagctactattgcgctggcctgaagaaagtgaccgaagtgaagggctacacaaaagggggacctggccacgaggaacccattcctatggccacctatgggtggaacctggtcaagctccattccggaaaagacgtgttctttacaccccctgagaagtgtgatacgcttctgtgcgacatcggcgagtctagcccgaatcccaccattgaagaggggcggacactgagagttctcaagatggtggaaccttggctgcgcggaaaccaattctgtatcaaaattcttaatccctacatgccttccgtcgtggagaccctggagcagatgcagcggaagcacggcggcatgctcgttagaaaccccctgagccgcaattctacacacgaaatgtactgggtgtcctgcgggaccggaaacatcgtcagcgctgtgaatatgacgtctcggatgctgctcaacagatttaccatggcccatcgcaaaccgacatatgagcgggatgtggacctgggcgcggggaccagacacgtcgccgttgaacctgaggtggctaaccttgatatcattggacagcgcatcgaaaatattaagcatgagcacaaatccacatggcattacgacgaggataacccctataagacctgggcctaccacggcagctatgaagtgaagccctctgggtccgctagctccatggtcaatggagtggttaaactgctcacaaagccttgggacgtgatccccatggtcacccaaattgccatgacggatacaacccctttcggccagcagagagtgtttaaagagaaggttgacacccggacaccgaaagctaagcgcggcacggcccaaatcatggaagtgaccgcgaagtggctgtgggggttccttagcagaaacaaaaagccccggatctgtacaagagaggaatttacccggaaagtccgctctaatgccgctattggagccgtgttcgttgacgagaaccagtggaatagcgctaaggaggccgtggaagatgagagattttgggacctggtccagaaagaacgggagctccacaagcagggcaagtgcgccacatgcgtgtacaacatgatggggaaacgcgaaaagaaactgggagagttcggcaaggcgaaagggtccagagctatctggtatatgtggctgggcgcccggtttctcgagttcgaagccctgggattcatgaatgaggatcattggttttctcgcgaaaacagcctttccggcgtcgagggggagggactgcacaagctcggctacattctgagagacatctctaaaattcctgggggaaatatgtacgctgatgacaccgccggctgggatacacggatcaccgaagacgatcttcaaaacgaggctaagatcacggacattatggaacccgagcatgccctgctcgcgaccagcatcttcaagctgacatatcagaataaagtggttcgcgtgcagagacctgccaagaacgggaccgtcatggatgtgatttcccggcgcgaccagagaggctctggacaagtgggcacatacgggctgaatacctttacgaacatggaagctcagctcatccggcagatggagagcgagggaattttcctgcccggcgaacttgagacaccgaacctggccgaacgcgttctcgattggctggagaaatatggggtggaaagacttaagcggatggctatctccggagacgactgtgtcgtgaaacctatcgatgacagatttgccaccgcgctgacagccctcaatgatatgggcaaggttcgcaaggacattccccagtgggagcctagcaaagggtggaacgattggcaacaggtgcccttctgctctcaccactttcatcagctgatcatgaaggacggccgggagattgtcgtgccttgtagaaatcaggatgaactggtcggacgcgctcgggtgtcccaaggcgccgggtggagcctcagagagaccgcttgcctgggaaaatcttacgcccagatgtggcagcttatgtatttccaccgccgggacctgagactcgctgccaacgcgatctgttccgccgttcccgtggattgggtcccgacgagccgcaccacatggtccattcatgctcaccatcaatggatgaccacagaagacatgctgtctgtgtggaatcgggtttggatcgaggaaaacccttggatggaggataagacccacgtgagctcctggggcgacgtcccctaccttgggaaaagagaggaccagtggtgcggaagcctgattggcctcacagcccgcgccacctgggcttctaatatccaggtggccatcaaccaggtgcggagactgattgggaatgaaaactatctggattacatgacgtccatgaagcggtttaagaatgagggcgaccccgaaggagcgctctggtga

SEQ ID NO: 18969 - RNA, 9879 nt, synthetic construct
  misc_feature 1..9879: note = derived and/or modified CDS sequence (opt5) from DENV-1__FJ410269__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacccttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgttacccgcctcgaaaacattatgtggaaacagatctccaacgagctgaatcatattcttctggaaaacgacatgaagttcacggtggtcgtgggagatgtggtcggcatcctcgctcaggggaaaaagatgattcggccgcaacccatggagcacaaatactcttggaaaagctggggaaaggccaagatcatcggcgctgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacgcaggcctgcgaccaccggcttatgagcgctgcgatcaaagattctaaggccgtgcatgctgacatgggctattggatcgaatccgagaaaaatgaaacatggaagctcgccagagccagcttcattgaggtcaagacctgtatctggcccaaatctcacacactgtggtccaacggggtgctggaaagcgagatggttattccgaagatctacggaggccctatttctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcatccatgaatggtgttgccggtcctgtaccctgcctcccctgcgcttcaaaggggaggacggatgctggtacggcatggagattagaccggtgaaggaaaaggaggaaaatcttgtcaaaagcatggtgtctgccgggtccggagaggttgacagcttttccctcggcctgctgtgtatctctattatgatcgaagaggtgatgcggagcagatggtcccgcaagatgctcatgacggggacactggcggtcttccttctgctcattatgggacagctgacctggaacgatctgatccggctttgcattatggtgggcgctaatgcctctgacagaatgggcatggggacaacctatctggccctcatggctacctttaaaatgcgccctatgttcgccgtgggactgctctttagacggctgacaagccgcgaggtccttctgctcacgatcggcctgtccctggttgcgtctgtggaaatccccaacagccttgaggaactgggggatggactcgctatgggcattatgatcctgaagctcctgaccgacttccaatcccaccagctttgggccacactgctcagcctgacctttattaaaacaaccctgtctcttcattacgcctggaagacgatggctatggtgctgtccatcgtcagcctcttccccctgtgtctctctacaacctcccagaagaccacatggctgcctgtgcttctggggagcctgggatgcaaaccgctcaccatgtttctgattgccgagaataagatctggggcagaaaatcttggccccttaacgaaggcatcatggctgttggggtggtctccattctgctcagctccctgctcaagaacgatgtgcctctggccggaccccttatcgcgggcgggatgctgattgcctgttatgttatcagcggatctagcgctgacctgtccctcgagaaagccgctgaggtgtcttgggaagaggaagccgagcacagcggcgcctcccataatattctggtcgaagtgcaggatgacgggacaatgaagatcaaagatgaggagcgggacgatacgcttaccatcctgctcaaggctacactgctcgcggtctctggagtgtaccctctgagcattcccgccacccttttcgtttggtatttttggcaaaagaaaaagcagcgctccggcgtgctgtgggacacaccttctcccccggaagtcgagagagctgtgctggatgacggcatctaccggattatgcagcgcgggctcctgggaagaagccaggttggcgtgggggtcttccaagaaaacgtgttccacaccatgtggcacgtgacgcggggagccgttcttatgtatcagggcaaacgcctggagccttcctgggccagcgtcaagaaagacctcatctcttacgggggaggctggagactgcagggctcctggaataccggggaggaagtccaggtgattgctgtcgagcccggaaagaaccctaagaatgtgcaaacagcccccggcacctttaaaacaccggaaggggaggttggagcgatcgctctcgatttcaagcctggcaccagcgggtctcccattgtgaaccgggaaggaaaaatcgtcggcctgtacggcaatggggtggttacaacgtccggaacctatgtgagcgccatcgcccaggctaaggcctcccaggagggccctcttcccgagattgaagacgaggtctttagaaaacgcaacctgacaatcatggatctgcatcccgggtctggaaagacccggagatacctccctgcgattgtgcgcgaagctatcaagcggaaactgagaacccttattctggccccgacacgcgttgtggccagcgagatggctgaagccctcaagggcatgcccatccggtatcaaacgaccgctgtcaaatccgagcacacagggaaggagatcgtggacctgatgtgccatgccaccttcacaatgagactgctcagccctgtgcgcgtccccaattacaacatgattatcatggatgaagcgcactttaccgacccttcttccattgccgctcggggctatatcagcacgagagttggaatgggcgaggccgctgccattttcatgacagccacaccccctgggtctgtggaggcttttccgcagagcaatgcggtgatccaggatgaggaacgggacatccccgagcgctcctggaactctggatacgagtggattaccgatttccctggcaaaacagtctggtttgtgcccagcatcaagtccgggaatgacattgccaactgtcttagaaagaatggaaaacgggttatccagctgtctcgcaagaccttcgatacagaatatcagaagaccaagaacaacgactgggactacgtggtcacgacagatattagcgagatgggcgctaattttagagccgaccgggtgatcgatcctagacgctgcctgaaacccgttattctcaaggacgggccggaacgggtgatcctggccggccctatgcccgtcaccgtggcttccgccgcgcagagacgcggacggatcggcagaaaccataataaggagggggatcagtacatttatatgggacagccccttaacaatgacgaggatcacgctcactggacagaagccaaaatgctgctcgacaacatcaatacccctgagggcattatccccgccctgttcgaacctgagcgcgaaaagagcgctgccattgatggggagtaccggctgagaggagaggcgcgcaaaacgttcgtcgaactcatgagacggggcgaccttccggtgtggctgtcttataaggttgcctccgaggggtttcaatacagcgatcgcagatggtgcttcgacggcgaacggaacaatcaggtgctggaggaaaacatggatgtggagatctggaccaaagagggagaacgcaagaaactcagaccccggtggctggacgctagaacatattccgaccctcttgccctgcgcgagtttaaggagttcgctgccggccggagatctgtcagcggggatctcatcctggagattggaaagctgccccagcatctcacccagcgcgctcaaaatgcccttgacaacctggttatgctgcacaattccgaacagggcgggcgggcgtacagacatgccatggaggagctccctgatacaatcgaaaccctgatgcttctggctctcattgccgtgctgacaggaggcgtgaccctgtttttcctctctggccgggggcttggaaaaacgagcatcggcctgctgtgtgtcatggcttccagcgtgctcctgtggatggcctctgttgagccccactggattgccgcttccatcatccttgaatttttcctgatggtgctcctgattccggagcctgaccgccagagaacaccccaggataaccaactggcgtatgtcgtgatcgggctcctttttatgattctgaccgtcgccgctaatgagatgggactgctcgaaaccacaaagaaagacctgggcatcgggcacgtggccgttgagaaccatcaccatgccaccatgcttgatgtggacctgcaccctgctagcgcctggacactctacgcggtcgccacgaccattatcacacccatgatgcggcataccattgaaaacacaaccgctaatatctctctgacggccatcgctaaccaggccgcgattctgatgggactcgataagggctggcctatctccaaaatggacattggcgtgccccttctggccctggggtgctacagccaggttaatccgctcaccctgacagctgccgtgcttatgctggtcgctcactatgccatcattggacctggcctccaagctaaggccacccgcgaggcgcagaagagaacagccgctgggatcatgaaaaaccccaccgtggatggaatcgtggccattgacctggatcccgttgtctacgacgctaagttcgaaaaacagctgggccagatcatgctccttattctgtgtacgtctcaaatcctgctcatgcggacaacctgggccctgtgcgagagcattacacttgccaccgggcctctgaccacactctgggagggatccccgggcaagttttggaatacgaccatcgcggtgtctatggctaacatcttccgcggcagctatctggccggggctggactggccttttccctcatgaaaagccttggcgggggaagacggggcacaggggcccagggagaaaccctgggcgagaagtggaagcgccagctgaatcagctctccaaatctgagttcaacatttacaagagaagcggcatcatggaggtggaccggtccgaagctaaagaggggctgaagagaggagagacaacccgccacgccgtctctcggggcacggcgaaacttagatggttcgttgaacgcaatctggtgaagcccgaggggaaggtgattgatctcggatgtggcagagggggatggagctattactgcgccggcctgaaaaaggtcacagaagtgaaaggctataccaaagggggacctggccatgaggaacccatccctatggctacctacgggtggaacctggttaaactccactccggaaaggacgtgtttttcacaccccctgagaaatgtgatacccttctgtgcgacattggcgagtctagcccgaatcccacaatcgaagaggggagaacgctgcgcgtcctcaagatggtggaaccttggctgcggggaaaccaattttgtattaagatccttaatccctacatgccttccgttgtggagaccctggagcagatgcagagaaaacatggcggcatgctcgtccgcaaccccctgagcagaaattctacacacgaaatgtattgggtgtcctgcgggaccggaaacatcgtgagcgccgtcaatatgacatctagaatgctgctcaaccgcttcaccatggctcaccggaagccgacgtacgagagagatgttgacctgggcgccgggacccgccatgtggcggtggaacctgaggtcgccaaccttgatattatcggacagagaattgaaaatatcaaacacgagcataagtccacatggcactatgacgaggataacccctacaaaacctgggcttatcatggcagctacgaagtgaagccctctgggtccgccagctccatggttaatggagtggtcaagctgctcacaaaaccttgggacgtgattcccatggttacccaaatcgctatgacagataccacgccttttggccagcagcgggtgttcaaggagaaagtcgacacacgcaccccgaaggccaaaagaggcaccgctcaaatcatggaagtgacagcccggtggctgtgggggtttcttagcagaaacaagaagccccggatttgtacgcgcgaggagttcaccagaaaagttcggtctaatgcggccatcggagctgtgtttgtcgacgagaaccagtggaatagcgccaaggaggctgtggaagatgagcgcttctgggacctggtccagaaagaaagagagctccacaagcagggcaaatgcgccacatgcgtgtataacatgatggggaagcgggaaaagaaactgggagagtttggcaaggccaaagggtcccgcgcgatttggtacatgtggctgggcgctagattcctcgagtttgaagccctgggattcatgaatgaggatcactggttctctcgggaaaacagcctttccggcgttgagggggagggactgcataagctcggctacatcctgcgcgacatttctaaaatccctgggggaaatatgtatgccgatgacaccgctggctgggatacaagaatcaccgaagacgatcttcaaaacgaggccaagattacagacatcatggaacccgagcacgctctgctcgccaccagcatttttaaactgacgtaccagaataaggtggtccgggtgcagcgccctgcgaagaacgggaccgtgatggatgttatctccagacgggaccagcgcggctctggacaagtgggcacatatgggctgaataccttcacaaacatggaagcccagctcattagacagatggagagcgagggaatctttctgccctccgaacttgagaccccgaacctggctgaacgggtcctcgattggctggagaaacatggcgtggaaagacttaagcgcatggccatcagcggggacgactgtgttgtgaaacctattgatgaccggttcgctacggccctgacagcgctcaatgatatgggaaaggtcagaaaagacatcccccagtgggagccttctaagggctggaacgattggcaacaggtgcccttttgctcccaccacttccatcagctgattatgaaggacgggcgcgagatcgtcgtgccttgtcggaatcaggatgaactggttggcagagcccgcgtgagccaaggagctggctggtctctccgggagaccgcctgcctggggaaatcctacgctcagatgtggcagcttatgtattttcacagacgcgacctgcggctcgccgctaacgccatttgtagcgcggtccccgtggattgggttccgacatccagaaccacgtggtctatccatgcccaccatcaatggatgaccacagaagacatgctgagcgtgtggaatcgcgtctggattgaggaaaacccttggatggaggataagacccacgtgtccagctggggagacgtgccctaccttggcaaacgggaggaccagtggtgcgggtctctgatcggactcacagctagagccacctgggcctccaatatccaggttgctattaaccaggtccggagactgatcggcaatgaaaactatctggattacatgacaagcatgaagcgcttcaaaaatgagggggaccccgaaggcgccctctggtga

SEQ ID NO: 18970 - RNA, 9879 nt, synthetic construct
  misc_feature 1..9879: note = derived and/or modified CDS sequence (opt5) from DENV-1__FJ410273__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccggacaggcctcgacttcaacgaaatggtgctgcttaccatgaaggagaaaagctggctggtccataagcagtggtttctcgatctgcctcttccctggacgtccggggcttctacaagccaagagacctggaatcgccaggacctgctcgtgacattcaaaaccgcgcacgccaagaagcaggaagtcgtggttctgggatcccaagagggcgctatgcacaccgccctgacaggggccacggaaattcagaccagcggaacaaccacaatctttgctggccatctcaaatgcagactgaagatggataaacttaccctgaaggggatgtcttatgtgatgtgtacgggctccttcaaactcgagaaggaagtcgccgagacacagcacggaaccgtgctggttcagattaagtacgagggcaccgacgcgccgtgcaaaatccctttcagcacacaagatgaaaagggggtgacccagaacggacggctgatcacagctaatcccattgtcacggacaaagagaagcctgtgaacatcgaagccgagccgccctttggcgagtcttatattgtgatcggggccggagaaaaagctcttaagctcagctggttcaagaaaggctcctctattgggaagatgtttgttgccaccgctagaggcgcccgccggatggcgatcctgggagatacagcctgggacttcggcagcatcgggggagtctttacctccgtgggcaaactggtgcatcagattttcgggacagcttacggagtcctctttagcggcgtgtcttggaccatgaagatcgggattggcgttctgcttacgtggctgggactcaattccagaagcacctctctgtccatgacatgtatcgccgtgggcctggtcaccctttacctcggggtgatggttcaggctgatagcggatgcgtgattaactggaaaggccgcgagctgaagtgtgggtccggaatcttcgtcacaaatgaagtgcacacctggacagagcaatataagtttcaggccgactctcctaaacggctgagcgcggccattggcaaggcttgggaagagggggtttgcggcatcagatccgccacccgcctcgagaacatcatgtggaaacagatttctaacgaactgaatcatatccttctggagaacgacatgaagttcacggtggtcgtgggagatgtggctggcattctcacacaggggaaaaagatgatccggccgcaacccatggaatacaaatatagctggaagtcctggggaaaggccaaaattatcggcgccgacgtccagaataccacctttatcattgatgggcctaacacacccgagtgtcctgacgatcagagagcttggaatatctgggaagttgaggactacggattcggcatttttaccacgaacatctggctgaagctgcgcgatagctatacacaggtgtgcgaccaccggcttatgtctgcggccattaaagattccaaggctgtgcacgccgacatgggctactggatcgagagcgagaagaatgagacctggaagctcgccagagcttctttcatcgaagtcaagacatgtatttggcccaaatcccataccctgtggagcaacggggtgctggagtctgaaatgatcattccgaagatctatggaggccctattagccaacacaattaccgccccgggtacttcacacagaccgccggaccttggcatctcggcaaactggagcttgattttaacctgtgcgaggggacgaccgttgtggtcgacgaacactgcggaaatcggggcccctccctcagaacaaccacagtgaccggcaagatcatccacgagtggtgttgccggagctgtacgctgcctcccctgcgcttcaaaggggaagatggatgctggtatggcatggagattagaccggttaaggagaaggaagagaaccttgtgaaatctatggtctccgcggggagcggagaagtggactccttttctctcggcctgctgtgtatcagcattatgatcgaggaagttatgcggtccagatggtctcgcaagatgctcatgacagggaccctggctgtgttctttcttctgattatgggacagctcacatggaatgacctgatccggctgtgcattatggtcggcgccaacgccagcgatagaatgggcatggggaccacctaccttgctctgatggccacattcaaaatgcgccctatgctcgcggtgggactgctctttagacggctgacgtcccgcgaggtgcttctgctcaccatcggcctgtctctggtcgctagcgttgagcttcccaattccctggaagaactcggggacggactggccatgggcatcatgattctcaagctgcttacagatttccaaagccatcagctgtgggccaccctcctgtctctgacatttatcaaaaccacgtattcccttcactacgcttggaagacaatggccatggtgctgagcattgtgtctctcttccccctgtgtctctccaccaccagccagaagacaacctggctgcctgtccttctggggtctctgggatgcaaaccgctcacaatgtttctgatcgctgaaaacaagatttggggcagaaaatcctggccccttaacgagggcatcatggccgtggggatcgttagcattctgctctccagcctgctcaagaatgacgtgcctctggcgggaccccttatcgccggcgggatgctgattgcttgttatgtcatctctggaagctccgccgatctgtctctcgaaaaagctgccgaggtgagctgggaggaagaggccgaacattccggcgcttctcacaacattctggttgaggtgcaggacgatgggacgatgaagatcaaagacgaggaacgggatgacacccttacaatcctgctcaaggcgaccctgctcgccgtcagcggagtgtaccctctgtccattcccgctacacttttcgtctggtatttttggcaaaagaaaaagcagcgctctggcgtgctgtgggataccccttcccctcccgaggttgaaagagccgtgctggacgatggcatctaccggattatgcagcgcgggctcctgggaagatcccaggtcggcgtgggggttttccaagagaatgtgttccatacgatgtggcacgtcacccggggagccgtgcttatgtaccagggcaaacgcctggaacccagctgggcttctgtgaagaaagacctcatctcctatgggggaggctggagactgcagggcagctggaacacaggggaggaggttcaggtcattgccgtggaacccggaaagaatcctaagaacgtgcaaaccgcgcccggcacatttaaaacctctgagggggaagtcggagctatcgccctcgacttcaagccgggcacatccgggagccctattgtgaatcgggagggaaaaatcgttggcctgtacggcaacggggtggtcacgacctccggaacatatgtgtctgccatcgctcaggccaaggcgagccaggaaggcccccttcctgagattgagaatgaagtttttagaaaacgcaacctgaccatcatggatctgcaccccgggtccggaaagacccggagatacctccccgctattgtgcgcgaggccatcaagcggaaactgagaacacttattctggcccctacgcgcgtcgtggctagcgaaatggccgaggctctcaagggcatgccgatccggtatcaaaccacagccgttaaatctgaacataccgggaaggagatcgtggacctgatgtgccacgcgacattcaccatgagactgctctcccccgtccgcgtgcctaattacaacatgattatcatggatgaggcccattttacggaccccagctctattgctgcccggggctatatcagcacaagagtgggaatgggcgaagctgccgccattttcatgaccgctacccctcccgggtccgtcgaggcgtttcctcagtctaatgccgttatccaggatgaggaacgggacatcccggaacgcagctggaactccggatacgagtggattacagatttccccggcaaaaccgtgtggtttgtgccttctatcaagagcgggaatgacattgctaactgtcttagaaagaacggaaaacgggtcatccagctgtcccgcaagacattcgataccgagtaccagaaaacgaagaataacgactgggattatgtggttacaaccgacattagcgaaatgggcgccaattttagagccgaccgggtgatcgatcccagacgctgcctgaaacctgtcattctcaaggacgggcccgagcgggtgatcctggctggcccgatgcctgttacagtggcctctgcggctcagagacgcggacggatcggcagaaaccacaataaggaaggggatcagtacatttatatgggacagccccttaacaatgacgaggatcatgcccactggaccgaggccaaaatgctgctcgacaacatcaatacgcccgaaggcattatccctgctctgttcgagcccgaacgcgagaagtccgccgcgattgatggggaataccggctgagaggagaggcccgcaaaaccttcgtcgagctcatgagacggggcgaccttcctgtgtggctgagctataaggtcgcttccgaagggtttcaatactctgatcgcagatggtgcttcgacggcgagcggaacaatcaggtgctggaagagaacatggatgttgaaatctggacaaaagagggagagcgcaagaaactcagaccgcggtggctggacgccagaacctatagcgatccccttgctctgcgcgaatttaaggagttcgccgctggccggagatccgtgtctggggacctcatcctggaaattggaaagctgcctcagcacctcacacagcgcgcccaaaatgcgcttgacaacctggtgatgctgcataatagcgagcagggcgggcgggcctacagacacgctatggaggaactccccgataccatcgagacactgatgcttctggccctcattgctgtcctgaccggaggcgttacgctgtttttcctctccggccgggggcttggaaaaacaagcatcggcctgctgtgtgtgatggcctcttccgtgctcctgtggatggccagcgtcgaacctcattggattgctgcgtctatcatccttgagtttttcctgatggtgctcctgattcccgaaccggaccgccagagaacccctcaggataaccaactggcctacgttgtgatcgggctcctttttatgattctgaccgtcgctgccaacgagatgggactgctcgagacaaccaagaaagacctgggcatcgggcacgtggccgtcgaaaatcaccatcacgctgccatgcttgatgtggacctgcatcccgcgtccgcctggacactctatgctgttgccacgaccattatcacacctatgatgcggcacaccattgagaacacaaccgctaatatcagcctgacggccatcgcgaaccaggccgctattctgatgggactcgataagggctggcccatctctaaaatggacattggcgtgcctcttctggccctggggtgctacagccaggtcaatcccctcaccctgacagctgccgtgcttatgctggttgctcattatgccatcattggaccgggcctccaagcgaaggccacccgcgaagctcagaagagaacagccgctgggatcatgaaaaaccctaccgtggatggaatcgtcgccattgacctggatcccgtggtgtacgacgccaagttcgagaaacagctgggccagatcatgctccttattctgtgtacgtcccaaatcctgctcatgcggacaacctgggcgctgtgcgaatctattacacttgctaccgggcccctgaccacactctgggagggaagccctggcaagttttggaatacgaccatcgccgtttccatggctaacatcttccgcggcagctatctggccggggccggactggctttttccctcatgaaatctcttggcgggggaagacggggcacaggggcccagggagagaccctgggcgaaaagtggaagcgccagctgaatcagctcagcaaatccgagttcaacacatacaagagatctggcattatggaagtcgatcggagcgaggcgaaagaagggctgaagagaggagagaccacgaaacacgccgtgtcccgcggcacagctaaacttcggtggttcgtggagagaaatctggtcaagccggaagggaaagttatcgacctcggatgtggccgcgggggatggtcttattactgcgccggcctgaagaaagtgaccgaggtgaagggctacaccaaagggggacccggccacgaggagcctattcccatggctacatatgggtggaacctggtcaagctccatagcggaaaagacgtgtttttcatccctcccgaaaagtgtgatacccttctgtgcgacattggcgagtccagccctaatccgacaatcgaggaagggcggacgctgagagttctcaagatggtggagccctggctgcgcggaaaccaattttgtattaaaatccttaatccttacatgccctctgtcgtggaaaccctggagcagatgcagcggaagcacggcggcatgctcgttagaaaccctctgtcccgcaatagcacacatgagatgtattgggtgtcttgcgggaccggaaacatcgtctccgccgtgaacatgacaagccggatgctgctcaatagattcaccatggcgcaccgcaaacccacgtacgaacgggatgtggacctgggcgccgggaccagacacgtcgctgttgagccggaagtggccaaccttgatattatcggacagcgcattgagaatatcaagcatgaacacaaatctacatggcattatgacgaggataacccttacaagacctgggcttatcacggctcctacgaggtgaagcccagcgggtccgccagctctatggtcaatggagtggttaaactgctcacaaagccctgggacgtgattcctatggtcacccaaatcgctatgacagataccacgccctttggccagcagagagtgttcaaagaaaaggttgacacacggacccctaaagccaagcgcggcaccgcgcaaatcatggaggtgacagccaagtggctgtgggggtttcttagcagaaacaaaaagccgcggatttgtacgagagaagagttcacccggaaagtccgctccaatgctgccatcggagctgtgtttgttgatgaaaaccagtggaactctgccaaggaggccgtggaggacgaaagattctgggacctggtccatcgggagcgcgaactccacaaacagggcaagtgcgcgacatgcgtgtacaacatgatggggaagagagagaaaaagctgggagaatttggcaaagctaaggggagccgggccatttggtatatgtggctgggcgcccgcttcctcgagtttgaggctctgggattcatgaatgaagatcactggttctccagagagaactctcttagcggcgtcgaaggggagggactgcataaactcggctacatcctgcgggacatttccaagatccccgggggaaatatgtatgccgatgacaccgctggctgggatacacgcatcaccgaggacgatcttcagaacgaagccaaaattacagacatcatggagcctgaacacgcgctgctcgccaagtctatttttaagctgacctaccaaaataaagtggttagagtgcagcggcccgctaagaacgggacggtcatggatgtgatcagccgcagagaccagcggggctccggacaggtgggcacctatgggctgaacacattcaccaatatggaggcccaactcattcgccagatggaaagcgagggaatcttttctccttccgagctggaaacacccaaccttgctggcagagttctggattggctcgagaaacatggggtggaacggctgaagagaatggccatcagcggagacgattgtgtcgtgaaaccgattgacgaccgcttcgcgaccgcccttacggctctgaatgatatgggcaaggttcggaaggacatccctcagtgggagccctctaaagggtggaacgattggcagcaagtgcctttttgctcccaccacttccatcagctcattatgaaggacggcagagaaatcgtcgtgccctgtcgcaatcaggatgagctggtcggacgggccagagtgagccagggcgctgggtggtccctgcgcgagacagcctgcctcggaaaatcttacgctcaaatgtggcagctgatgtattttcaccggagagaccttcgcctggccgcgaacgccatttgtagcgctgttcctgtggattgggtccccacctcccggacaacctggagcatccatgcccaccatcagtggatgacgaccgaagacatgctctctgtgtggaatagagtttggattgaggaaaacccgtggatggaggataagacacacatctccagctggggcgacgtgccttacctggggaaacgcgaagatcaatggtgcggatctcttatcggcctgaccgcccgggctacatgggccaccaatattcaggtcgcgatcaaccaggtgagacggctcattgggaatgagaactacctggactatatgacaagcatgaagagattcaagaatgagtccgaccccgaaggcgctctgtggtga

SEQ ID NO: 18971 - RNA, 9879 nt, synthetic construct
  misc_feature 1..9879: note = derived and/or modified CDS sequence (opt5) from DENV-1__FJ410276__SS-prME
  source 1..9879: mol_type = other RNA
tccgtgaccatgttcctgatgctcatgcccaccgccctggcttttcaccttacgaccagaggcggggaacctcatatgatcgtgtccaagcaggaacggggaaaatctctcctgttcaagacaagcgccggcgttaacatgtgcaccctgattgcgatggaccttggggaactgtgtgaagatacaatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtcacacctagcatggccatgagatgcgtgggcattgggtcccgggatttcgttgagggacttagcggcgctacgtgggtggacgtcgtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatcccttttctgacacaagatgaaaagggggttacgcagaacggacggcttatcaccgcgaatcccattgtgacagacaaagagaagcctgtcaacatcgaagctgagccgcccttcggcgagtcctatattgtgatcggggccggagaaaaagccctcaagctgagctggtttaagaaaggctctagcattgggaagatgttcgaggctaccgccagaggcgctcgccggatggccatcctgggagatacagcgtgggactttggctccatcgggggagtgttcacctctgttggcaaactcgtccatcagatttttgggacggcctacggagtgctgttcagcggcgtgtcctggaccatgaagatcgggattggcgtccttctgacatggctcggactgaatagcagatctacctccctgagcatgacatgtatcgctgtgggccttgttaccctctacctgggggtgatggtccaggccgattctggatgcgtgattaactggaaaggccgcgaactgaagtgtgggtccggaatctttgttacaaatgaggtgcacacctggacggaacaatataagttccaggctgacagccctaaacggctctccgccgcgattggcaaggcctgggaggagggggtctgcggcatcagatctgctacacgcctggaaaacatcatgtggaaacagattagcaacgagcttaatcatatcctgctcgaaaacgacatgaagtttaccgtggttgtgggagatgtcgccggcattctggctcaggggaaaaagatgatccggccgcaacccatggagtacaaatattcctggaagtcttggggaaaggccaaaattatcggcgccgacgtgcagaataccacattcatcattgatgggcctaacacccccgaatgtcctgacgatcagagagcttggaatatctgggaggtggaggactacggatttggcattttcacgacaaacatctggctgaaacttcgcgatagctatacccaggtctgcgaccaccggctcatgtccgcggccattaaagatagcaaggctgttcacgccgacatgggctactggatcgaatctgagaaaaatgaaacatggaagctggccagagcttccttcatcgaggtgaagacctgtatttggcccaaaagccatacactgtggtctaacggggtgctcgaatccgagatgatcattccgaagatctatggaggccctattagccaacacaattaccgccccgggtactttacccagacggccggaccttggcatctgggcaaacttgagctggatttcgacctctgcgaagggaccacagtcgtggttgatgagcactgcggaaaccggggcccctctctgagaaccacaaccgtgacgggcaagatcatccacgaatggtgttgccggagctgtacactgcctccccttcgctttagaggggaggacggatgctggtatggcatggagattcggccggtcaaagaaaaggaggaaaatctcgtgaagtccatggttagcgcggggtctggagaggtggactccttcagcctgggcctgctctgtatctccattatgatcgaagaggtcatgagatctcgctggagccggaaaatgctgatgaccgggacacttgctgtgtttttcctgctcattatgggacagctgacctggaacgatctgatcagactttgcattatggttggcgccaatgcctccgaccgcatgggcatggggaccacatacctggctctcatggccacgtttaagatgagacctatgttcgcggtgggactgctctttcggcgcctgacctctagagaggtccttctgctcacaatcggcctgagcctggtggcttccgtggaacttcccaactctctggaggaactcggggatggactggccatgggcatcatgattctcaaactgcttaccgacttccaaagccatcagctgtgggccacactcctgtccctgacctttatcaagacgacattcagccttcactatgcttggaaaaccatggccatggtcctgtctattgtttccctctttcccctgtgtctcagcaccacatctcagaagaccacatggctgcctgtgcttctggggtccctgggatgcaagccgctcacgatgttcctgatcgctgagaataaaatttggggccggcgcagctggccccttaacgaaggcatcatggccgtggggatcgtctctattctgctctccagcctgctcaagaacgatgtgcctctggcgggaccccttatcgccggcgggatgctgattgcttgttacgttatctccggaagctctgccgacctgagcctcgagaaagctgccgaggtgtcctgggaagaggaagccgagcattctggcgctagccacaatattctggtcgaagtgcaggatgacgggaccatgaagatcaaagatgaggagagagacgatacacttaccatcctgctcaaggcgacactgctcgccgtttccggagtgtatcctctgtctattcccgctacccttttcgtctggtacttttggcagaagaagaagcagcggagcggcgtgctgtgggacacgcctagccctcccgaagtcgagcgcgccgtgctggatgacggcatctatagaattatgcagcgggggctcctgggacgctctcaggttggcgtgggggtcttccaagaaaacgtgtttcataccatgtggcacgttacaagaggagccgtgcttatgtaccagggcaaacggctggagcccagctgggcttccgtcaagaaagacctcatcagctacgggggaggctggagactgcagggctcttggaataccggggaggaagtccaggtgattgccgttgagcccggaaagaaccctaaaaatgtccaaacagcgcccggcaccttcaagacaccggaaggggaggtgggagctatcgccctcgattttaagcctggcacgtccgggagccccattgtgaaccgcgaaggaaaaatcgtcggcctgtatggcaatggggtggttaccacatctggaacctacgtgtccgccatcgctcaggcccgggcgagccaggagggccctcttcccgagattgaagacgaggtcttcagaaagcgcaacctgaccatcatggatctgcaccccgggtccggaaaaacacggagatatctccctgctattgtgcgcgaagccatcaagcggaaactgagaacgcttattctggccccgacccgcgttgtggcttctgagatggccgaagctctcaagggcatgcccatccggtaccaaacaaccgccgtcaagagcgagcatacagggaaagagatcgtggacctgatgtgccacgcgacctttacgatgagactgctctcccctgttcgggtgcccaattataacatgattatcatggatgaagcccatttcacagaccctagctctattgctgcccgcggctacatctccaccagagtcggaatgggcgaggctgccgccatttttatgaccgctacaccccctgggagcgtggaagcgttcccgcagtctaatgccgtgatccaggatgaggaacgggacatccccgagcgcagctggaactccggatatgagtggattaccgattttcctggcaagacagtctggttcgttccctctatcaaaagcgggaatgacattgctaactgtcttagaaagaatggaaaacgggtgatccagctgtccagaaagaccttcgatacggaataccaaaagaccaagaataacgactgggactacgtggtcaccacagatatttctgagatgggcgccaattttcgcgccgaccgggtgatcgatcctagacgctgcctgaagcccgttattctcaaagacgggccggaacgggtgatcctggctggccctatgcccgtcaccgtggccagcgcggctcagagacgcggacggatcggcagaaaccacaataaggagggggatcagtatatttacatgggacagccccttaacaatgacgaggatcatgcccactggacggaagccaaaatgctgctcgacaacatcaatacccctgagggcattatccccgctctgttcgaacctgagcgcgaaaagtccgccgcgattgatggggagtatagactgcggggagaggcccgcaagacatttgttgaactcatgagacggggcgaccttccggtgtggctgagctacaaagtcgcttctgaggggttccaatattccgatcgcagatggtgctttgacggcgaacggaacaatcaggtgctggaggaaaacatggatgtcgagatctggaccaaggagggagaacgcaaaaagctccgcccccggtggctggacgccagaacatacagcgaccctcttgctctgcgcgagttcaaagaatttgccgctggccggagatccgtgtctggggatctcatcctggagattggaaagctgccccagcacctcacccagcgggcccaaaatgcgcttgacaacctggttatgctgcataatagcgaacagggcgggcgcgcctatagacacgctatggaggagctccctgatacaatcgaaaccctgatgcttctggccctcattgctgtgctgacgggaggcgtgacactgttctttctctccggccgggggcttggaaaaacctctatcggcctgctgtgtgtcatggccagctccgttctcctgtggatggccagcgtggagccccattggattgctgcgtctatcatccttgagttctttctgatggtgctcctgattccggagcctgaccgccagagaacaccccaggataaccaactggcctacgtcgtgatcgggctccttttcatgattctgacagttgctgccaatgagatgggactgctcgaaaccacaaagaaggacctgggcatcgggcacgtggccgtcgagaaccaccatcacgctgccatgcttgatgtggacctgcatcctgcgtccgcctggacgctctacgctgtcgccaccacaattatcacccccatgatgcggcacacaattgaaaacaccacggctaatatcagcctgaccgccatcgcgaaccaggccgctattctgatgggactcgataaaggctggcctatctctaagatggacattggcgtgccccttctggccctggggtgctattcccaggttaatccgctcacactgaccgctgccgtgcttatgctggtcgctcattacgccatcattggacctggcctccaagcgaaagccacacgcgaggctcagaagagaaccgccgctgggatcatgaaaaaccccacggtggatggaatcgttgccattgacctggatcccgtggtctatgacgccaagtttgaaaagcagctgggccagatcatgctccttattctgtgtacaagccaaatcctgctcatgcggaccacatgggcgctgtgcgagtctattacccttgctaccgggcctctgacaacgctctgggagggaagcccgggcaaattctggaataccacaatcgccgtgtccatggctaacatcttccgcggctcttacctggccggggccggactggcttttagcctcatgaagtcccttggcgggggaagacggggcaccggggcccagggagaaacactgggcgagaaatggaagagacagctgaatcagctcagcaaatccgagttcaacacctataagcgctctggcattatggaggtggaccggagcgaagcgaaggaggggctgaaaagaggagagacgacaaagcacgccgtttcccgcggcaccgctaaacttcggtggtttgtcgaaagaaatctggtgaagcccgaggggaaagtgatcgatctcggatgtggccgcgggggatggtcttactattgcgccggcctgaagaaggtcaccgaagttaaaggctacacaaaagggggacctggccacgaggaacccattcctatggctacctacgggtggaacctggtgaaactccatagcggaaaggacgtgttctttattccccctgagaaatgtgatacacttctgtgcgacatcggcgagtcctctccgaatcccacgatcgaagaggggcggaccctgagagtcctcaagatggtggaaccttggctgcgcggaaaccaattctgtattaaaatccttaatccctatatgcctagcgttgtggagacactggagcagatgcagcggaagcacggcggcatgctcgtcagaaaccccctgtcccgcaatagcacccatgaaatgtactgggtgtcttgcgggacaggaaacatcgtttccgccgtgaatatgaccagccggatgctgctcaacagatttacgatggcgcaccgcaagccgacctatgagagagatgtcgacctgggcgccgggacacggcacgtggctgtggaacctgaggtcgccaaccttgatattatcggacagcgcattgaaaatatcaaacatgagcacaagtctacctggcattacgacgaggataacccctataaaacatgggcttaccacggctcctatgaagttaagcccagcgggtctgcctccagcatggtgaatggagtggtcaaactgctcaccaagccttgggacgtgattcccatggttacacaaatcgctatgaccgatacgacacctttcggccagcagagagtgtttaaggagaaagtcgacacccggaccccgaaggccaaaagaggcacagcgcaaatcatggaagtgacggccaagtggctgtgggggttcctttcccggaacaaaaagccccgcatttgtaccagagaggaatttacacggaaggttcgcagcaatgctgccatcggagctgtgttcgtcgacgagaaccagtggaactctgccaaagaggccgtggaagatgagagattttgggacctggttcatcgggaacgcgagctccacaagcagggcaaatgcgcgacctgcgtgtacaacatgatggggaagagagagaaaaagctgggagagttcggcaaggctaaagggagccgggccatttggtacatgtggctgggcgcccgcttcctcgagtttgaagctctgggattcatgaatgaggatcactggttttccagagaaaactctcttagcggcgtcgagggggagggactgcataagctcggctatatcctgcgggacatttccaaaatccctgggggaaatatgtacgccgatgacacagctggctgggatacccgcatcacagaagacgatcttcagaacgaggccagaattaccgacatcatggaacccgagcacgcgctgctcgccaagtctattttcaaactgacgtatcaaaataaggtggtccgggtgcagcgccctgctaaaaacgggaccgttatggatgtgatcagcagacgggaccagagaggctccggacaggtcggcacatacgggctgaatacctttacaaacatggaagcccaactcattcgccagatggagtctgagggaatcttcagcccctccgaactggagaccccgaaccttgctgaacgggtgctggattggctcgagaagtatggcgtggaaagactgaagcgcatggccatcagcggggacgactgtgttgtgaaacctattgatgaccggtttgcgacggcccttacagctctgaatgatatgggaaaggtcagaaaagacatcccccagtgggagccttctaagggctggaacgattggcagcaagtgcccttctgctcccatcactttcaccagctcattatgaaagacgggcgcgagatcgttgtgccttgtcggaatcaggatgaactggtcggcagagcccgcgtgagccagggagctggctggtctctgcgggagaccgcctgcctcgggaagtcctacgctcaaatgtggcagctgatgtatttccatagacgcgaccttcggctggccgcgaacgccatttgtagcgctgtccccgtggattggatcccgacatccagaaccacgtggtctattcacgcccatcaccagtggatgaccacagaagacatgctcagcgtttggaatcgggtgtggatcgaggaaaacccttggatggaggataagacccatatctccagctggggagacgtcccctacctgggcaaaagagaggaccaatggtgcgggtctcttattggactgacagcccgcgctacctgggccacaaatatccaggtggcgattaaccaggttcggagactcatcggcaatgaaaactacctggattatatgacctccatgaagcgctttaaaaatgagagcgaccccgaaggggctctgtggtga

SEQ ID NO: 18972 - RNA, 9879 nt, synthetic construct
  misc_feature 1..9879: note = derived and/or modified CDS sequence (opt5) from DENV-1__FJ410278__SS-prME
  source 1..9879: mol_type = other RNA
agcgtgaccatgctgctcatgctgatgcccaccgcccttgctttccacctgacgacccggggcggggaacctcatatgatcgtgtccaagcaggaacggggaaaatctctcctgtttaagaccagcgccggcgttaacatgtgcacccttattgcgatggacctgggggaactctgtgaagataccatgacctacaaatgcccccgcatcacagagaccgaacccgacgatgtggactgttggtgcaatgctacggatacctgggtgacatatggaacctgttcccaaacaggcgagcaccggcgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctgattaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccaggccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtcaagagcatggtttctgctgggtccggagaggtggacagcttttccctcggcctgctgtgtatttctatcatgattgaagaggtcatgagaagccgctggtcccggagaatgctcatgacagggaccctggccgtgttctttcttctgatcatgggacagctcacatggaacgatctgattcgcctgtgcatcatggttggcgccaatgcttctgacagaatgggcatggggaccacctaccttgccctgatggcgacattcaaaatgcggcctatgtttgctgtgggactcctgttccgcagactcacgagccgggaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagcgggacgataccctgacaattcttctgaaagccaccctcctggctgtttctggagtgtatcctctcagcatccccgccacactgttcgtctggtacttctggcaacgcaagaaacagagatccggcgtgctttgggacaccccttctcccccggaagtcgagcgggccgtgctggatgacggcatttatcgcatcatgcagagagggctgctcggacggagccaggttggcgtgggggtctttcaagaaaacgtgttccatacgatgtggcacgttaccagaggagctgtgctgatgtaccagggcaagcgccttgagccttcctgggccagcgtcaagaaagacctgatttcttacgggggaggctggcggctccagggctcctggaatacaggggaggaagtccaggtgatcgcggttgagcccggaaagaaccctaaaaatgtccaaaccgctcccggcacatttaagaccccggaaggggaggtgggagccattgccctggatttcaaacctggcacaagcgggtctcccatcgtgaacagagaaggaaagatcgtcggcctctatggcaatggggtggttacgacctccggaacatacgtgagcgctattgcccaggcgaaggcttcccaggagggccctctgcccgagatcgaagacgaggtctttcgcaaacggaaccttaccattatggatctgcaccccgggtctggaaagaccagacgctatctgcctgccatcgtgcgggaagccattaaaagaaagctccgcacactgatccttgctccgacgcgggttgtggccagcgagatggctgaagccctgaaaggcatgcccatcagataccaaaccacagcggtcaagtccgagcataccgggaaggagattgtggacctcatgtgccacgccacattcaccatgcggctgctgagccctgttcgcgtgcccaattataacatgatcattatggatgaagctcattttacggacccttcttccatcgccgctagaggctacattagcacacgggtcggaatgggcgaggccgccgctatcttcatgaccgcgacaccccctgggtctgtggaagcctttccgcagagcaatgctgtgatccaggatgaggaacgcgacattcccgagagatcctggaactctggatatgagtggatcacagatttccctggcaaaaccgtctggtttgttcccagcattaagtccgggaatgacatcgccaactgtctccggaaaaatggaaagagagtgattcagctttctcgcaaaacattcgataccgaataccaaaagacgaagaacaacgactgggactacgtggtcacaaccgatatcagcgagatgggcgccaatttccgggctgacagagtgattgatcctcgccggtgcctgaaacccgttatcctgaaggacgggccggaaagagtgatcctcgccggccctatgcccgtcacagtggcgtccgctgcccagcgccggggaagaattggccgcaaccacaataaagagggggatcagtatatctacatgggacagcccctgaacaatgacgaggatcatgcccactggaccgaagctaagatgcttctggacaacattaatacgcctgagggcatcattcccgccctctttgaacctgagagagaaaagagcgcggccatcgatggggagtatcggctgcgcggagaggctagaaagaccttcgttgagctgatgcggcgcggcgacctcccggtgtggctttcttacaaggtcgcctccgaggggtttcaatatagcgatagacggtggtgcttcgacggcgaaagaaacaatcaggtgctggaggaaaacatggatgtcgagatctggacaaaagagggagaacgcaagaaactgcggcccagatggctcgacgctcgcacctactccgaccctctggcccttcgggagtttaaggagttcgctgccggcagacggtctgtgagcggggatctgattctcgagatcggaaaactgccccagcacctgacacagcgcgcgcaaaatgccctcgacaaccttgttatgctgcataattccgaacagggcgggagagcttatcggcacgccatggaggagctgcctgataccattgaaacactcatgctgcttgctctgatcgccgtgctcaccggaggcgtgacgctgtttttcctgtctggccgcgggctcggaaagacaagcattggccttctgtgtgtcatggcctccagcgttctgctctggatggcttctgtggagccccattggatcgcggcctccatcattctggaatttttccttatggtgctgctcatcccggagcctgacagacagcggacaccccaggataaccaactggcttacgtcgtgattgggctgctctttatgatccttaccgttgccgccaatgagatgggactgctggaaacaaccaaaaaggacctcggcattgggcacgtggctgtcgagaaccaccatcacgccgcgatgctggatgtggaccttcatcctgccagcgcttggacactgtacgccgtcgctacgaccatcattacacccatgatgcgccacaccatcgaaaacacaaccgccaatatctctctcacggcgattgccaaccaggctgccatcctgatgggactggataagggctggcctatttccaaaatggacatcggcgtgcccctccttgctctggggtgctatagccaggttaatccgctgaccctcacagccgctgtgctgatgcttgtcgcccattacgcgattatcggacctggcctgcaagccaaggctaccagagaggcccagaaacggacagctgccgggatcatgaagaaccccaccgtggatggaattgttgccatcgacctcgatcccgtggtctatgacgcgaaattcgaaaagcagctgggccagattatgctgctcatcctttgtacgtctcaaattctgctgatgcgcacaacctgggctctctgcgagagcatcacactggccaccgggcctcttaccacactgtgggagggatccccgggcaagttttggaatacgaccatcgctgtgtctatggccaacattttcagaggcagctacctcgccggggctggactggccttctccctgatgaaaagcctcggcgggggacggagaggcacaggggcgcagggagaaacccttggcgagaagtggaaacgccagctgaatcagctgtccaagtctgaatttaacacatataaacggagcggcatcatggaggtggacagatccgaagccaaggaggggctcaagcgcggagagaccacgaaacacgctgtttctcggggcacagccaagctgagatggttcgtcgaacgcaatcttgtgaaacccgaggggaaggtgattgatctgggatgtggcagagggggatggagctactattgcgctggcctcaaaaaggtcaccgaagttaagggctacaccaaagggggacctggccacgaggaacccatccctatggccacatacgggtggaacctggtgaagctgcattccggaaaagacgtgtttttcattccccctgagaagtgtgataccctcctttgcgacatcggcgagtctagcccgaatcccacaattgaagaggggagaacgctgcgcgtcctgaaaatggtggaaccttggctccggggaaaccaattttgtatcaagatcctgaatccctatatgccttccgttgtggagacccttgagcagatgcagagaaaacacggcggcatgctggtccgcaaccccctcagcagaaattctacacatgaaatgtactgggtgtcctgcgggaccggaaacattgttagcgcggtgaatatgacatctagaatgctgctgaaccgcttcaccatggcccacagaaagccgacgtatgagcgggatgtcgacctcggcgctgggacccgccacgtggccgtggaacctgaggtcgctaacctggatatcattggacagagaatcgaaaatattaagcatgagcacaaatccacatggcattacgacgaggataacccctataagacctgggcctaccacggcagctatgaagttaaaccctctgggtccgctagctccatggtgaatggagtggtcaaacttctgacaaaaccttgggacgtgatccccatggttacccaaatcgccatgacagataccacgccttttggccagcagcgggtgttcaaggagaaggtcgacacaagaaccccgaaagcgaagcggggcaccgcccaaattatggaagtgacagctaaatggctctgggggtttctgagccgcaacaagaaacccagaatctgtacgcgggaggagttcacccgcaaggttagatctaatgccgctattggagccgtgtttgtcgacgagaaccagtggaatagcgccaaggaggcggtggaagatgagcggttctgggaccttgttcatcgcgaaagagagctgcacaaacagggcaagtgcgctacatgcgtgtacaacatgatggggaaacgggaaaagaaactcggagagtttggcaaggccaaggggtcccgcgccatctggtacatgtggctgggcgctagattcctggagttcgaagccctcggatttatgaatgaggatcactggttctctcgggaaaacagcctgtccggcgtcgagggggagggacttcataaactgggctatattctccgcgacatctctaagatccctgggggaaatatgtacgctgatgacaccgccggctgggatacaagaattaccgaagacgatctgcagaacgaggcgcggatcacagacattatggaacccgagcacgcccttctggctaaaagcatctttaagctcacctatcaaaataaagtggtccgcgtgcagagacctgccaagaacgggacggttatggatgtgatttcccggagagaccagcgcggctctggacaggtcggcacctacgggctgaatacattcaccaacatggaagctcaactgatccggcagatggagagcgagggaatcttttcccccagcgaactcgagacaccgaacctggccgaaagagtgcttgattggctggagaaatatggcgtggaacgcctcaagcggatggcgatttctggggacgactgtgttgtgaagcctatcgatgacagattcgccaccgctctgacggcccttaatgatatgggaaaagtccgcaaggacattccccagtgggagccttccaaaggctggaacgattggcagcaagtgcccttttgcagccatcacttccaccagctgatcatgaaggacgggcgggagattgttgtgccttgtagaaatcaggatgaactcgtcggccgcgctcgggtgtctcagggagccggctggtccctgagagagacagcttgcctggggaaaagctacgcccaaatgtggcagctcatgtattttcatcgccgggacctgagacttgcggccaacgctatctgttccgccgtccccgtggattggattccgacctctcggacaacctggagcatccacgcccatcaccagtggatgacgaccgaagacatgctgtccgtttggaatagagtgtggatcgaggaaaacccttggatggaggataagacacatattagctcttggggagacgtcccctacctcggcaagcgcgaggaccaatggtgcgggtccctgatcggacttaccgctcgggccacatgggcgaccaatattcaggtggctatcaaccaggttagacgcctgattggcaatgaaaactacctcgattatatgacaagcatgaaaagattcaagaatgagtctgaccccgaaggggccctgtggtga

SEQ ID NO: 18973 - RNA, 9879 nt, synthetic construct
  misc_feature 1..9879: note = derived and/or modified CDS sequence (opt5) from DENV-1__FJ410279__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagtttacggttgtggtcggagatgtggctggcattctggcccaggggaaaaagatgatccggccgcaacccatggagtacaaatatagctggaagtcctggggaaaggccaaaattatcggcgctgacgtgcagaatacaaccttcatcattgatgggcctaacacccccgaatgtcctgacgatcagagagcgtggaatatctgggaggtcgaggactacggatttggcattttcacaaccaacatctggctcaagctgcgcgatagctatacgcaggtttgcgaccaccggctgatgtctgccgctattaaagattccaaggccgtgcacgccgacatgggctactggatcgaaagcgagaaaaatgaaacatggaaacttgctagagcctctttcatcgaggtgaagacctgtatttggcccaaatcccatacactctggagcaacggggtcctggaatctgagatgatcattccgaagatctatggaggccctattagccaacacaattaccgccccgggtactttacccagacagcgggaccttggcatctgggcaaactcgagctggatttcgacctttgcgaagggaccacggtggttgtggatgagcactgcggaaaccggggcccctccctgagaaccacaaccgtcacaggcaagatcatccacgaatggtgttgccggagctgtaccctccctcccctgcgctttaaaggggaggacggatgctggtatggcatggagattagaccggtgaaggaaaaggaggaaaatctggttaaatctatggtgtccgctgggagcggagaggtcgactccttctctcttggcctcctgtgtatcagcattatgatcgaagaggtgatgcggtccagatggtctcgcaagatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaaaatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaagctgctcaccgacttccaaagccatcagctgtgggctacacttctgtctctcacctttatcaaaacaaccttctccctgcactatgcctggaagacgatggctatggttctgagcattgtgtctctttttcccctgtgtctctccacaaccagccagaagaccacatggctgcctgtgctcctggggtctcttggatgcaaaccgctgaccatgttcctgatcgccgagaataagatttggggcagaaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggacaatgaagatcaaagatgaggagcgggacgatacgctcaccatcctgcttaaggccacactgctcgctgtgagcggagtctatcctctgtccattcccgccaccctcttcctgtggtacttttggcaaaagaaaaagcagcgctctggcgtgctttgggacacaccttcccctcccgaagtcgagagagccgtgctggatgacggcatctatcggattatgcagcgcgggctgctcggaagatcccaggttggcgtgggggtcttccaagaaaacgtgtttcataccatgtggcacgttacgcggggagctgtgctgatgtaccagggcaaacgccttgagcccagctgggcctctgtcaagaaagacctgatctcctacgggggaggctggagactccagggcagctggaataccggggaggaagtccaggtgattgcggttgagcccggaaagaaccctaagaatgtccaaacagctcccggcaccttcaaaacatctgaaggggaggtgggagccatcgccctggattttaagccgggcacctccgggagccctattgtgaaccgggaaggaaaaatcgtcggcctctatggcaatggggtggttacaacgtccggaacctacgtgtctgctatcgcccaggcgaaggctagccaggagggccccctgcctgagattgaagacgaggtcttcagaaaacgcaaccttacaatcatggatctgcaccccgggtccggaaagacccggagatatctgcccgccattgtgcgcgaagccatcaagcggaaactcagaaccctgattcttgctcctacacgcgttgtggccagcgagatggctgaagccctgaagggcatgccgatccggtaccaaacgaccgcggtcaaatctgagcatacagggaaggagatcgtggacctcatgtgccacgccacctttacaatgagactgctgtcccccgttcgcgtgcctaattataacatgattatcatggatgaagctcatttcaccgaccccagctctattgccgctcggggctacatcagcacgagagtcggaatgggcgaggccgccgctatttttatgacagcgacccctcccgggtccgtggaagccttccctcagtctaatgctgtgatccaggatgaggaacgggacatcccggagcgcagctggaactccggatatgagtggattaccgattttcccggcaaaacagtctggttcgttccttctatcaagagcgggaatgacattgccaactgtctcagaaagaatggaaaacgggtgatccagctttcccgcaagaccttcgatacagaataccagaagaccaagaacaacgactgggactacgtggtcacgacagatattagcgagatgggcgccaattttagagctgaccgggtgatcgatcccagacgctgcctgaaacctgttattctgaaggacgggcccgaacgggtgatcctcgccggcccgatgcctgtcaccgtggcgtctgctgcccagagacgcggacggatcggcagaaaccacaataaggagggggatcagtatatttacatgggacagcccctgaacaatgacgaggatcatgcccactggacagaagctaaaatgcttctggacaacatcaatacccccgagggcattatccctgccctcttcgaacccgagcgcgaaaagtccgcggccattgatggggagtatcggctgagaggagaggctcgcaaaacgtttgttgaactgatgagacggggcgacctccctgtgtggcttagctacaaggtcgcctccgaggggttccaatattctgatcgcagatggtgctttgacggcgaacggaacaatcaggtgctggaggaaaacatggatgtcgagatctggaccaaagagggagaacgcaagaaactgagaccgcggtggctcgacgctagagtgtacagcgaccccctggcccttcgcgagttcaaggaatttgctgccggccggagatccgtttctggggatctgatcctcgagattggaaagctgcctcagcacctgacacagcgcgcgcaaaatgccctcgacaaccttgtgatgctgcataatagcgaacagggcgggcgggcttatagacacgccatggaggagctgcccgataccatcgaaacactcatgctgcttgctctgattgccgtgctcaccggaggcgtcacactgttctttctgtccggccgggggctcggaaaaaccagcatcggccttctgtgtgttatggcctcttccgtgctgctctggatggctagcgtggagcctcattggattgcggcctctatcatcctggagttctttcttatggtcctgctcattcccgagccggaccgccagagaacgcctcaggataaccaactggcttacgtggttatcgggctgctgttcatgattcttacagtggccgccaatgagatgggactgctggaaaccaccaagaaagacctcggcatcgggcacgtcgctgtggagaaccaccatcacgccgcgatgctggatgtcgaccttcatcccgcctccgcttggacactgtacgccgtggctaccacaattatcacgcctatgatgcggcacaccattgaaaacacaaccgccaatatcagcctcacagcgatcgccaaccaggctgccattctgatgggactggataagggctggcccatctctaaaatggacattggcgttcctctccttgctctggggtgctatagccaggtgaatcccctgaccctcacggccgctgtcctgatgcttgtggcccattacgcgatcattggaccgggcctgcaagccaaggctacccgcgaggcccagaagagaacagctgccgggatcatgaaaaaccctaccgttgatggaatcgtggccattgacctcgatcccgtcgtgtatgacgcgaagtttgaaaaacagctgggccagatcatgctgctcattctttgtacatcccaaatcctgctgatgcggaccacgtgggctctctgcgagtctattacactggccaccgggccccttacaaccctgtgggagggaagccctggcaagttctggaataccacaatcgctgtgtccatggccaacatcttccgcggcagctacctcgccggggctggactggccttttccctgatgaaatctctcggcgggggaagacggggcacgggggcgcagggagaaacccttggcgagaagtggaagcgccagctgaatcagctgagcaaatccgagttcaacacatataagagatctggcattatggaggttgaccggagcgaagccaaagaggggctcaagagaggagagaccacaaaacacgctgtctcccgcggcaccgccaagctgcggtggtttgtggaaagaaatcttgtgaagccggaggggaaagtcatcgatctgggatgtggccgcgggggatggtcttactattgcgctggcctcaagaaagttacggaagtgaagggctacacaaaagggggacccggccacgaggaacctattcccatggccacctacgggtggaacctggtgaagctgcatagcggaaaagacgtcttctttatccctcccgagaagtgtgataccctcctttgcgacattggcgagtccagccctaatccgacaatcgaagaggggcggaccctgagagtgctgaagatggttgaaccctggctccgcggaaaccaattctgtattaaaatcctgaatccttatatgccctctgtggtcgagacacttgagcagatgcagcggaagcacggcggcatgctggtgagaaaccctctctcccgcaatagcacgcatgaaatgtactgggtttcttgcgggaccggaaacatcgtgtccgcggtcaatatgacaagccggatgctgctgaacagatttaccatggcccaccgcaaacccacatatgagcgggatgtggacctcggcgctgggaccagacacgtggccgtcgaaccggaggttgctaacctggatattatcggacagcgcattgaaaatatcaagcatgagcacaaatctacgtggcattacgacgaggataacccttataagacctgggcctaccacggctcctatgaagtgaagcccagcgggtccgctagctctatggtgaatggagtcgtgaaacttctgacaaagccctgggacgttattcctatggtgacccaaatcgccatgacagataccacacccttcggccagcagagagtctttaaagagaaggtggacacccggacgcctaaagcgaagcgcggcacagcccaaatcatggaagttaccgctaagtggctctgggggttcctgagcagaaacaaaaagccgcggatttgtaccagagaggaatttacacggaaagtgcgctccaatgccgctatcggagccgtcttcgtggacgagaaccagtggaactctgccaaggaggcggttgaagatgagagattttgggaccttgtgcatcgggaacgcgagctgcacaaacagggcaagtgcgctacgtgcgtctacaacatgatggggaagagagagaagaagctcggagagttcggcaaagccaaggggagccgggccatttggtacatgtggctgggcgctcgcttcctggagtttgaagccctcggattcatgaatgaggatcactggttttccagagaaaactctctgagcggcgtggagggggagggacttcataaactgggctatatcctccgggacatttccaagatccccgggggaaatatgtacgctgatgacaccgccggctgggatacacgcatcaccgaagacgatctgcagaacgaggcgaaaattacagacatcatggaacctgagcacgcccttctggctaagtctattttcaagctcacctatcaaaataaagtcgtgagagttcagcggcccgccaagaacgggacagtgatggatgtcatcagccgcagagaccagcggggctccggacaggtgggcacctacgggctgaatacgtttaccaacatggaagctcaactgattcgccagatggagagcgagggaatcttctctccttccgaactcgagacacccaacctggccggcagagtgcttgattggctggaaaaacatggggttgagcggctcaagagaatggcgatcagcggagacgactgtgtggtcaaaccgattgatgaccgctttgccaccgctctgacagcccttaatgatatgggcaaggtgcggaaggacatccctcagtgggaaccctctaaagggtggaacgattggcagcaagttcctttctgctcccaccactttcatcagctgattatgaaggacggcagagagatcgtggtcccctgtcgcaatcaggatgagctcgtgggacgggctagagtcagccagggcgccgggtggtccctgcgcgaaaccgcttgcctgggaaaatcttatgcccaaatgtggcagctcatgtacttccaccggagagacctgcgccttgcggccaacgctatttgtagcgccgtgcctgttgattgggtgcccacgtcccggacaacctggagcatccatgcccaccatcagtggatgacaaccgaggacatgctgtctgtctggaatagagtgtggattgaagagaacccgtggatggaagataagacgcacatctccagctggggcgacgttccttatctcgggaaacgcgaggaccaatggtgcggatctctgatcggccttaccgctcgggccacatgggcgaccaatattcaggtggctatcaaccaggtcagacggctgattgggaatgagaactacctcgattacatgacaagcatgaagagatttaagaatgaatccgaccccgagggcgccctgtggtga

SEQ ID NO: 18974 - RNA, 9879 nt, synthetic construct
  misc_feature 1..9879: note = derived and/or modified CDS sequence (opt5) from DENV-1__FJ410283__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgccggcaaactcgttcatcagattttcgggacggcttacggagtcctgttttccggcgtgagctggaccatgaagatcgggattggcgtgcttctgacatggctcggactcaattctagatccaccagcctgtctatgacatgtatcgccgtcggccttgtgaccctctacctgggggttatggtgcaggctgattccggatgcgtcattaactggaaaggccgcgaactgaagtgtgggagcggaatcttcgtgacaaatgaggttcacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgtcgtggttggagatgtggctggcattctggcccaggggaaaaagatgatccggccgcaacccatggagtacaaatattcttggaaaagctggggaaaggccaagattatcggcgctgacgtccagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctaaggccgtccacgccgacatgggctactggatcgaatccgagaaaaatgaaacatggaagctggctagagccagcttcatcgaggttaagacctgtatttggcccaaatctcatacactgtggtccaacggggtgctcgaaagcgagatgatcattccgaagatctatggaggccctatttctcaacacaattaccgccccgggtacttcacccagacggcgggaccttggcatctgggcaaacttgagctggattttgacctctgcgaagggaccacagtggtcgtggatgagcactgcggaaaccggggccccagcctgagaaccacaaccgttacgggcaagatcatccacgaatggtgttgccggtcctgtacactgcctccccttcgcttcagaggggaggacggatgctggtatggcatggagattcggccggtgaaagaaaaggaggaaaatctcgtcaagagcatggtgtctgctgggtccggagaggttgacagcttttccctgggcctgctctgtatctctattatgatcgaagaggtgatgagaagccgctggtcccggaaaatgctgatgaccgggacacttgccgtcttctttctgctcattatgggacagctgacctggaacgatctgatcagactttgcattatggtgggcgccaatgcttctgaccgcatgggcatggggaccacatacctggccctcatggcgacgttcaagatgagacctatgtttgctgttggactgctgttccggcgcctgaccagcagagaggtgcttctgctcacaatcggcctgtccctggtcgcctctgtggaacttcccaacagcctggaggaactcggggatggactggccatgggcatcatgattctcaaactgcttaccgactttcaatcccatcagctgtgggctacactcctgagcctgaccttcatcaagacgacattttctcttcactatgcctggaaaaccatggctatggtgctgtccattgtcagcctcttccccctgtgtctctctaccacatcccagaagaccacatggctgcctgttcttctggggagcctgggatgcaagccgctcacgatgtttctgatcgccgagaataaaatttggggccggcgctcttggccccttaacgaaggcatcatggcggtggggatcgtgtccattctgctcagctccctgctcaagaacgatgtccctctggccggaccccttatcgctggcgggatgctgattgcctgttacgtgatcagcggatctagcgctgacctgtccctcgagaaagccgccgaggtttcttgggaagaggaagctgagcatagcggcgcgtcccacaatattctggtggaagtccaggatgacgggaccatgaagatcaaagatgaggagagagacgatacacttaccatcctgctcaaggccacactgctcgctgtgtctggagtttatcctctgagcattcccgccacccttttcgtgtggtacttctggcagaagaagaagcagcggtccggcgtcctgtgggacacgccttctcccccggaagtggagcgcgccgtcctggatgacggcatctatagaattatgcagcgggggctcctgggacgcagccaggtgggcgttggggtgtttcaagaaaacgtcttccataccatgtggcacgtgacaagaggagctgttcttatgtaccagggcaaacggctggagccttcctgggccagcgtgaagaaagacctcatctcttacgggggaggctggagactgcagggctcctggaataccggggaggaagtccaggtgattgcggtggagcccggaaagaaccctaaaaatgttcaaacagctcccggcacctttaagacaccggaaggggaggtcggagccatcgccctcgatttcaagcctggcacgagcgggtctcccattgtgaaccgcgaaggaaaaatcgtgggcctgtatggcaatggggtcgtgaccacatccggaacctacgttagcgctatcgcccaggcgaaggcttcccaggagggccctcttcccgagattgaagacgaggtgtttcggaaaagaaacctgaccatcatggatctgcaccccgggtctggaaagacacgccggtatctccctgccattgtcagagaagccatcaaacgcaagctgcggacgcttattctggctccgaccagagtggttgccagcgagatggctgaagccctcaagggcatgcccatccgctaccaaacaaccgcggtgaaatccgagcatacagggaaggagatcgtcgacctgatgtgccacgccaccttcacgatgcggctgctcagccctgtgagagttcccaattataacatgattatcatggatgaagctcattttacagacccttcttccattgccgctcggggctacatcagcacccgcgtgggaatgggcgaggccgccgctattttcatgaccgcgacaccccctgggtctgtcgaagcctttccgcagagcaatgctgtgatccaggatgaggaaagagacatccccgagcggtcctggaactctggatatgagtggattaccgatttccctggcaaaacagtgtggtttgtccccagcatcaagtccgggaatgacattgccaactgtcttcgcaaaaatggaaagagagttatccagctgtctcggaagaccttcgatacggaataccagaagaccaagaacaacgactgggactacgtggtgaccacagatattagcgagatgggcgccaatttcagagctgaccgcgtcatcgatcctcggagatgcctgaaacccgtgattctcaaggacgggccggaacgcgttatcctggccggccctatgcccgtgaccgtcgcgtccgctgcccagcggagaggacgcatcggccggaaccacaataaagagggggatcagtatatttacatgggacagccccttaacaatgacgaggatcatgcccactggacggaagctaagatgctgctcgacaacatcaatacccctgagggcattatccccgccctgtttgaacctgagagagaaaagagcgcggccattgatggggagtatcgcctgagaggagaggctcggaaaacattcgtggaactcatgcgcagaggcgaccttccggtttggctgtcttacaaggtggcctccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgctcggacatactccgaccctcttgccctgagagagtttaaggagttcgctgccggccgccggtctgtcagcggggatctcatcctggagattggaaaactgccccagcacctcacccagagagcgcaaaatgcccttgacaacctggtgatgctgcataattccgaacagggcgggcgggcttatcgccacgccatggaggagctccctgatacaatcgaaaccctgatgcttctggctctcattgccgttctgacgggaggcgtgacactgtttttcctctctggcagagggcttggaaagaccagcatcggcctgctgtgtgtgatggcctccagcgtcctcctgtggatggcttctgttgagccccattggattgcggcctccatcatccttgaatttttcctgatggtgctcctgattccggagcctgaccggcagcgcacaccccaggataaccaactggcttacgtggtcatcgggctcctttttatgattctgacagtggccgccaatgagatgggactgctcgaaaccacaaagaaagacctgggcatcgggcacgttgctgtggagaaccaccatcacgccgcgatgcttgatgtcgacctgcatcctgccagcgcttggacgctctacgccgtggctaccacaattatcacccccatgatgagacacacaattgaaaacaccacggccaatatctctctgaccgcgatcgccaaccaggctgccattctgatgggactcgataagggctggcctatctccaaaatggacattggcgtcccccttctggctctggggtgctatagccaggtgaatccgctcacactgaccgccgctgttcttatgctggtggcccattacgcgatcattggacctggcctccaagccaaggctacacgggaggcccagaaacgcaccgctgccgggatcatgaagaaccccacggtcgatggaatcgtggccattgacctggatcccgttgtgtatgacgcgaagttcgaaaaacagctgggccagatcatgctccttattctgtgtacatctcaaatcctgctcatgagaaccacatgggctctgtgcgagagcattacccttgccaccgggcctctgacaacgctctgggagggatccccgggcaagttttggaataccacaatcgctgtctctatggccaacatcttccggggcagctacctggccggggctggactggccttctccctcatgaaaagccttggcgggggacgcagaggcaccggggcgcagggagaaacactgggcgagaagtggaaacggcagctgaatcagctctccaagtctgaatttaacacctataagagaagcggcattatggaggtggaccgctccgaagccaaagaggggctgaagcggggagagacgacaaaacacgctgtgtctagaggcaccgccaaacttcgctggttcgttgaacggaatctggtcaaacccgaggggaaggtgatcgatctcggatgtggcagagggggatggagctactattgcgctggcctgaagaaagtgaccgaagtcaagggctacacaaaagggggacctggccacgaggaacccattcctatggccacctacgggtggaacctggttaagctccattccggaaaagacgtgtttttcattccccctgagaagtgtgatacacttctgtgcgacatcggcgagtctagcccgaatcccacgatcgaagaggggcgcaccctgcgggtgctcaaaatggtcgaaccttggctgagaggaaaccaattttgtattaagatccttaatccctatatgccttccgtggttgagacactggagcagatgcagcgcaagcacggcggcatgctcgtgcggaaccccctgagcagaaattctacccatgaaatgtactgggtctcctgcgggacaggaaacatcgtgagcgcggttaatatgacctctcgcatgctgctcaaccggttcacgatggcccacagaaaaccgacctatgagcgcgatgtggacctgggcgctgggacaagacacgtcgccgtggaacctgaggtggctaaccttgatattatcggacagcggattgaaaatatcaagcatgagcacaaatccacctggcattacgacgaggataacccctataagacatgggcctaccacggcagctatgaagtcaaaccctctgggtccgctagctccatggttaatggagtggtgaagctgctcaccaagccttgggacgtcattcccatggtgacacaaatcgccatgaccgatacgacaccttttggccagcagcgcgttttcaaagagaaggtggacaccagaaccccgaaagcgaagcggggcacagcccaaatcatggaagtcacggctaaatggctgtgggggtttcttagcagaaacaagaagccccggatttgtacccgcgaggagttcacaagaaaagtgcggtctaatgccgctatcggagccgtttttgtggacgagaaccagtggaatagcgccaaggaggcggtcgaagatgagcgcttctgggacctggtgcatagagaacgggagctccacaaacagggcaagtgcgctacctgcgtttacaacatgatggggaaacgcgaaaagaagctgggagagtttggcaaagccaaggggtccagagccatttggtacatgtggctgggcgctcggttcctcgagttcgaagccctgggatttatgaatgaggatcactggttctctcgcgaaaacagcctttccggcgtggagggggagggactgcataaactcggctatatcctgagagacatttctaagatccctgggggaaatatgtacgctgatgacacagccggctgggatacccggatcacagaagacgatcttcagaacgaggcgcgcattaccgacatcatggaacccgagcacgccctgctcgctaaaagcatttttaagctgacgtatcaaaataaagtcgtgagagtccagcggcctgccaagaacgggaccgtgatggatgttatctcccgcagagaccagcggggctctggacaggtgggcacatacgggctgaataccttcacaaacatggaagctcaactcattagacagatggagagcgagggaatcttttcccccagcgaactggagaccccgaaccttgccgaacgcgtcctggattggctcggcaagtatggggtggagcggctgaaaagaatggcgatctctggagacgactgtgtggttaagcctattgatgaccgcttcgccacggctcttacagccctgaatgatatgggcaaagtgcggaaggacatcccccagtgggaaccttccaaagggtggaacgattggcagcaagtccccttttgcagccatcacttccaccagctcattatgaaggacggcagagagatcgtggttccttgtcgcaatcaggatgagctggtgggacgggctagagtctctcagggcgccgggtggtccctgcgcgaaaccgcttgcctcggaaagagctacgcccaaatgtggcagctgatgtattttcatcggagagaccttcgcctggcggccaacgctatttgttccgccgtgcccgtcgattggatcccgacatctcggaccacgtggagcattcacgcccatcaccagtggatgaccacagaggacatgctctccgtgtggaatagagtttggatcgaagagaacccttggatggaagataaaacccatatcagctcttggggcgacgtgccctacctggggaagcgggaggaccaatggtgcggatcccttattggcctgacagctagagccacctgggcgacaaatatccaggtcgctattaaccaggtgcgccggctcatcgggaatgagaactacctggattatatgaccagcatgaaaagattcaagaatgaatctgaccccgagggcgccctgtggtga

SEQ ID NO: 18975 - RNA, 9879 nt, synthetic construct
  misc_feature 1..9879: note = derived and/or modified CDS sequence (opt5) from DENV-1__FJ410284__SS-prME
  source 1..9879: mol_type = other RNA
agcgtgaccatgctgctcatgctgatgcccaccgcccttgctttccacctgacgaccagaggcggggaacctcatatgatcgtcaccaagcaggaacggggaaaatccctcctgtttaagacctctgccggcgttaacatgtgcacacttattgccatggacctgggggaactctgtgaagataccatgacctacaaatgcccccgcatcaccgaagctgaacccgacgatgtggactgttggtgcaatgccacggatacctgggtgacatatggaacctgtagccaaacaggcgaacacagacgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaagcccctaccagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgtccagaatacaacctttattatcgatgggcctaacacccccgaatgtcctgacgatcagagagcctggaatatttgggaggttgaggactatggattcggcatctttacaaccaacatttggctgaagctgcgcgattcctacacgcaggcttgcgaccaccggcttatgagcgcggccatcaaagattctaaggctgtgcatgccgacatgggctattggatcgaatccgagaaaaatgaaacatggaagctcgccagagctagcttcattgaggtgaagacctgtatctggcccaaatctcacacactgtggtccaacggggtcctggaaagcgagatggtgattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttatgtgattagcggatctagcgccgacctctccctggagaaagctgccgaggtttcttgggaagaggaagccgagcacagcggcgcttcccataatatccttgtggaagtccaggatgacgggacaatgaagattaaagatgaggagaaggacgatacgctgaccatcctcctgaaggcgacactcctggccgtgtctggagtctaccctcttagcatccccgctaccctgttcgtgtggtatttttggcagaagaagaaacagcggtccggcgttctgtgggacacaccttctcccccggaagtggagcgcgccgtcctcgatgacggcatttacagaatcatgcagcgggggctgcttggacgcagccaggtgggcgttggggtgttccaagaaaacgtcttccacaccatgtggcacgtgacgagaggagccgtgctgatgtatcagggcaagcggctcgagccttcctgggctagcgttaaaaaggacctgatttcttacgggggaggctggcgcctccagggctcctggaataccggggaggaagtccaggtgatcgccgtggagcccggaaagaaccctaaaaatgtccaaacagcgcccggcacctttaagacaccggaaggggaggtgggagctattgccctggatttcaaacctggcaccagcgggtctcccatcgttaacagagaaggaaagattgtgggcctttacggcaatggggtcgtgacaacgtccggaacctatgttagcgccatcgctcaggccaaagcgtcccaggagggccctctgcccgagatcgaagacgaggtgtttcggaagagaaacctgacaattatggatctccatcccgggtctggaaagacccgccggtacctgcctgctatcgtcagagaagccaccaaacgcaaacttcggacactgattctcgccccgacgagagtggttgctagcgagatggccgaagctctgaaaggcatgcccatccgctatcaaaccacagccgtgaagtccgagcacaccgggaaagagattgtcgacctgatgtgccatgcgacattcaccatgcggctccttagccctgtgagagtgcccaattacaacatgatcatcatggatgaagcccactttacggacccttcttccattgctgcccgcggctatatcagcacacgggtcggaatgggcgaggctgccgccattttcatgaccgctacaccccctgggtctgttgaagcgtttccgcagagcaatgccgtgatccaggatgaggaaagagacattcccgagcggtcctggaactctggatacgagtggatcacagatttccctggcaagaccgtgtggtttgtccccagcatcaagtccgggaatgacattgctaactgtctgcgcaaaaatggaaagagagtgatccagctgtctcggaaaacattcgataccgaatatcaaaagacgaaaaacaacgactgggactacgttgtgacaaccgatattagcgagatgggcgccaattttcgcgccgacagagtcatcgatcctcggagatgcctcaagcccgtgattctgaaggacgggccggaacgcgttatccttgctggccctatgcccgtgacagtcgcctccgcggctcagcggagaggacgcattggccggaaccataataaagagggggatcagtacatctatatgggacagcccctgaacaatgacgaggatcacgcccactggaccgaagccaagatgctcctggacaacatcaatacgcctgagggcattatccccgctctgttcgaacctgagagagaaaagagcgccgcgattgatggggagtaccgcctccggggagaggccagaaagaccttcgtggagcttatgcgcagaggcgacctgccggtctggctgtcttataaagtggcttccgaggggtttcaatacagcgatcggcgctggtgcttcgacggcgaaagaaacaatcaggttctcgaggaaaacatggatgtggagatctggacaaaggagggagaacggaaaaagctgcgccccagatggcttgacgcccggacctattccgaccctctggctctcagagagtttaaggagttcgccgctggccgccggtctgtgagcggggatctgattctggagatcggaaaactcccccagcatcttacacagagagcccaaaatgcgctggacaacctggtcatgctccacaattccgaacagggcgggcgcgcctaccggcatgctatggaggagctgcctgataccatcgaaacacttatgctgctcgccctgattgctgttctgaccggaggcgtgacgctctttttcctttctggcagagggctgggaaagacaagcatcggcctgctctgtgtgatggcctccagcgtcctgctttggatggcctctgtggagccccactggattgctgcgtccatcattctggaatttttcctcatggttctgctgatcccggagcctgaccggcagcgcacaccccaggataaccaactcgcctatgtggtcatcgggcttctgtttatgattctgaccgtggctgccaatgagatgggactcctggaaacaaccaaaaaggaccttggcatcgggcacgtcgccgtggagaaccatcaccatgctacaatgctggatgttgacctccaccctgccagcgcgtggacgctgtacgccgtggctaccacaattatcacccccatgatgagacatacaattgaaaacaccacggccaatatctctctgaccgctattgccaaccaggcggccatcctcatgggacttgataaaggctggcctatctccaagatggacattggcgtccccctgctggctctcgggtgctacagccaggtgaatccgctgacacttaccgccgctgttctgatgctcgtggcccactatgctatcattggacctggcctgcaagccaaggcgacacgggaggcccagaaacgcaccgctgccgggatcatgaagaaccccacggtcgatggaattgtggctatcgacctggatcccgtggtttacgacgccaaattcgaaaagcagctcggccagatcatgcttctgattctgtgtacatctcaaatcctcctgatgagaaccacatgggccctttgcgagagcattaccctggcgaccgggcctctcacaacgctgtgggagggatccccgggcaaattttggaataccacaatcgctgtctctatggccaacattttccggggcagctatctggctggggccggactcgccttttcccttatgaaaagcctgggcgggggacgcagaggcaccggggctcagggagaaacactgggcgagaagtggaaacggcagctcaatcagctgtccaagtctgagttcaacatctacaaacgcagcggcatcatggaggtggacagatccgaagccaaggaggggcttaaacggggagagaccacgagacacgcggtgtctcgcggcacagccaagctgcggtggttcgtcgaaagaaatctcgttaagcccgaggggaaagtgattgatctgggatgtggccgcgggggatggagctattactgcgctggcctgaagaaagtgaccgaagtcaagggctataccaaagggggacctggccatgaggaacccatccctatggccacatacgggtggaacctcgtgaaacttcactccggaaaagacgtctttttcacaccccctgagaagtgtgatacactgctgtgcgacattggcgagtctagcccgaatcccacgatcgaagaggggcggaccctcagagtgctgaagatggtcgaaccttggcttcgcggaaaccaattttgtattaaaatcctgaatccctacatgccttccgtggttgagacactcgagcagatgcagcggaagcatggcggcatgctggtgagaaaccccctgagccgcaattctacccacgaaatgtattgggtctcctgcgggacaggaaacattgtgagcgctgtgaatatgacctctcggatgctcctgaacagattcacgatggcccaccgcaaaccgacctacgagcgggatgtcgaccttggcgcggggacaagacatgttgccgtggaacctgaggtggctaacctggatatcatcggacagcgcattgaaaatatcaagcacgagcataaatccacctggcactatgacgaggataacccctacaagacatgggcctatcatggcagctacgaagtcaagccctctgggtccgctagctccatggtgaatggagttgtgaaactcctgaccaagccttgggacgtcattcccatggtgacacaaatcgccatgaccgatacgacaccttttggccagcagagagttttcaaagagaaggtggacacccggaccccgaaagctaagcgcggcacagcccaaattatggaagtcacggcgagatggctttgggggtttctgagccggaacaagaaacccagaatctgtacccgggaggagttcacacgcaaggtgagatctaatgccgctatcggagccgtttttgtggacgagaaccagtggaatagcgctaaagaggccgtcgaagatgagcggttctgggacctcgtgcagaaggaacgcgagctgcacaaacagggcaagtgcgcgacctgcgtctataacatgatggggaagagagagaagaagctgggagagtttggcaaagcgaaggggtcccgggctatttggtacatgtggctcggcgcccgcttcctggagtttgaagcccttggattcatgaatgaggatcactggttctctagagaaaacagcctgtccggcgtggagggggagggactccataaactgggctacatccttcgggacatttctaagatccctgggggaaatatgtatgctgatgacacagccggctgggatacccgcattacagaagacgatctgcaaaacgaggctaaaatcaccgacatcatggaacccgagcacgccctcctggcgacgagcatttttaagctgacctaccagaataaggttgtgagagtccagcggcctgccaaaaacgggacagtgatggatgtgatctcccgcagagaccagcggggctctggacaagttggcacctatgggctcaatacattcaccaacatggaagctcagctgattcgccagatggagagcgagggaatctttcttccctccgaactggagacgccgaacctcgccgaaagagtgctggattggcttgagaagcatggcgtcgaacggctgaaaagaatggctattagcggggacgactgtgtggttaagcctatcgatgaccgcttcgccacagcgctcaccgccctgaatgatatgggaaaagtgcggaaggacatcccccagtgggagccttctaagggctggaacgattggcaacaggtccccttttgctcccaccacttccatcagctgattatgaaagacgggagagagatcgtggtcccttgtcgcaatcaggatgaactcgtgggccgggctagagttagccaaggagccggctggtctctgcgcgagacagcttgccttgggaagtcctacgcccagatgtggcagctgatgtattttcaccggagagacctccgcctggctgccaacgcgatttgtagcgccgtgcccgtcgattgggtgccgacctcccggacgacctggtctatccatgctcaccatcaatggatgacaaccgaagacatgcttagcgtttggaatagagtgtggattgaggaaaacccttggatggaggataaaacacacgtctccagctggggagacgtgccctacctgggcaagcgcgaggaccagtggtgcgggtctctcatcggactgaccgcccgggccacatgggcttccaatattcaggtggccatcaaccaggttagacggctgatcggcaatgaaaactatctcgattacatgaccagcatgaaaagattcaagaatgagggggaccccgaaggcgcgctgtggtga

SEQ ID NO: 18976 - RNA, 9879 nt, synthetic construct
  misc_feature 1..9879: note = derived and/or modified CDS sequence (opt5) from DENV-1__FJ410285__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaggacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagcacgaaaacctgaaatactccgtcatcgtgaccgttcatacaggcgaccagcaccaagtggggaatgagagcaccgaacatggaacaaccgctacgattacaccccaagcccctaccaccgagatccagctcacagactatggcgctctgtctctggattgtagcccccggaccggcctcgacttcaacgaaatggtcctgcttacgatgaaggagaaaagctggctggtgcacaagcagtggtttctcgatctgcctcttccctggacatccggggcctctaccagccaagagacatggaatcgccaggacctgctcgtcaccttcaaaaccgcccacgctaagaagcaggaagtggttgtgctgggatcccaagagggcgcgatgcatacagccctgacgggggctaccgaaattcagacaagcggaaccacaaccatctttgccggccacctcaaatgcagactgaagatggataaacttacgctgaaggggatgtcttacgtcatgtgtacaggctccttcaaactcgagaaggaagtggccgagacccagcatggaaccgttctggtgcagattaagtatgagggcacagacgctccgtgcaaaatccctttcagcacccaagatgaaaagggggtcacacagaacggacggctgatcacggccaatcccattgtgaccgacaaagagaagcctgtgaacatcgaagcggagccgccctttggcgagtcttacattatcattggggctggagaaaaagcccttaagctcagctggttcaagaaaggctcctctatcgggaagatgtttgaggccacagctagaggcgcccgccggatggctatcctgggagataccgcctgggacttcggcagcattgggggagtttttacatccgtcggcaaactggtgcaccagatcttcgggaccgcgtatggagtgctctttagcggcgtctcttggacgatgaagattgggatcggcgtgctgcttacctggctgggactcaattccagaagcacatctctgtccatgacctgtattgccgttggcctggtgacactttacctcggggtcatggtgcaggctgatagcggatgcgttatcaactggaaaggccgcgaactgaagtgtgggtccggaattttcgtgaccaatgaggtccatacatggaccgaacaatacaagtttcaggccgactctcctaaacggctgagcgctgccatcggcaaggcgtgggaggagggggtgtgcggcatcagatccgccacgcgcctcgaaaacattatgtggaaacagatctctaacgagctgaatcacattcttctggaaaacgacatgaagttcacagttgtggtcggagatgtggctggcatcctcgcccaggggaaaaagatgattcggccgcaacccatggagtataaatacagctggaagtcctggggaaaggctaaaatcatcggcgccgacgtgcagaataccacctttattatcgatgggcctaacacacccgaatgtcctgacgatcagagagcctggaatatttgggaggtcgaggactatggattcggcatctttaccacgaacatttggctgaagctgcgcgatagctacacacaggtttgcgaccaccggcttatgtctgctgcgatcaaagattccaaggccgtgcatgctgacatgggctattggatcgaaagcgagaaaaatgaaacctggaagctcgccagagcctctttcattgaggtgaagacatgtatctggcccaaatcccacaccctgtggagcaacggggtcctggaatctgagatgattatcccgaagatttacggaggccctatcagccaacataattatcgccccgggtacttcacacagaccgctggaccttggcacctcggcaaactggagcttgattttgacctgtgcgaagggacgaccgtggttgtggatgagcactgcggaaaccggggcccctccctcagaacaaccacagtcaccggcaagatcattcatgaatggtgttgccggagctgtacgctgcctcccctgcgcttcagaggggaggacggatgctggtacggcatggagatccggccggtgaaagaaaaggaggaaaatcttgttaagtctatggtgtccgccgggcctggagaggtcgacagcttttccctcggcctgctgtgtatttctatcatgattgaagaggtgatgagaagccgctggtcccggaaaatgctcatgacagggaccctggcggttttctttcttctgatcatgggacagctcacatggaacgatctgattagactgtgcatcatggtgggcgctaatgcctctgaccgcatgggcatggggaccacctatcttgccctgatggctacattcaagatgagacccatgtttgccgtcggactcctgttccggcgcctcacgagcagagaggtgctgcttctgaccatcggcctctccctggtggcgtctgtcgaactgcccaacagccttgaggaactgggggatggactcgctatgggcattatgatcctgaaactcctggccgactttcaatcccaccagctttgggccacactgctcagcctgaccttcattaagacaaccttttctctgcattacgcttggaaaacgatggccatggttctttccatcgtgagcctgttccctctctgtctgtctacaacctcccagaagaccacatggctcccggtgctgcttgggagcctgggatgcaagcccctgaccatgtttctcattgctgagaataaaatctggggccggcgctcttggcctctgaacgaaggcatcatggccgtcgggattgtgtccatccttctgagctccctcctgaagaacgatgttcccctcgcgggacctctgattgccggcgggatgcttatcgcttgttatgtgattagcggatctagcgccgacctgtccctggagaaagctgccgaggtctcttgggaagaggaagccgagcacagcggcgcttcccataatatcctcgtggaagttcaggatgacgggacaatgaagatcaaagatgaggagagagacgatacgctgaccattcttctgaaggcgacactcctggccgtgtctggagtctaccccctcagcatccctgctaccctgttcgtgtggtatttctggcagaagaagaagcagcggtccggcgtcctttgggacacaccctctccgcctgaagtggagcgcgccgttctggatgacggcatttacagaatcatgcagcgggggctgctcggacgcagccaggtgggcgtcggggtgtttcaagaaaacgttttccacaccatgtggcacgtgacgagaggagccgtcctgatgtatcagggcaaacggcttgagccctcctgggctagcgtgaagaaagacctgatttcttacgggggaggctggagactccagggctcctggaataccggggaggaagtgcaggttatcgccgtcgagcctggaaagaaccccaaaaatgtgcaaacagcgccgggcacctttaagacacctgaaggggaggtgggagctattgccctggatttcaagcccggcaccagcgggtctcctatcgtcaaccgcgaaggaaaaatcgtgggcctctacggcaatggggttgtgacaacgtccggaacctatgtcagcgccattgctcaggccaaggcgtcccaggagggccccctgcccgagatcgaagacgaggtgtttcggaaaagaaaccttacaattatggatctgcatcctgggtctggaaagacccgccggtacctgccggctatcgttagagaagccattaaacgccggctcagaaccctgatccttgcccccacacgcgtggtcgctagcgagatggccgaagctctgaagggcatgcctatccggtatcaaacgaccgccgtgaagtccgagcacacagggaaagagattgttgacctcatgtgccatgcgaccttcacaatgagactgctgagccccgtgcgggtccctaattacaacatgatcattatggatgaagcccactttaccgacccctcttccatcgctgcccgcggctatattagcacgagagtgggaatgggcgaggctgccgccatcttcatgacagctacccctccggggtctgtggaagcgtttccccagagcaatgccgtcatccaggatgaggaacgggacattcctgagcgctcctggaactctggatacgagtggatcaccgatttccccggcaagacagtttggtttgtgcctagcattaaatccgggaatgacatcgctaactgtctcagaaagaatggaaaacgggtgattcagctttctagaaagaccttcgatacagaatatcaaaagaccaaaaacaacgactgggactacgtcgtgacgacagatatcagcgagatgggcgccaatttccgcgccgaccgggttattgatcccagacgctgcctgaagccggtgatcctgaaagacgggcctgaacgggtcatcctcgctggccccatgcccgtgaccgttgcctccgcggctcagagacgcggacggattggcagaaaccataataaggagggggatcagtacatctatatgggacagcctctgaacaatgacgaggatcacgcccactggacagaagccaaaatgcttctggacaacattaatacccccgagggcatcattcctgctctctttgaaccggagcgcgaaaagagcgccgcgatcgatggggagtacagactgcggggagaggcccgcaagacgttcgtggaactgatgagacggggcgacctccccgtctggctttcttataaagtggcttccgaggggtttcaatacagcgatcgcagatggtgcttcgacggcgaacggaacaatcaggtcctggaggaaaacatggatgtggagatctggaccaaggagggagaacgcaaaaagctgcgccctcggtggctcgacgccagaacatattccgaccccctggctcttagagagtttaaagagttcgccgctggccggagatctgttagcggggatctgattctcgagatcggaaagctgcctcagcatctgacccagcgggcccaaaatgcgctcgacaaccttgtgatgctgcacaattccgaacagggcgggcgcgcctacagacatgctatggaggagctgcccgatacaattgaaaccctcatgctgcttgccctgatcgctgtgctcacaggaggcgtcaccctgtttttcctgtctggccgggggctcggaaaaacgagcattggccttctgtgtgttatggcctccagcgtgctgctctggatggcctctgtggagccgcactggatcgctgcgtccatcattctggaatttttccttatggtcctgctcatccctgagcccgaccgccagagaacacctcaggataaccaactggcctatgtggttattgggctgctctttatgatccttaccgtggctgccaatgagatgggactgctggaaaccacaaagaaggacctcggcattgggcacgtcgccgtggagaaccatcaccatgctgccatgctggatgtcgaccttcaccccgcgagcgcctggaccctgtacgctgtggccacaacgatcattacccctatgatgcggcatacaatcgaaaacaccacagctaatatctctctcaccgccattgcgaaccaggccgctatcctgatgggactggataaaggctggcccatttccaagatggacatcggcgttccgctccttgccctggggtgctacagccaggtgaatcctctgacgctcaccgctgccgtcctgatgcttgtggctcactatgccattatcggacccggcctgcaagcgaaagccacacgcgaggctcagaagagaaccgccgctgggatcatgaaaaaccccacagttgatggaattgtggccatcgacctcgatcctgtcgtgtacgacgccaagttcgaaaagcagctgggccagattatgctgctcatcctttgtacctctcaaattctgctgatgcggacgacatgggcgctctgcgagagcatcaccctggctacagggccgcttaccaccctgtgggagggatcccccggcaaattttggaatacaacgatcgccgtgtctatggctaacattttccgcggcagctatctcgccggggccggactggctttctccctgatgaagtccctcggcgggggaagacggggcaccggggcccagggagaaacacttggcgagaaatggaagagacagctgaatcagctgtccaaatctgaatttaacacctacaagcgcagcggcatcatggaggttgaccggtccgaagcgaaggaggggctcaaaagaggagagacaaccaagcacgccgtctctcgcggcacggctaaactgcggtggttcgtggaaagaaatcttgtgaagcctgaggggaaagtcattgatctgggatgtggccgcgggggatggagctattactgcgccggcctcaagaaggttacagaagtgaaaggctataccaaaggcgggcccgggcatgaggaacctatccccatggctacctacgggtggaacctggtgaaactgcactccggaaaggacgtctttttcattcctccggagaaatgtgatacactcctttgcgacatcggcgagtctagccccaatcctaccattgaagaggggcggacactgagagtgctgaagatggttgaaccctggctccgcggaaaccaattttgtatcaaaatcctgaatccttacatgccctccgtggtcgagacgcttgagcagatgcagcggaagcatggcggcatgctggtgagaaacccgctcagccgcaattctacccacgaaatgtattgggtttcctgcgggacaggaaacattgtgagcgccgtcaatatgacctctcggatgctgctgaacagattcacaatggcgcaccgcaagcctacctacgagagagatgtggacctcggcgccgggacgcggcatgtggctgtcgaacccgaggttgccaacctggatatcattggacagcgcatcgaaaatattaaacacgagcataagtccacctggcactatgacgaggataacccctacaaaacatgggcttatcatggcagctacgaagtgaagccttctgggtccgccagctccatggtgaatggagtcgtgaaacttctgaccaagccctgggacgttatccctatggtgacacaaatcgctatgaccgatacaaccccgtttggccagcagagagtcttcaaggagaaagtggacacgcggacacccaaggccaaaagaggcaccgcgcaaattatggaagttaccgccaagtggctctgggggtttctgagccggaacaaaaagcctcgcatctgtacaagagaggagttcacgcggaaggtgcgctctaatgctgccattggagctgtctttgtggacgagaaccagtggaatagcgccaaagaggccgttgaagatgagagattctgggaccttgtgcaccgggaacgcgagctgcacaagcagggcaaatgcgcgacctgcgtctataacatgatggggaagagagagaaaaagctcggagagtttggcaaggctaaagggtcccgggccatctggtacatgtggctgggcgcccgcttcctggagttcgaagctctcggatttatgaatgaggatcattggttctctagagaaaacagcctgtccggcgtggagggggagggacttcacaagctgggctacattctccgggacatctctaaaatccccgggggaaatatgtatgccgatgacacagctggctgggatacccgcattacagaagacgatctgcagaacgaggccagaatcaccgacattatggaacctgagcatgcgcttctggccaagagcatctttaaactcacataccaaaataaggtcgtgcgggttcagcgccccgctaaaaacgggaccgtgatggatgtcatttccagacgggaccagagaggctctggacaggtgggcacgtatgggctgaataccttcacaaacatggaagcccaactgatccgccagatggagagcgagggaatcttttccccgagcgaactcgagacccctaacctggctgaacgggtgcttgattggctggagaagtacggcgttgaaagactcaagcgcatggccatttctggggacgactgtgtggtcaaacccatcgatgaccggttcgcgacagccctgaccgctcttaatgatatgggaaaggtgagaaaagacattcctcagtgggagccctccaagggctggaacgattggcagcaagttcctttttgcagccaccacttccatcagctgatcatgaaagacgggcgcgagattgtggtcccctgtcggaatcaggatgaactcgtgggcagagcccgcgtctctcagggagctggctggtccctgcgggagacggcctgcctgggaaagagctatgctcaaatgtggcagctcatgtactttcacagacgcgacctgcggcttgccgcgaacgccatctgttccgctgtgccggttgattggattcctacatctagaaccacatggagcatccatgcccaccatcagtggatgaccacggaagacatgctgtccgtgtggaatcgggtctggatcgaggaaaacccctggatggaggataagacccacattagctcttggggagacgtgccctatctcggcaaaagagaggaccaatggtgcgggtccctgatcggacttacagcccgcgctacctgggccacaaatattcaggttgcgatcaaccaggtgcggagactgattggcaatgaaaactacctcgattacatgaccagcatgaagcgcttcaaaaatgagtctgaccctgaaggggctctgtggtga

SEQ ID NO: 18977 - RNA, 9879 nt, synthetic construct
  misc_feature 1..9879: note = derived and/or modified CDS sequence (opt5) from DENV-1__FJ410286__SS-prME
  source 1..9879: mol_type = other RNA
agcgtgaccatgctgctcatgctgatgcccacggcccttgctttccacctgacgaccagaggaggggaacctcatatgatcgtctccaagcaggaacggggaaaatctctcctgtttaagaccagcgccggagttaacatgtgcacccttattgcgatggacctgggggaactctgtgaagatacaatgacctacaaatgcccgagaatcacagaagctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccagggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgggaagggagtgacacagaacggccggcttatcacggctaatcccatcgtcaccgataaagagaagcctgtgaacattgaagccgagccgccctttggggagagctatatcgtgattggagccggcgaaaaagctctcaagctgtcttggttcaagaaagggagctccatcggcaagatgtttgaggccacagctagaggagcccgccggatggcgattctgggcgacaccgcctgggatttcgggtctatcggaggcgtttttacaagcgtcgggaaactcgtgcatcagatcttcggaaccgcttacggcgtgctgttttccggggtcagctggacgatgaagattggcatcggagtgcttctgacctggctcggcctcaattctagatccacaagcctgtctatgacctgtattgccgttgggcttgtgacactctacctgggagtcatggtgcaggctgactccggctgcgttatcaactggaaagggcgcgaactgaagtgtggaagcggcattttcgtgaccaatgaggtccacacatggaccgaacaatataagtttcaggccgattcccctaaacggctctctgcggccatcgggaaggcttgggaggagggcgtgtgcggaattagaagcgccacgcgcctggaaaacatcatgtggaaacagatctccaacgagcttaatcatattctgctcgaaaacgacatgaagttcacagttgtggtcggcgacgtggctgggatcctggtgcagggcaagaagatgattcggccgcaacccatggagtacaaatattcttggaaaagctggggcaaggccaaaatcattggggccgatgtccaaaattccacctttatcatcgacggacctaacacccccgaatgtcctgatgaccagagagcttggaatatttgggaggttgaggattacggcttcggcatctttacaaccaacatttggctgaaacttcgcgacagctatacacaggtgtgcgatcaccggctcatgtctgcggccatcaaagactccaaggctgtgcacgccgatatggggtactggattgaaagcgagaaaaatgaaacatggaagctggccagagcttctttcatcgaggtcaagacctgtatctggcccaaatcccatacactgtggagcaacggagtgctcgaatctgagatgattatcccgaagattcacggcgggcctatcagccaacataattatcgccccggatacttcacccagacagccggcccttggcacctggggaaacttgagctggactttgatctctgcgaaggaaccacggttgtggtcgacgagcactgcggcaaccggggcccctccctgagaaccacaaccgtgacagggaagattatccatgaatggtgttgccggagctgtaccctgcctccccttcgcttcagaggagaggatggctgctggtacgggatggagatccggccggttaaagaaaaggaggaaaatctcgtgaagtctatggtctccgcgggaagcggcgaggtggactccttttctctggggctgctctgtattagcatcatgattgaagaggttatgagatcccgctggtctcggaaaatgctgatgacgggaacacttgctgtgttctttctgctcatcatgggccagctgacctggaacgacctgattagactttgcatcatggtcggcgccaatgccagcgatcgcatggggatgggaacaacctatctggctctcatggccaccttcaagatgagacctatgtttgcggtgggcctgctgttccggcgcctgacatccagagaggtgcttctgctcacgattgggctgtctctggtcgctagcgttgaacttcccaactccctggaggaactcggagacggcctggccatggggatcatgatcctcaaactgcttaccgattttcaaagctaccagctgtgggccacactcctgtctctgaccttcattaagacaaccttttcccttcactatgcttggaaaacgatggccatggtgctgagcatcgtgtctctcttccccctgtgtctctccacaaccagccagaagaccacatggctgcctgtccttctgggatctctgggctgcaagccgctcaccatgtttctgattgctgagaataaaatctggggccggaagtcctggccccttaacgaagggattatggccgtgggaatcgttagcatcctgctctccagcctgctcaaaaacgacgtgcctctggcgggcccccttattgccgggggaatgctgatcgcttgttacgtcatttctggcagctccgccgatctgtctctcgagaaggctgccgaggtgagctgggaagaggaagccgagcattccggggcttctcacaatatcctggttgaagtgcaggacgatggaacaatgaaaattaaggacgaggagcgcgatgacacgcttaccatcctgctcaaagcgacactgctcgccgtcagcggcgtgtatcctctgtccatccccgctacccttttcgtctggcatttctggcaaaagaagaaacagagatctggcgtgctgtgggatacacctagccctcccgaagttgagcgggccgtgctggacgatgggatttaccgcatcatgcagagaggactcctgggccggtcccaggtcggggtgggagtttttcaagaaaacgtgttccacaccatgtggcacgtcacgcgcggcgccgtgcttatgtatcaggggaagagactggagcccagctgggcttctgtgaaaaaggacctcatttcctacggaggcggctggcggtttcaggggagctggaataccggagaggaagttcaggtcatcgccgtggagcccggcaaaaaccctaagaatgtgcaaacagcgcccgggaccttcaagacaccggaaggagaggtcggcgctattgccctggactttaaacctgggacctctggatcccccatcgtgaacagagaaggcaagattgttggcctctacgggaatggagtggtcacaacgagcggcacctatgtgtccgccatcgctcaggccaaagcgtctcaggaggggcctctgcccgagatcgaagatgaggttttccgcaagcggaaccttacaattatggacctgcatcccggaagcggcaaaaccagacgctacctgcctgctatcgtgcgggaagccattaagagaaagctccgcaccctgatccttgccccgacacgggtcgtggcttccgagatggccgaagctctgaaagggatgcccattagatatcaaacgaccgccgttaagagcgagcacacaggcaaagagatcgtggatctcatgtgccatgcgacctttacaatgcgcctgctgtctcctgtccgggtgcccaattacaacatgatcattatggacgaagcccacttcaccgatccttccagcatcgctgccagaggatatatttctacgcgggtgggcatgggggaggctgccgccatctttatgacagctacaccccctggaagcatggaagcgttcccgcagtccaatgccgtcattcaggacgaggaacgcgatatccccgagagatcttggaacagcggctacgagtggatcaccgactttcctgggaagacagtttggttcgtgccctccattaaagctggaaatgatatcgccaactgtctccggaagaatggcaagcgcgtgattcagctttctagaaaaaccttcgacacagaatatcaaaagaccaaaaacaacgattgggactacgtcgtgacgacagacatcagcgagatgggggccaattttcgggctgatagagttattgaccctcgccggtgcctgaagcccgtgatcctgaaagatggcccggaaagagtcattctcgccggacctatgcccgtgaccgttgcgtccgctgcccagcgccggggcagaatcgggcgcaaccataataaggagggagaccagtacatctatatgggccagcccctgaacaatgatgaggaccacgcccactggacagaagctaagatgcttctggataacattaatacccctgaggggatcattcccgccctcttcgaacctgagcgggaaaagagcgcggccatcgacggagagtacagactgcgcggcgaggctagaaagacgtttgtggaactgatgcggcgcggggatctcccggtctggctttcttataaagtggcctccgagggcttccaatacagcgacagacggtggtgctttgatggagaacgcaacaatcaggtcctggaggaaaacatggacgtggagatttggaccaaggagggcgaacgcaaaaagctgcggcccagatggctcgatgctcgcacatattccgaccctctggcccttcgggagttcaaagaatttgctgccgggagacgctctgttagcggagacctgatcctcgagatcggcaagctgccccagcatctgacccagcgggcgcaaaatgccctcgataaccttgtgatgctgcacaattccgaacaagggggcagagcttaccggcatgccatggaggagctgcctgacacaattgaaaccctcatgctgcttgctctgatcgccgtgctcacaggcggcgtcaccctgttctttctgtctgggaagggactcggcaaaacgagcattgggcttctgtgtgttatggcctccagcgtgctgctctggatggcttctgtggagccccactggatcgcggcctccattatcctggagttctttcttatggtcctgctcatcccggagcctgatcgccagagaacaccccaggacaaccaactggcttatgtggttattggactcctgttcatgatccttaccgtggccgccaatgagatgggcctgctggaaaccacaaagaaagatctcgggattggacacgtcgctgtggagaaccatcaccatgccgcgatgctggacgtcgatcttcaccctgccagcgcttggaccctgtacgccgtggctacaacgatcattacccccatgatgcggcatacaatcgaaaacaccacagccaatatttctctcaccgcgatcgccaaccaggctgccatcctgatgggcctggacaagggctggcctatttccaaaatggatatcggggttcccctccttgctctgggatgctacagccaggtgaatccgctgacgctcaccgccgctgtcctgatgcttgtggcccactatgcgattatcggccctgggctgcaagccaaggctacacgcgaggcccagaagagaaccgctgccggaattatgaaaaaccccacaatcgacggcatcgttgccattgatctcgaccccgtggtctacgatgcgaagtttgaaaaacagctggggcagatcatgctgctcattctttgtacctctcaaatcctgctgatgcggacgacatgggctctctgcgagagcattaccctggccacaggacctcttaccaccctgtgggagggctccccgggcaagttctggaatacaacgatcgctgtgtctatggccaacatcttccgcgggagctatctcgccggagctggcctggccttttccctgatgaaaagcctcgggggaggcagacgggggaccggagcgcagggcgaaacacttggcgagaagtggaagcgccagctgaatcagctgtccaaatctgagttcaacacctacaagagaagcgggattatggaggtggaccggtccgaagccaaagagggactcaagagaggcgagacaaccaaacacgctgtttctcgcgggacggccaagctgcggtggtttgtcgaaagaaatcttgtgaagcccgagggaaaagtgatcgacctgggctgtgggcgcggaggctggagctattactgcgctggcctcaagaaagtcacagaagttaaggggtataccaaaggaggccctgggcatgaggaacccattcctatggccacctacggatggaacctggtgaagctgcactccggcaaagatgtgttctttattccccctgagaagtgtgacacactcctttgcgatatcggggagtctagcccgaatcccaccatcgaagagggacggacactgagagtcctgaagatggtggaaccttggctccgcggcaaccaattctgtattaaaatcctgaatccctacatgccttccgttgtggagacgcttgagcagatgcagcggaagcatggcgggatgctggtcagaaaccccctcagccgcaattctacccacgaaatgtattgggtgtcctgcggaacaggcaacatcgttagcgcggtgaatatgacctctcggatgctgctgaacagatttacaatggcccaccgcaaaccgacctacgagcgggacgtcgatctcggggctggaacgagacatgtggccgtggaacctgaggtcgctaacctggacattatcggccagcgcattgaaaatatcaagcacgagcataaatccacctggcactatgatgaggacaacccctacaagacatgggcctatcatgggagctacgaagttaagccctctggatccgctagctccatggtgaatggcgtggtcaaacttctgaccaagccttgggatgtgattcccatggttacacaaatcgccatgaccgacacaacccctttcggccagcagagagtgtttaaagagaaggtcgatacgcggacaccgaaagcgaagcgcgggaccgcccaaatcatggaagtgaccgctagatggctctggggattcctgagccggaacaagaaacccagaatttgtacacgggaggaatttacgcgcaaggttagatctaatgccgctatcggcgccgtgttcgtcgacgagaaccagtggaatagcgccaaagaggcggtggaagacgatcggttttgggaccttgttcaccgcgagagagaactgcacaagcaggggaaatgcgctacctgcgtgtataacatgatgggaaagcgggagaagaaactcggcgagttcgggaaggccaaaggctcccgcgccatttggtacatgtggctgggagctagattcctggagtttgaggccctcggcttcatgaatgaagatcattggttttctcgggagaacagcctgtccggggtcgaaggagagggccttcacaagctggggtacatcctccgcgacatttctaaaatccctggaggcaatatgtatgctgatgacacagccgggtgggataccagaatcacagaggacgatctgcagaacgaagcgaagattaccgacatcatggagcccgaacatgcccttctggctaaaagcattttcaagctcacataccaaaataaggtggtccgggtgcagcgccctgccaaaaacggcaccgttatggatgtgatctccagacgggaccagcgcggatctggccaggtcgggacgtatggactgaatacctttacaaacatggaggctcaactgattagacagatggaaagcgagggcatcttcctccccaacgagctggaaaccccgaatcttgccgggcgggtgctggattggctcgagaagtacggagtggaaagactgaaacgcatggcgatctccggcgacgactgtgttgtgaagcctattgatgaccggtttgccacagctcttaccgccctgaacgatatggggaaagtcagaaaggacatcccccagtgggagcctagcaagggctggaatgattggcagcaagtgcccttctgctctcaccactttcatcagctcattatgaaagacggacgcgaaatcgttgtgccttgtcggaaccaggatgagctggtcggcagagctcgcgtgtcccagggggccggatggagcctgcgggagacggcttgcctcggcaagtcttatgcccaaatgtggcagctgatgtacttccacagacgcgaccttcggctggcggccaatgctatttgttccgccgtccccgtggattgggttccgacaagcagaaccacatggtccatccatgcccaccatcagtggatgaccacggaagacatgctctctgtgtggaaccgcgtctggattgaggaaaatccttggatggaggataaaacccggatcagctcctgggaagacgtgccctatctggggaagagagaggaccaatggtgcggaagccttatcggcctgacagctcgggccacctgggcgacaaacattcaggttgctatcaatcaggtgagacgcctcattgggaacgagaattactctgattacatgacctccatgaaacggtttaagaacgaaagcgagcccgaaggcgccctgtggtga

SEQ ID NO: 18978 - RNA, 9879 nt, synthetic construct
  misc_feature 1..9879: note = derived and/or modified CDS sequence (opt5) from DENV-1__FJ461339__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactgaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagccacacgcaggtttgcgaccaccggcttatgtctgccgctattaaagattccaaggccgtgcatgccgacatgggctattggatcgaaagcgagaaaaatgaaacatggaagctcgctagagcctctttcatcgaggtgaagacctgtatttggcccaaatcccacacactgtggagcaacggggtcctggaatctgagatgatcattccgaagatctacggaggccctattagccaacataattatcgccccgggtacttcacccagacagcgggaccttggcacctcggcaaactggagcttgattttgacctgtgcgaagggaccacggtggttgtggatgagcactgcggaaaccggggcccctccctcagaaccacaaccgtcacaggcaagatcatccatgaatggtgttgccggagctgtaccctgcctcccctgcgcttcaaaggggaggacggatgctggtacggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctatcttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaccccaccagctttgggctacactgctcagcctgaccttcatcagaacaaccttttctctgcattacgcctggaaaacgatggctatggttctttccattgtgagcctgttccctctctgtctgtctacaacctcccagaagaccacatggctcccggtgctgcttgggagcctgggatgcaagcccctgaccatgtttctcatcgccgagaataaaatttggggccggaagtcttggcctctgaacgaaggcatcatggcggtcgggatcgtgtccattcttctgagctccctcctgaaaaacgatgttcccctcgccggacctctgatcgctggcgggatgcttattgcctgttatgtgatcagcggatctagcgctgacctgtccctggagaaggccgccgaggtctcttgggaagaggaagctgagcacagcggcgcgtcccataatattctcgtggaagttcaggatgacgggacaatgaaaatcaaggatgaggagcgcgacgatacgctgaccatccttctgaaagccacactcctggctgtgtctggagtctaccccctcagcattcctgccaccctgttcgtgtggtatttctggcaaaagaagaaacagagatccggcgtcctttgggacacaccctctccgcctgaagtggagcgggccgttctggatgacggcatctaccgcattatgcagagagggctgctcggacggagccaggtgggcgtcggggtgtttcaagaaaacgttttccacaccatgtggcacgtgacgcgcggagctgtcctgatgtatcagggcaagagacttgagccctcctgggccagcgtgaaaaaggacctgatctcttacgggggaggctggcggctccagggctcctggaataccggggaggaagtgcaggttattgcggtcgagcctggaaaaaaccccaagaatgtgcaaacagctccgggcacctttaagacaagcgaaggggaggtgggagccatcgccctggatttcaaacctggcacctctgggtcccccattgtcaacagagaaggaaagatcgtgggcctctacggcaatggggttgtgacaacgagcggaacctatgtctccgctatcgcccaggcgaaagcttctcaggagggccctctgcccgagattgaagacgaggtgtttcgcaagcggaaccttacaatcatggatctgcatcccgggagcggaaaaaccagacgctacctgcctgccattgttcgggaagccatcaagagacgcctccggaccctgattcttgctccgacaagagtggtcgcctccgagatggctgaagccctgaagggcatgcccatccgctatcaaacgaccgcggtgaaaagcgagcacacagggaaggagatcgttgacctcatgtgccatgccaccttcacaatgcggctgctgtctcctgtgagagtccccaattacaacatgattatcatggatgaagctcactttaccgacccttccagcattgccgctcggggctatatctctacgcgcgtgggaatgggcgaggccgccgctattttcatgacagcgaccccccctgggagcgtggaagcctttccgcagtccaatgctgtcatccaggatgaggaaagagacatccccgagcggtcttggaacagcggatacgagtggattaccgatttccctggcaaaacagtttggtttgtgccctccatcaagtctgggaatgacattgccaactgtctccgcaaaaatggaaagagagtgatccagcttagccggaagaccttcgatacagaatatcaaaaaaccaagaacaacgactgggactacgtcgtgacgacagatatttccgagatgggcgccaatttcagagctgaccgcgttatcgatcctcggagatgcctgaaacccgtgattctgaaggacgggccggaacgcgtcatcctcgccggccctatgcccgtgaccgttgcgagcgctgcccagcggagaggacgcatcggccggaaccataataaagagggggatcagtacatttatatgggacagcccctgaacaatgacgaggatcacgcccactggacagaagctaagatgcttctggacaacatcaatacccctgagggcattatccccgccctctttgaacctgagagagaaaagtctgcggccattgatggggagtaccgcctgagaggagaggctcggaaaacgttcgtggaactgatgcgcagaggcgacctcccggtctggctttcctataaggtggccagcgaggggtttcaatactccgatcggcgctggtgcttcgacggcgaaagaaacaatcaggtcctggaggaaaacatggatgtggagatctggaccaaagagggagaacggaagaaactgagaccccgctggctcgacgctcggacatattctgaccctctggcccttagagagtttaaggaattcgctgccggccgccggagcgtttccggggatctgatcctcgagattggaaaactgccccagcatctgacccagagagcgcaaaatgccctcgacaaccttgtgatgctgcacaattctgaacagggcgggcgggcttaccgccatgccatggaggagctgcctgatacaatcgaaaccctcatgctgcttgctctgattgccgtgctcacaggaggcgtcaccctgtttttcctgagcggcagagggctcggaaagacgtccatcggccttctgtgtgttattgccagctctgtgctgctctggatggcttccgtggagccccactggatcgcggccagcatcattctggaatttttccttatggtcctgctcatcccggagcctgaccggcagcgcacaccccaggataaccaactggcttatgtggttattgggctgctctttatgatccttaccgtggccgccaatgagatgggactgctggaaaccacaaagaaagacctcggcattgggcacgtcgctgtggagaaccatcaccatgccgcgatgctggatgtcgaccttcaccctgcctctgcttggaccctgtacgccgtggctacaacgatcattacccccatgatgagacatacaatcgaaaacaccacagccaatatctccctcaccgcgattgccaaccaggctgccatcctgatgggactggataagggctggcctattagcaaaatggacatcggcgttcccctccttgctctggggtgctactctcaggtgaatccgctgacgctcaccgccgctgtcctgatgcttgtggcccactatgcgattatcggacctggcctgcaagccaaggctacacgggaggcccagaaacgcaccgctgccgggatcatgaagaaccccacagttgatggaattgtggccatcgacctcgatcccgtcgtgtacgacgcgaagttcgaaaaacagctgggccagattatgctgctcatcctttgtaccagccaaattctgctgatgagaacgacatgggctctctgcgagtccatcaccctggccacagggcctcttaccaccctgtgggagggatctccgggcaagttttggaatacaacgatcgctgtgagcatggccaacattttccggggctcctatctcgccggggttggactggctttcagcctgatgaaatccctcggcgggggacgcagaggcaccggggcccagggagaaacacttggcgagaagtggaaacggcagctgaatcagctgtctaagagcgaatttaacacctacaagagatccggcatcatggaggtcgaccgctctgaagcgaaagaggggctcaagcggggagagacaaccaaacacgccgtgagcagaggcacggctaagctgcgctggttcgtggaacggaatcttgtcaaacccgaggggaaggttattgatctgggatgtggcagagggggatggtcctattactgcgccggcctcaagaaagtgacagaagtgaagggctataccaaagggggacctggccatgaggaacccatccctatggctacctacgggtggaacctggtcaagctgcactctggaaaagacgtgtttttcattccccctgagaagtgtgatacactcctttgcgacatcggcgagagctccccgaatcccaccattgaagaggggcgcacactgcgggttctgaaaatggtggaaccttggctcagaggaaaccaattttgtatcaagatcctgaatccctacatgcctagcgtcgtggagacgcttgagcagatgcagcgcaagcatggcggcatgctggttcggaaccccctctctagaaattccacccacgaaatgtattgggtgagctgcgggacaggaaacattgtctctgccgtgaatatgacctcccgcatgctgctgaaccggttcacaatggcgcacagaaaaccgacctacgagcgcgatgtggacctcggcgccgggacgagacatgtcgctgttgaacctgaggtggccaacctggatatcattggacagcggatcgaaaatattaagcacgagcataaaagcacctggcactatgacgaggataacccctacaagacatgggcttatcatggctcttacgaagtgaaaccctccgggagcgcctccagcatggtcaatggagtggttaagcttctgaccaagccttgggacgtgatccccatggtcacacaaatcgctatgaccgatacaaccccttttggccagcagcgcgtgttcaaagagaaggttgacacgagaacaccgaaagccaagcggggcaccgcgcaaattatggaagtgaccgccaaatggctctgggggtttctgtctagaaacaagaagccccggatctgtacacgcgaggaattcacgagaaaagtccggagcaatgctgccattggagctgtgtttgttgacgagaaccagtggaattccgccaaggaggccgtggaagatgagcgcttctgggaccttgtccacagagaacgggagctgcacaaacagggcaagtgcgcgacctgcgtgtataacatgatggggaaacgcgaaaagaagctcggagagtttggcaaagctaaggggtctagagccatctggtacatgtggctgggcgcccggttcctggagttcgaagctctcggatttatgaatgaggatcattggttcagccgcgaaaactccctgtctggcgtcgagggggagggacttcacaaactgggctacattctcagagacatcagcaagatccctgggggaaatatgtatgccgatgacacagctggctgggatacccggattacagaagacgatctgcagaacgaggccaaaatcaccgacattatggaacccgagcatgcgcttctggccaagtccatctttaaactcacataccaaaataaggtggttcgcgtgcagagacctgctaagaacgggaccgtcatggatgtgatttctcggcgcgaccagagaggcagcggacaggtgggcacgtatgggctgaataccttcacaaacatggaagcccaactgatccggcagatggagtccgagggaatctttagcccctctgaactcgagacctccaacctggctggcagagttcttgattggctggaaaaacacggggtggagcgcctcaagcggatggccattagcggagacgactgtgtcgtgaaaccgatcgatgacagattcgcgacagccctgaccgctcttaatgatatgggcaaggttcgcaaagacattcctcagtgggaaccctctaaggggtggaacgattggcagcaagtgcctttttgctcccaccatttccaccagctgatcatgaaggacggccgggagattgtcgtgccctgtagaaatcaggatgagctcgtcggacgcgcccgggtgagccagggcgctgggtggtccctgagagaaacggcctgcctgggaaaatcttacgctcaaatgtggcagctcatgtattttcatcgccgggacctgagacttgccgcgaacgccatctgtagcgctgttcctgtggattgggtccccacatcccgcaccacatggagcattcacgcccatcaccagtggatgaccacggaggacatgctgtctgtgtggaatcgggtttggatcgaagagaacccgtggatggaagataagacccacgtgtccagctggggcgacgtcccttacctcgggaaaagagaggaccaatggtgcggatctctgatcggccttacagcccgggctacctgggccacaaatattcaggtggcgatcaaccaggtgagacgcctgctcgggaatgagaactatctggattacatgaccagcatgaagcggttcaaaaatgaatccgaccccgagggcgctctgtggtga

SEQ ID NO: 18979 - RNA, 9879 nt, synthetic construct
  misc_feature 1..9879: note = derived and/or modified CDS sequence (opt5) from DENV-1__FJ882515__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagatgcgcgattcctacacacaggtctgcgaccaccggctgatgagcgcggccatcaaagattctaaggctgttcatgccgacatgggctattggatcgaatccgagaaaaatgaaacctggaaacttgccagagctagcttcattgaggtgaagacatgtatctggcccaaatctcacaccctctggtccaacggggtgctggaaagcgagatgattatcccgaagatttacggaggccctatctctcaacataattatcgccccgggtacttcacacagaccgccggaccttggcacctgggcaaactcgagctggattttgacctttgcgaagggacgaccgtcgtggttgatgagcactgcggaaaccggggccccagcctgagaacaaccacagtgaccggcaagatcattcatgaatggtgttgccggtcctgtacgctccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgacagggaccctcgctgtgttcctgcttctgatcatgggacagctcacatggaacgatctgattcggctgtgcatcatggttggcgccaatgcctctgacagaatgggcatggggaccacctatcttgctctgatggccacatttaaaatgcgccctatgttcgcggtgggactcctgtttagacggctcacgagccgcgaggtcctgcttctgaccatcggcctctccctggtggcttctgtggaactgcccaacagccttgaggaactgggggatggactcgccatgggcattatgatcctgaagctcctgacagacttccaatcccaccagctttgggccaccctgctcagcctgacatttattaaaaccacgctgtctcttcattacgcttggaagacaatggccatggtcctgtccatcgttagcctcattcccctgtgtctctctaccacctcccagaagacaacctggctgcctgtgcttctggggagcctgggatgcaaaccgctcacaatgttcctgatcgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacgatgtggcacgtgacccggggagccgtccttatgtatcagggcaaacgcctggagccttcctgggctagcgtgaagaaagacctcatttcttacgggggaggctggagactgcagggctcctggaatacaggggaggaagtgcaggttatcgccgtcgagcccggaaagaaccctaagaatgtgcaaaccgcgcccggcacattcaaaaccccggaaggggaggtgggagctattgccctcgattttaagcctggcacaagcgggtctcccatcgtcaaccgggaaggaaaaatcgtgggcctgtacggcaatggggttgtgacgacctccggaacatatgtcagcgccattgctcaggccaaggcgtcccaggagggccctcttcccgagatcgaagacgaggtgttcagaaaacgcaacctgaccattatggatctgcatcccgggtctggaaagacccggagatacctccctgctatcgttcgcgaagccattaagcggaaactgagaacacttatcctggccccgacgcgcgtggtcgctagcgagatggccgaagctctcaagggcatgcccatccggtatcaaaccacagccgtgaaatccgagcacaccgggaaggagattgttgacctgatgtgccatgcgacatttaccatgagactgctcagccctgtgcgcgtccccaattacaacatgatcattatggatgaagcccacttcacggacccttcttccatcgctgcccggggctatattagcacaagagtgggaatgggcgaggctgccgccatctttatgaccgctacaccccctgggtctgtggaagcgttcccgcagagcaatgccgtcatccaggatgaggaacgggacattcccgagcgctcctggaactctggatacgagtggatcacagattttcctggcaaaaccgtttggttcgtgcccagcattaagtccgggaatgacatcgctaactgtcttagaaagaatggaaaacgggtgattcagctgtctcgcaagacatttgataccgaatatcagaagacgaagaacaacgactgggactacgtcgtgacaaccgatatcagcgagatgggcgccaatttcagagccgaccgggttattgatcctagacgctgcctgaaacccgtgatcctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacgcctgagggcatcattcccgctctgtttgaacctgagcgcgaaaagagcgccgcgatcgatggggagtaccggctgagaggagaggcccgcaaaaccttcgtggaactcatgagacggggcgaccttccggtctggctgtcttataaggtggcttccgaggggttccaatacagcgatcgcagatggtgctttgacggcgaacggaacaatcaggtcctggaggaaaacatggatgtggagatctggacaaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacgctgttctttctctctggccgggggcttggaaaaacaagcattggcctgctgtgtgttatggcctccagcgtgctcctgtggatggcctctgtggagccccactggatcgctgcgtccatcattcttgagttctttctgatggtcctcctgatcccggagcctgaccgccagagaacaccccaggataaccaactggcctatgtggttattgggctccttttcatgatcctgaccgtggctgccaatgagatgggactgctcgaaacaaccaagaaagacctgggcattgggcacgtcgccgtggagaaccatcaccatgctacaatgcttgatgtcgacctgcaccctgccagcgcgtggacgctctacgccgtggctaccacaatcattacccccatgatgcggcatacaatcgaaaacaccacggccaatatctctctgaccgctattgccaaccaggcggccatcctgatgggactcgataagggctggcctatttccaaaatggacatcggcgttccccttctggctctggggtgctacagccaggtgaatccgctcacactgaccgccgctgtccttatgctggtggcccactatgctattatcggacctggcctccaagccaaggcgacacgcgaggcccagaagagaaccgctgccgggatcatgaaaaaccccacggttgatggaattgtggctatcgacctggatcccgtcgtgtacgacgccaagtttgaaaaacagctgggccagattatgctccttatcctgtgtacatctcaaattctgctcatgcggaccacatgggccctgtgcgagagcatcacccttgcgaccgggcctctgacaacgctctgggagggatccccgggcaagttctggaataccacaatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatctacaagagaagcggcattatggaggttgaccggtccgaagccaaagaggggctgaagagaggagagaccacgcgccacgcggtctctcggggcacagccaaacttagatggttcgtggaacgcaatctggtgaagcccgaggggaaggtcatcgatctcggatgtggcagagggggatggagctattactgcgctggcctgaaaaaggttaccgaagtgaaaggctataccaaagggggacctggccatgaggaacccattcctatggccacatacgggtggaacctggtgaaactccactccggaaaggacgtcttctttacaccccctgagaaatgtgatacacttctgtgcgacatcggcgagtctagcccgaatcccacgattgaagaggggagaaccctgcgcgtgctcaagatggttgaaccttggctgcggggaaaccaattctgtatcaagatccttaatccctacatgccttccgtggtcgagacactggagcagatgcagagaaaacatggcggcatgctcgtgcgcaaccccctgagcagaaattctacccacgaaatgtattgggtttcctgcgggacaggaaacattgtgagcgctgtcaatatgacctctagaatgctgctcaaccgctttacgatggcccaccggaagccgacctacgagaaagatgtggacctgggcgcggggacaagacatgtggccgtcgaacctgaggttgctaaccttgatatcattggacagcgcatcgaaaatattaagcacgagcataaatccacctggcactatgacgaggataacccctacaagacatgggcctatcatggcagctacgaagtgaagccctctgggtccgctagctccatggtgaatggagtcgtgaaactgctcaccaagccttgggacgttatccccatggtgacacaaatcgccatgaccgatacgacacctttcggccagcagagagtctttaaagagaaggtggacacccggaccccgaaagctaagcgcggcacagttcaaattatggaagtgacggccagatggctgtgggggttccttagccggaacaagaaacccagaatctgtacccgggaggaatttacacgcaaggtcagatctaatgcggccattggagctgtgttcgttgacgagaaccagtggaatagcgccaaagaggctgtggaagatgagcggttttgggacctggtccagaaggaacgcgagctccacaaacagggcaagtgcgcgacctgcgtgtataacatgatggggaagagagagaagaagctgggagagttcggcaaagccaaggggtcccgggcgatctggtacatgtggctgggcgctcgctttctcgagttcgaagccctgggatttatgaatgaggatcactggttctctagagaaaacagcctttccggcgtcgagggggagggactgcataaactcggctacattctgcgggacatctctaagatccctgggggaaatatgtatgccgatgacacagctggctgggatacccgcattacagaagacgatcttcaaaacgaggccaaaatcaccgacattatggaacccgagcacgctctgctcgccacgagcatcttcaagctgacctaccagaataaggtggttagagtgcagcggcctgcgaaaaacgggacagtcatggatgtgatttcccgcagagaccagcggggctctggacaagtgggcacctatgggctgaatacatttaccaacatggaagcccagctcatccgccagatggagagcgagggaatcttcctgccctccgaacttgagacgccgaacctggctgaaagagttctcgattggctggagaagtacggcgtggaacggcttaaaagaatggccattagcggggacgactgtgtcgtgaagcctatcgatgaccgctttgctacagccctgaccgcgctcaatgatatgggaaaagttcggaaggacattccccagtgggagccttctaagggctggaacgattggccccaagtgcctcattgctcccaccacttccatcagctgatcatgaaagacgggagagagattgtcgtgccctgtcgcaatcaggatgaactggtcggccgggccagagtgagccagggagctggctggtctctccgcgagacagcctgcctggggaagtcctatgctcaaatgtggcagcttatgtactttcaccggagagacctgcgcctcgccgctaacgccatctgtagcgcggttccggtggattgggtccctacctcccggacgacctggtctattcatgcccaccatcagtggatgacaaccgaagacatgctgagcgtgtggaatagagtttggatcgaggaaaacccctggatggaggataaaacacacgtgtccagctggggagacgtcccctatcttggcaagcgcgaggaccaatggtgcgggtctctgatcggactcaccgctcgggccacatgggcctccaatattcaggtggctatcaaccaggtgagacggctgattggcaatgaaaactacctggattacatgaccagcatgaaaagattcaagaatgaggacgatcctgaaggggccctctggtga

SEQ ID NO: 18980 - RNA, 9879 nt, synthetic construct
  misc_feature 1..9879: note = derived and/or modified CDS sequence (opt5) from DENV-1__FJ882517__SS-prME
  source 1..9879: mol_type = other RNA
agcgtgaccatgctgctcatgctgatgcccaccgcccttgctttccacctgacgaccagaggcggggagcctcatatgatcgtctccaagcaggaacggggaaagtctctcctgtttaagacaagcgccggcgttaatatgtgcacccttattgccatggacctgggggagttctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaagaggctctgaaacttagctggtttaagaaaggctcctctatcgggaagatgttcgaagccacagctagaggcgcccgccggatggcgattctcggagataccgcctgggactttggcagcatcgggggagttttcacatccgtcggcaaactggtgcatcagatctttgggaccgcttacggagtgctgttcagcggcgtctcttggacgatgaagattgggatcggcgtgctcctgacctggcttggactcaattccagaagcacatctctctccatgacctgtattgccgttggcctggtgacactgtaccttggggtcatggtgcaggctgatagcggatgcgttatcaactggaaaggccgcgagctcaagtgtgggtccggaatttttgtgaccaatgaagtccacacatggaccgagcagtataagttccaagccgactctcctaaacggctgagcgcggccatcggcaaggcttgggaggaaggggtgtgcggcattagatccgccacgcgcctggagaacatcatgtggaaacagatctctaacgaactcaatcatattctgcttgagaacgacatgaagtttacagttgtggtcggagatgtggctggcatcctggcccaggggaaaaagatgattcggccgcagcccatggaatacaaatatagctggaagtcctggggaaaggccaaaatcattggcgctgacgtgcaaaataccaccttcatcatcgatgggcctaacacacccgagtgtcctgacgatcagagagcgtggaatatttgggaggtcgaagactacggatttggcatcttcaccacgaacatttggctcaagctgcgcgatagctatacacaggtttgcgaccaccggctgatgtctgccgctatcaaagattccaaggccgtgcacgccgacatgggctactggattgagagcgagaagaatgagacctggaaacttgctagagcctctttcatcgaagtgaagacatgtatctggcccaaatcccataccctctggagcaacggggtcctggagtctgagatgattatcccgaagatttatggaggccctatcagccagcacaattaccgccccgggtactttacacaaaccgcgggaccttggcatctgggcaaactcgaactggatttcgacctttgcgaggggacgaccgtggttgtggatgaacactgcggaaaccggggcccctccctgagaacaaccacagtcaccggcaagattatccacgagtggtgttgccggagctgtacgctccctcccctgcgctttaaaggggaggacggatgctggtatggcatggaaatcagaccggtgaaggagaaggaagagaatctggttaaatctatggtgtccgctgggagcggagaagtcgactccttctctcttggcctcctgtgtattagcatcatgattgaggaggtgatgcggtccagatggtctcgcaagatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggtcacatttaaaatgcgccctatgttcgcggtgggactgctctttagacggctgacgtcccgcgaagtgctcctgcttaccattggcctgtctctcgtcgctagcgttgagctgcccaactccctggaagaacttggggatggactggccatgggcatcatgatcctcaagctgctcacagacttccagagccatcaactgtgggccacccttctgtctctcacatttattaaaaccacgttctccctgcactatgcttggaagacaatggccatggtgctgagcatcgtgtctctttttcccctgtgtctctccaccaccagccagaagacaacctggctgcctgtcctcctggggtctcttggatgcaaaccgctgacaatgttcctgattgctgaaaataagatctggggcagaaaatcctggcccctcaacgagggcattatggccgtggggatcgttagcatcctgctttccagcctgctcaagaacgatgtgcctctggcgggacccctcattgccggcgggatgctgatcgcttgttacgtcatttctggaagctccgccgacctttctctggagaaagctgccgaagtgagctgggaggaagaggccgaacattccggcgcttctcacaatatcctggttgaggtgcaggatgacgggacgatgaagattaaagatgaggaacgggacgataccctcacaatcctgcttaaggcgaccctgctcgccgtcagcggagtgtatcctctgtccatccccgctacactcttcgtctggtacttttggcagaagaaaaagcaacgctctggcgtgctgtgggacaccccttcccctcccgaggttgaaagagccgtgcttgatgacggcatttatcggatcatgcagcgcgggctgctgggaagatcccaggtcggcgtgggggttttccaggagaacgtgtttcatacgatgtggcacgtcacccggggagccgtgctcatgtaccaaggcaaacgcctggagcccagctgggcttctgtgaagaaagaccttatttcctacgggggaggctggagactgcagggcagctggaatacaggggaagaggttcaggtcatcgccgtggaacccggaaagaaccctaagaatgtgcagaccgcgcccggcacattcaaaacctctgagggggaagtcggagctattgccctcgattttaagccgggcacatccgggagccctatcgtgaaccgggagggaaaaattgttggcctgtatggcaatggggtggtcacgacctccggaacatacgtgtctgccatcgctcaagccaaggcgagccaggagggccccctccctgaaatcgaggacgaagttttcagaaaacgcaacctgaccattatggatcttcaccccgggtccggaaagacccggagatatctgcccgctatcgtgcgcgaggccattaagcggaaactgagaacactcatcctggcccctacgcgcgtcgtggctagcgaaatggccgaggctcttaagggcatgccgattcggtaccagaccacagccgttaaatctgagcataccgggaaggaaatcgtggacctgatgtgccacgcgacatttaccatgagactcctgtcccccgtccgcgtgcctaattataacatgatcattatggatgaggcccatttcacggaccccagctctatcgctgcccggggctacattagcacaagagtgggaatgggcgaagctgccgccatctttatgaccgctacccctcccgggtccgtcgaggcgttccctcaatctaatgccgttattcaggatgaggaacgggacatcccggagcgcagctggaactccggatatgaatggatcacagattttcccggcaaaaccgtgtggttcgtgccttctattaagagcgggaatgacatcgctaactgtctgagaaagaatggaaaacgggtcattcagctctcccgcaagacattcgataccgagtaccagaaaacgaagaacaacgactgggactacgtggttacaaccgatatcagcgaaatgggcgccaattttagagccgaccgggtgattgatcccagacgctgccttaaacctgtcatcctgaaggacgggcccgagcgggtgattctggctggcccgatgcctgttacagtggcctctgcggctcaaagacgcggacggatcggcagaaaccacaataaggagggggatcagtatatctacatgggacagcccctcaacaatgacgaagatcatgcccactggaccgaggccaaaatgctgcttgacaacattaatacgcccgaaggcatcattcctgctctgttcgagcccgaacgcgagaagtccgccgcgatcgatggggagtatcggctcagaggagaagcccgcaaaacctttgtcgagctgatgagacggggcgacctgcctgtgtggctcagctacaaggtcgcttccgaagggttccagtattctgatcgcagatggtgctttgacggcgagcggaacaatcaagtgcttgaagagaacatggatgttgagatttggacaaaagaaggagagcgcaagaaactgagaccgcggtggctggacgccagaacctacagcgaccccctcgctctgcgcgagttcaaggagtttgccgctggccggagatccgtgtctggggatcttatcctggaaatcggaaagctccctcagcacctgacacagcgcgcccagaatgcgctggacaacctcgtgatgcttcataatagcgagcaaggcgggcgggcctatagacacgctatggaggaactgcccgataccattgagacactgatgctcctggcccttatcgctgtcctgaccggaggcgttacgctgttctttctgtccggccgggggctgggaaaaacaagcattggcctcctttgtgtgatggcctcttccgtgctgctgtggatggccagcgtcgaacctcattggatcgctgcgtctattatcctcgagttctttctgatggtgcttctgatccccgagccggaccgccagagaacccctcaggataaccagctcgcctacgttgtgattgggctgctgttcatgatcctcaccgtcgctgccaatgaaatgggacttctggagacaaccaagaaagacctgggcattgggcacgtggccgtcgaaaaccaccatcacgctgccatgctcgatgtggacctgcatcccgcgtccgcctggacactttacgctgttgccacgaccatcattacacctatgatgcggcacaccatcgagaacacaaccgctaatattagcctgacggccatcgcgaaccaagccgctatcctcatgggactggataagggctggcccatttctaaaatggacatcggcgtgcctctgctcgcccttgggtgctatagccaggtcaatcccctgaccctgacagctgccgtgctcatgctggttgctcattacgccattatcggaccgggccttcaggcgaaggccacccgcgaagctcaaaagagaacagccgctgggattatgaaaaaccctaccgtggatggaatcgtcgccatcgacctggatcccgtggtgtatgacacgaagtttgagaaacagctcggccagattatgctgctgatcctctgtacatcccagattcttctgatgcggaccacatgggccctgtgcgagtctatcaccctcgcgaccgggcccctgacaacgctttgggaaggaagccctggcaagttctggaataccacaattgctgtttccatggccaacatcttccgcggcagctacctggctggggccggactcgccttttccctgatgaaatctctgggcgggggaagacggggcaccggggctcaaggagagacactcggcgaaaagtggaagcgccagcttaatcagctgagcaaatccgagttcaacacctataagagatctggcatcatggaagtcgaccggagcgaggccaaagaggggctgaagagaggagaaacgacaaaacacgcggtgtcccgcggcaccgccaagctccggtggtttgtggagagaaatctggtcaagccggaagggaaagttattgatcttggatgtggccgcgggggatggtcttactattgcgctggcctgaagaaagtgaccgaggtgaagggctacacaaaagggggacccggccacgaggaacctatccccatggccacctacgggtggaacctcgtcaagctgcatagcggaaaagacgtgttctttattcctcccgagaagtgtgatacactgctctgcgacatcggcgaatccagccctaatccgacgattgaggaagggcggacccttagagttctgaagatggtggagccctggctgcgcggaaaccagttctgtatcaaaattctcaatccttatatgccctctgtcgtggagacactggaacaaatgcagcggaagcacggcggcatgcttgttagaaaccctctgtcccgcaatagcacccatgagatgtactgggtgtcttgcgggacaggaaacatcgtctccgctgtgaatatgaccagccggatgctcctgaacagatttacgatggcccaccgcaaacccacctatgaacgggatgtggacctgggcgcggggacaagacacgtcgccgttgagccggaagtggctaacctcgatatcattggacagcgcatcgagaatattaagcatgagcacaaatctacctggcattacgacgaagataacccttataagacatgggcctaccacggctcctatgaggtgaagcccagcgggtccgctagctctatggtcaatggagtggttaaactgcttaccaagccctgggacgtgatccctatggtcacacagattgccatgaccgatacgacacccttcggccaacagagagtgtttaaagaaaaggttgacacccggacccctaaagctaagcgcggcacagcccagatcatggaggtgacggcgaagtggctgtgggggttcctcagcagaaacaaaaagccgcggatctgtaccagagaagagtttacacggaaagtccgctccaatgccgctattggagccgtgttcgttgacgagaaccaatggaactctgctaaggaagccgtggaggatgaaagattttgggacctggtccatcgggagcgcgaacttcacaaacagggcaagtgcgcgacctgcgtgtacaacatgatggggaagagagagaaaaagctgggagagttcggcaaagcgaaggggagccgggctatctggtacatgtggctcggcgcccgcttcctggaatttgaggccctgggattcatgaatgaagatcactggttttccagagagaactctctcagcggcgtcgagggggaaggactgcataaacttggctatattctgcgggacatctccaagattcccgggggaaatatgtacgctgatgacacagccggctgggatacccgcatcacagaggacgatctccagaacgaagctaaaatcaccgacattatggagcctgaacacgccctgcttgcgaagtctatcttcaagctgacgtatcagaataaagtggttagagtgcaacggcccgccaagaacgggaccgtcatggatgtgattagccgcagagaccagcggggctccggacaggtgggcacatacgggctcaatacctttacaaacatggaggctcagctgatccgccaaatggagagcgaaggaattttctctccttccgagctggaaacccccaacctcgccggcagagttctggattggcttgagaaacatggggtggaacggctgaagagaatggctatcagcggagacgactgtgtcgtgaaaccgatcgatgaccgctttgccacggcgctcacagccctgaatgatatgggcaaggttcggaaggacattcctcagtgggagccctctaaagggtggaacgattggcaacaggtgcctttctgctcccaccactttcatcaacttatcatgaaggacggcagagagattgtcgtgccctgtcgcaatcaggatgaactggtcggacgggctagagtgagccagggcgccgggtggtccctccgcgagaccgcttgcctgggaaaatcttatgcccagatgtggcaactgatgtacttccaccggagagacctccgcctggctgccaacgcgatctgtagcgccgttcctgtggattgggtccccacatcccggaccacgtggagcattcatgctcaccatcagtggatgaccacagaagacatgctttctgtgtggaatagagtttggatcgaggaaaacccgtggatggaggataagacccacatttccagctggggcgacgtgccttatctggggaaacgcgaggaccagtggtgcggatctctcatcggcctgacagcccgggccacctgggctacaaatatccaagtcgccattaaccaggtgagacggcttatcgggaatgaaaactacctggattacatgaccagcatgaagagatttaagaatgagtccgaccccgaaggcgcgctctggtga

SEQ ID NO: 18981 - RNA, 9879 nt, synthetic construct
  misc_feature 1..9879: note = derived and/or modified CDS sequence (opt5) from DENV-1__JQ287661__SS-prME
  source 1..9879: mol_type = other RNA
agcgtgaccatgctgctcatgctgatgcccaccgcccttgctttccacctgacgacccggggcggggagcctcatatgatcgtcaccaagcaggaacggggaaagtccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacgtcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagatgcgcgattcctacacacaggtttgcgaccaccggctgatgagcgcggccattaaagattctaaggctgtgcatgccgacatgggctattggatcgaatccgagaaaaatgaaacctggaaacttgccagagctagcttcatcgaggtgaagacatgtatttggcccaaatctcacaccctctggtccaacggggtcctggaaagcgagatgatcattccgaagatctacggaggccctatttctcaacataattatcgccccgggtacttcacacagaccgccggaccttggcacctgggcaaactcgagctggattttgacctttgcgaagggacgaccgtggttgtggatgagcactgcggaaaccggggccccagcctgagaacaaccacagtcaccggcaagatcatccatgaatggtgttgccggtcctgtacgctccctcccctgcgcttcaaaggggaggacggatgctggtacggcatggagattagaccggtgaaggaaaaggaggaaaatctggttaaaagcatggtgtctgcggggtccggagaggtcgacagcttttcccttggcctcctgtgtatctctattatgatcgaagaggtgatgcggagcagatggtcccgcaagatgctgatgacagggaccctcgctgttttcctgcttctgattatgggacagctcacatggaacgatctgatccggctgtgcattatggtgggcgccaatgcctctgacagaatgggcatggggaccacctatcttgctctgatggccacatttaaaatgcgccctatgttcgcggtcggactcctgtttagacggctcacgagccgcgaggtgctgcttctgaccatcggcctctccctggtggcttctgtcgaactgcccaacagccttgaggaactgggggatggactcgccatgggcatcatgattctgaagctcctgacagacttccaatcccaccagctttgggccaccctgctcagcctgacatttatcaaaaccacgctgtctcttcattacgcttggaagacaatggccatggttctgtccattgtgagcctcatccccctgtgtctctctaccacctcccagaagacaacctggctgcctgtgcttctggggagcctgggatgcaaaccgctcacaatgttcctgattgctgagaataagatctggggcagaaaatcttggccccttaacgaaggcatcatggccgtcggggtggtttccattctgctcagctccctgctcaagaacgatgtgcctctggcgggaccccttatcgccggcgggatgctgattgcttgttatgtcatcagcggatctagcgccgacctgtccctcgagaaagctgccgaggtgtcttgggaagaggaagccgagcacagcggcgcttcccataatattctggttgaagtgcaggatgacgggacgatgaagatcaaagatgaggagcgggacgatacccttacaatcctgctcaaggcgaccctgctcgccgtctctggagtgtaccctctgagcattcccgctacactttttgtctggtatttctggcaaaagaaaaagcagcgctccggcgtgctgtgggacaccccttctcccccggaagttgagagagccgtgctggatgacggcatctaccggattatgcagcgcgggctcctgggaagaagccaggtcggcgtgggggtttttcaagaaaacgtgttccacacgatgtggcacgtcacccggggagccgtgcttatgtatcagggcaaacgcctggagccttcctgggctagcgtgaagaaagacctcatctcttacgggggaggctggagactgcagggctcctggaatacaggggaggaagttcaggtcattgccgtggagcccggaaagaaccctaagaatgtgcaaaccgcgcccggcacattcaaaaccccggaaggggaggtcggagctatcgccctcgattttaagcctggcacaagcgggtctcccattgtgaaccgggaaggaaaaatcgttggcctgtacggcaatggggtggtcacgacctccggaacatatgtgagcgccatcgctcaggccaaggcgtcccaggagggccctcttcccgagattgaagacgaggttttcagaaaacgcaacctgaccatcatggatctgcatcccgggtctggaaagacccggagatacctccctgctattgtgcgcgaagccatcaagcggaaactgagaacacttattctggccccgacgcgcgtcgtggctagcgagatggccgaagctctcaagggcatgcccatccggtatcaaaccacagccgttaaatccgagcacaccgggaaggagatcgtggacctgatgtgccatgcgacatttaccatgagactgctcagccctgtccgcgtgcccaattacaacatgattatcatggatgaagcccacttcacggacccttcttccattgctgcccggggctatatcagcacaagagtgggaatgggcgaggctgccgccatttttatgaccgctacaccccctgggtctgtcgaagcgttcccgcagagcaatgccgttatccaggatgaggaacgggacatccccgagcgctcctggaactctggatacgagtggattacagattttcctggcaaaaccgtgtggttcgtgcccagcatcaagtccgggaatgacattgctaactgtcttagaaagaatggaaaacgggtcatccagctgtctcgcaagacatttgataccgaatatcagaagacgaagaacaacgactgggactacgtggttacaaccgatattagcgagatgggcgccaatttcagagccgaccgggtgatcgatcctagacgctgcctgaaacccgtcattctcaaggacgggccggaacgggtgatcctggctggccctatgcccgttacagtggcctccgcggctcagagacgcggacggatcggcagaaaccataataaggagggggatcagtacatttatatgggacagccccttaacaatgacgaggatcacgcccactggaccgaagccaaaatgctgctcgacaacatcaatacgcctgagggcattatccccgctctgtttgaacctgagcgcgaaaagagcgccgcgattgatggggagtaccggctgagaggagaggcccgcaaaaccttcgtcgaactcatgagacggggcgaccttccggtgtggctgtcttataaggtcgcttccgaggggttccaatacagcgatcgcagatggtgctttgacggcgaacggaacaatcaggtgctggaggaaaacatggatgttgagatctggacaaaagagggagaacgcaagaaactcagaccccggtggctggacgccagaacctattccgaccctcttgctctgcgcgagttcaaggaatttgccgctggccggagatctgtgagcggggatctcatcctggagattggaaagctgccccagcatctcacacagcgcgcccaaaatgcgcttgacaacctggtgatgctgcacaattccgaacagggcgggcgggcctacagacatgctatggaggagctccctgataccatcgaaacactgatgcttctggccctcattgctgtcctgaccggaggcgttacgctgttctttctctctggccgggggcttggaaaaacaagcatcggcctgctgtgtgtgatggcctccagcgtgctcctgtggatggcctctgtcgagccccactggattgctgcgtccatcatccttgagttctttctgatggtgctcctgattccggagcctgaccgccagagaacaccccaggataaccaactggcctatgttgtgatcgggctccttttcatgattctgaccgtcgctgccaatgagatgggactgctcgaaacaaccaagaaagacctgggcatcgggcacgtggccgtcgagaaccatcaccatgctacaatgcttgatgtggacctgcaccctgccagcgcgtggacgctctacgccgttgctaccacaattatcacccccatgatgcggcatacaattgaaaacaccacggccaatatctctctgaccgctatcgccaaccaggcggccattctgatgggactcgataagggctggcctatctccaaaatggacattggcgtgccccttctggctctggggtgctacagccaggtcaatccgctcacactgaccgccgctgtgcttatgctggttgcccactatgctatcattggacctggcctccaagccaaggcgacacgcgaggcccagaagagaaccgctgccgggatcatgaaaaaccccacggtggatggaatcgtcgctattgacctggatcccgtggtgtacgacgccaagtttgaaaaacagctgggccagatcatgctccttattctgtgtacatctcaaatcctgctcatgcggaccacatgggccctgtgcgagagcattacccttgcgaccgggcctctgacaacgctctgggagggatccccgggcaagttctggaataccacaatcgctgtttctatggccaacatctttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatttacaagagaagcggcatcatggaggtcgaccggtccgaagccaaagaggggctgaagagaggagagaccacgcgccacgcggtgtctcggggcacagccaaacttagatggttcgtggaacgcaatctggtcaagcccgaggggaaggttattgatctcggatgtggcagagggggatggagctattactgcgctggcctgaaaaaggtgaccgaagtgaaaggctataccaaagggggacctggccatgaggaacccatccctatggccacatacgggtggaacctggtcaaactccactccggaaaggacgtgttctttacaccccctgagaaatgtgatacacttctgtgcgacattggcgagtctagcccgaatcccacgatcgaagaggggagaaccctgcgcgttctcaagatggtggaaccttggctgcggggaaaccaattctgtattaagatccttaatccctacatgccttccgtcgtggagacactggagcagatgcagagaaaacatggcggcatgctcgttcgcaaccccctgagcagaaattctacccacgaaatgtattgggtgtcctgcgggacaggaaacatcgtcagcgctgtgaatatgacctctagaatgctgctcaaccgctttacgatggcccaccggaagccgacctacgagaaagatgtggacctgggcgcggggacaagacatgtcgccgttgaacctgaggtggctaaccttgatattatcggacagcgcattgaaaatatcaagcacgagcataaatccacctggcactatgacgaggataacccctacaagacatgggcctatcatggcagctacgaagtgaagccctctgggtccgctagctccatggtcaatggagtggttaaactgctcaccaagccttgggacgtgattcccatggtcacacaaatcgccatgaccgatacgacacctttcggccagcagagagtgtttaaagagaaggttgacacccggaccccgaaagctaagcgcggcacagtgcaaatcatggaagtcacggccagatggctgtgggggttccttagccggaacaagaaacccagaatttgtacccgggaggaatttacacgcaaggtgagatctaatgcggccatcggagctgttttcgtggacgagaaccagtggaatagcgccaaagaggctgtcgaagatgagcggttttgggacctggtgaagaaagaacgcgagctccacaagcagggcaagtgcgcgacctgcgtctataacatgatggggaaaagagaaaagaaactgggagagttcggcaaggccaaagggtcccgggcgatttggtacatgtggctgggcgctcgctttctcgagttcgaagccctgggatttatgaatgaggatcactggttctctagagaaaacagcctttccggcgtggagggggagggactgcataagctcggctacatcctgcgggacatttctaaaatccctgggggaaatatgtatgccgatgacacagctggctgggatacccgcatcacagaagacgatcttcagaacgaggccaagattaccgacatcatggaacccgagcacgctctgctcgccacgagcattttcaagctgacctaccaaaataaagttgtgagagtccagcggcctgcgaagaacgggacagtgatggatgtgatctcccgcagagaccagcggggctctggacaggttggcacctatgggctgaatacatttaccaacatggaagcccaactcattcgccagatggagagcgagggaatcttcctgccctccgaacttgagacgccgaacctggctgaaagagtgctcgattggctggagaaatacggcgtcgaacggcttaagagaatggccatcagcggggacgactgtgtggttaaacctattgatgaccgctttgctacagccctgaccgcgctcaatgatatgggaaaggtgcggaaggacatcccccagtgggagccttctaaaggctggaacgattggcagcaagtccccttctgctcccatcactttcaccagctgattatgaaggacgggagagagatcgtggtcccttgtcgcaatcaggatgaactggtgggccgggccagagttagccagggagctggctggtctctccgcgagacagcctgcctggggaaatcctatgctcaaatgtggcagcttatgtacttccatcggagagacctgcgcctcgccgctaacgccatttgtagcgcggtgcccgtcgattgggtgccgacctcccggacgacctggtctatccacgcccatcaccagtggatgacaaccgaagacatgctgagcgtttggaatagagtgtggattgaggaaaacccttggatggaggataagacacatgtctccagctggggagacgtgccctatcttggcaaacgcgaggaccaatggtgcgggtctctgatcggactcaccgctcgggccacatgggcctccaatatccaggtggctattaaccaggttagacggctgatcggcaatgaaaactacctggattacatgaccagcatgaagagatttaagaatgagggggaccccgaaggcgccctctggtga

SEQ ID NO: 18982 - RNA, 9879 nt, synthetic construct
  misc_feature 1..9879: note = derived and/or modified CDS sequence (opt5) from DENV-1__FJ882518__SS-prME
  source 1..9879: mol_type = other RNA
agcgtgaccatgctgctcatgctgatgcccaccgcccttgctttccacctgacgacccggggcggggagcctcatatgatcgtgacaaagcaggaacggggaaaatccctcctgtttaagacctctgccggcgttaatatgtgcacccttattgccatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggccttccacacccgaatgtcctgacgatcagagagcttggaacatttgggaggttgaggactatggattcggcatctttaccacgaatatttggctgaagctgcgcgatagctacacacaggtgtgcgaccaccggcttatgtctgcggccatcaaagattccaaggctgtgcatgccgacatgggctattggattgaaagcgagaaaaacgaaacctggaagctcgccagagcttctttcatcgaggtcaagacatgtatctggcccaaatcccacaccctgtggagcaatggggtgctggaatctgagatgattatcccgaagatttacggaggccctatcagccaacataactatcgccccgggtacttcacacagaccgccggaccttggcacctcggcaaactggagcttgattttgacctgtgcgaagggacgaccgttgtggtcgatgagcactgcggaaatcggggcccctccctcagaacaaccacagtgaccggcaagattatccatgaatggtgttgccggagctgtacgctgcctcccctgcgcttcaaaggggaggacggatgctggtacggcatggagatcagaccggttaaggaaaaggaggaaaaccttgtgaaatctatggtctccgcggggagcggagaggtggactccttttctctcggcctgctgtgtattagcatcatgattgaagaggttatgcggtccagatggtctcgcaagatgctcatgacagggaccctggctgtgttccttctgctcatcatgggacagctgacatggaatgatctgattcggctttgcatcatggtcggcgccaacgccagcgacagaatgggcatggggaccacctatctggctctcatggccacatttaaaatgcgccctatgttcgcggtgggactgctctttagacggctgacgtcccgcgaggtgcttctgctcaccattggcctgtctctggtcgctagcgttgaacttcccaattccctggaggaactcggggatggactggccatgggcatcatgatcctcaagctgcttacagacttccaaagccaccagctgtgggccaccctcctgtctctgacatttattaaaaccacgctttccctgcattacgcttggaagacaatggccatggtgctcagcatcgcttctctgttccccctctgtctgtccaccaccagccagaagacaacctggcttcctgtgctgctggggtctctcggatgcaaaccgctgacaatgtttcttattacggagaccaagatctggggcagaaaatcctggcccctgaacgaaggcattatggccgtcggggtggttagcatcctcctgtccagcctcctgaagaatgatgtgcctcttgcgggacccctgatcgccggcgggatgctgattgcttgttatgtcatctctggaagctccgccgacctctctctggagaaagctgccgaggtgagctgggaagaggaagccgagcactccggcgcttctcataacattcttgttgtggtccaggatgacgggacaatgaagatcaaagatgaggaacgggacgataccctgacaattctcctgaaggcgaccctcctggccgtgagcggagtctaccctctttccatccccgctacgctgttcgtgtggtatttttggcaaaagaaaaagcagcgctctggcgttctgtgggacacccctagccctcccgaggtggaaagagccgtcctcgatgacggcatctaccggattatgcagcgcgggctgcttggaagatcccaggtgggcgttggggtgttccaagagaacgtcttccacacaatgtggcacgtgacccggggagccgtgctgatgtatcagggcaaacgcctcgaacccagctgggcttctgttaagaaagacctgatctcctacgggggaggctggagactccagggcagctggaatacaggggaggaggtccaggtgattgccgtggaacccggaaagaaccctaagaatgtccaaaccgcgcccggcacatttaaaacgccggagggggaagtgggagctatcgccctggatttcaagcctggcacctctgggtcccccattgttaaccgggagggaaaaatcgtgggcctttacggcaatggggtcgtgacaaccagcggaacctatgtttccgccattgctcaggccaaggcgtctcaggaaggccctctgcccgagatcgaggacgaagtgtttagaaaacgcaacctgacaatcatggatctccatcccgggagcggaaagacgcggagatacctgcctgctattgtccgcgaggccatcaagcggaaacttagaaccctgattctcgccccgacacgcgtggttgcttccgaaatggccgaggctctgaagggcatgcccatccggtatcaaaccacagccgtgaaaagcgaacacaccgggaaggagattgtcgacctgatgtgccatgcgacgttcacaatgagactcctttctcctgtgcgcgtgcccaattacaacatgatcatcatggatgaggcccactttaccgacccttccagcattgctgcccggggctatatctctaccagagtcggaatgggcgaagctgccgccattttcatgacagctacaccccctgggagcgttgaggcgtttccgcagtccaatgccgtgatccaggatgaggaacgggacattcccgaacgctcttggaacagcggatacgagtggatcacagatttccctggcaaaaccgtgtggtttgtcccctccatcaagtctgggaatgacattgctaactgtctgagaaagaatggaaaacgggtgatccagctgagccgcaagacgttcgatacagagtatcagaagaccaagaacaatgactgggactacgttgtgacaaccgatatttccgaaatgggcgccaactttagagccgaccgggtcatcgatcctagacgctgcctcaaacccgtgattctgaaggacgggccggagcgggttatccttgctggccctatgcccgtgacggtcgccagcgcggctcagagacgcggacggattggcagaaaccataataaggaaggggatcagtacatctatatgggacagcccctgaacaatgacgaggatcacgcccactggaccgaggccaaaatgctcctggacaacatcaatacacctgaaggcattatccccgctctgttcgagcctgaacgcgagaagtctgccgcgattgatggggaataccggctcagaggagaggcccgcaaaaccttcgtggagcttatgagacggggcgacctgccggtctggctgtcctataaggtggctagcgaagggtttcaatactccgatcgcagatggtgcttcgacggcgagcggaacaatcaggttctcgaagagaacatggatgtggaaatctggacaaaagagggagagcgcaagaaactgagaccccggtggcttgacgccagaacctattctgaccctctggctctccgcgaatttaaggagttcgccgctggccggagaagcgtgtccggggatctgattctggaaatcggaaagctcccccagcatcttacacagcgcgcccaaaatgcgctggacaacctggtcatgctccacaattctgagcagggcgggcgggcctacagacatgctatggaggaactgcctgataccatcgagacgcttatgctgctcgccctgattgctgttctgacaggaggcgtgaccctctttttccttagcggccgggggctgggaaaaacctccatcggcctgctctgtgtgatggccagctctgtcctgctttggatggcctccgtggaaccccactggattgctgcgagcatcattctggagtttttcctcatggttctgctgatcccggaacctgaccgccagagaacaccccaggataaccaactcgcctatgtggtcatcgggcttctgtttatgattctgaccgtggctgccaatgagatgggactcctggagacaacgaagaaagaccttggcatcgggcacgtcgccgtggaaaaccatcaccatgctaccatgctggatgttgacctccaccctgcctctgcgtggacactgtacgccgtggctaccacaattatcacccccatgatgcggcatacgattgagaataccacagccaacatctccctgaccgctattgccaaccaggcggccatcctcatgggacttgataagggctggcctatcagcaaaatggacattggcgtccccctgctggctctcgggtgctactctcaggtgaatccgctgacacttaccgccgctgttctgatgctcgtggcccactatgctatcattggacctggcctgcaagccaaggcgacgcgcgaagcccagaagagaacagctgccgggatcatgaaaaaccccaccgtcgatggaattgtggctatcgacctggatcccgtggtttacgacgccaagttcgagaaacagctcggccagatcatgcttctgattctgtgtacaagccaaatcctcctgatgcggaccacctgggccctttgcgaatccattacactggcgacggggcctctcaccacactgtgggagggatctccgggcaagttttggaataccacaatcgctgtcagcatggccaacattttccgcggctcctatctggctggggccggactcgcctttagccttatgaaatccctgggcgggggaagacggggcaccggggctcagggagagacgctgggcgaaaagtggaagcgccagctcaatcagctgtctaaaagcgagttcaacatctacaagagatccggcatcatggaagtggaccggtctgaggccaaagaagggcttaagagaggagagacaacccgccacgcggtgagccggggcaccgccaaactgagatggttcgtcgagcgcaatctcgttaagcccgaagggaaggtgattgatctgggatgtggcagagggggatggtcctattactgcgctggcctgaaaaaggtgacagaggtcaaaggctataccaaagggggacctggccatgaggagcccatccctatggccacatacgggtggaacctcgtgaaacttcactctggaaaggacgtctttttcacgccccctgaaaaatgtgataccctgctgtgcgacattggcgagagctccccgaatcccacaatcgaggaagggagaaccctccgcgtgctgaagatggtcgagccttggcttcggggaaaccaattttgtattaagatcctgaatccctacatgcctagcgtggttgaaacactcgagcagatgcagagaaaacatggcggcatgctggtgcgcaaccccctgtctagaaattccacccacgagatgtattgggtcagctgcgggacgggaaacattgtgtctgctgtgaatatgacctccagaatgctcctgaaccgcttcacaatggcccaccggaagccgacctacgaaagagatgtcgaccttggcgcggggacacgccatgttgccgtggagcctgaagtggctaatctggatatcatcggacagagaattgagaacatcaaacacgaacataagagcacctggcactatgacgaggataacccctacaaaacatgggcctatcatggctcttacgaggtcaagccctccgggagcgcttccagcatggtgaatggagttgtgaagctcctgaccaaaccttgggacgtcattcccatggtgacgcaaatcgccatgacagataccaccccttttggccagcagcgggttttcaaggaaaaagtggacacacgcacgccgaaggctaaaagaggcaccgcccaaattatggaggtcacagcgcggtggctttgggggtttctgtctagaaacaagaagccccggatctgtacccgcgaagagttcacaagaaaagtgcggagcaatgccgctatcggagccgtttttgtggacgaaaaccagtggaactccgctaaggaggccgtcgaggatgaacgcttctgggacctcgtgcagaaagagagagaactgcacaagcagggcaaatgcgcgacctgcgtctataacatgatggggaagcgggagaagaaactgggagaatttggcaaggcgaaagggtctcgcgctatttggtacatgtggctcggcgccagattcctggagtttgaggcccttggattcatgaatgaagatcactggttcagccgggagaactccctgtctggcgtggaaggggagggactccataagctgggctacatccttcgcgacattagcaaaatccctgggggaaatatgtatgctgatgacacagccggctgggataccagaattacggaggacgatctgcaaaacgaagctaagatcaccgacatcatggagcccgaacacgccctcctggcgacatccatttttaaactgacctaccagaataaggttgtgcgggtccagcgccctgccaagaacgggacagtgatggatgtgatctctagacgggaccagcgcggcagcggacaagttggcacctatgggctcaatacgttcacaaacatggaggctcagctgattagacagatggaatccgagggaatctttcttcccagcgagctggaaaccccgaatctcgccgagcgggtgctggattggcttgaaaaatacggcgtcgagagactgaagcgcatggctatttctggggacgactgtgtggttaaacctatcgatgaccggttcgccacagcgctcaccgccctgaacgatatgggaaaggtgagaaaagacatcccccagtgggaaccttccaagggctggaacgattggcaacaggtccccttttgcagccatcacttccaccagctgattatgaaggacgggcgcgagatcgtggtcccttgtcggaatcaggatgagctcgtgggcagagctcgcgtttctcaaggagccggctggtccctgcgggaaacggcttgccttgggaaaagctatgcccagatgtggcagctgatgtactttcatagacgcgacctccggctggctgccaacgcgatttgttccgccgtgcccgtcgattgggtgccgacctctagaacaacctggagcatccacgctcatcaccaatggatgacaaccgaggacatgctttccgtttggaatcgcgtgtggattgaagagaacccttggatggaagataagacacatgtcagctcttggggagacgtgccctatctgggcaaacgggaggaccagtggtgcgggtccctcatcggactgaccgccagagccacgtgggctagcaatattcaggtggccatcaaccaggttcggagactgatcggcaatgagaactacctcgattacatgacatctatgaagcgcttcaaaaatgaaggggaccccgagggcgcgctgtggtga

SEQ ID NO: 18983 - RNA, 9879 nt, synthetic construct
  misc_feature 1..9879: note = derived and/or modified CDS sequence (opt5) from DENV-1__FJ882519__SS-prME
  source 1..9879: mol_type = other RNA
agcgtgacaatgctgctgatgctgatgcccacagcccttgctttccacctgacgaccagaggaggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggacaatgaaaatcaaggatgaggagcgggacgatacgctcaccatcctgcttaaggccacactgctcgctgtgagcggagtctatcctctgtccattcccgccaccctcttcgtgtggtacttttggcagaaaaagaaacaacgctctggcgtcctgtgggacacaccttcccctcccgaagtggagagagccgttcttgatgacggcatctatcggattatgcagcgcgggctgctgggaagatcccaggtgggcgtcggggtgttccaggaaaacgtttttcataccatgtggcacgtgacgcggggagctgtcctcatgtaccaaggcaagcgcctggagcccagctgggcctctgtgaaaaaggaccttatctcctacgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacctccgggagccctattgtcaaccgggaaggaaagatcgtgggcctgtatggcaatggggttgtgacaacgtccggaacctacgtctctgctatcgcccaagcgaaagctagccaggagggccccctccctgagattgaagacgaggtgttcagaaagcgcaacctgacaatcatggatcttcaccccgggtccggaaagacccggagatatctgcccgccattgttcgcgaagccatcaaacggaagctgagaaccctcattctggctcctacacgcgtggtcgccagcgagatggctgaagcccttaaaggcatgccgatccggtaccagacgaccgcggtgaagtctgagcatacagggaaagagatcgttgacctgatgtgccacgccacctttacaatgagactcctgtcccccgtgcgcgtccctaattataacatgattatcatggatgaagctcatttcaccgaccccagctctattgccgctcggggctacatcagcacgagagtgggaatgggcgaggccgccgctatttttatgacagcgacccctcccgggtccgtggaagccttccctcaatctaatgctgtcatccaggatgaggaacgggacatcccggagcgcagctggaactccggatatgagtggattaccgattttcccggcaagacagtttggttcgtgccttctatcaagagcgggaatgacattgccaactgtctgcgcaagaatggaaagcgggtgatccagctctcccgcaaaaccttcgatacagaataccagaagaccaaaaacaacgactgggactacgtcgtgacgacagatattagcgagatgggcgccaattttagagctgaccgggttatcgatcccagacgctgccttaagcctgtgattctgaaggacgggcccgaacgggtcatcctggccggcccgatgcctgtgaccgttgcgtctgctgcccaaagacgcggacggatcggcagaaaccacaataaagagggggatcagtatatttacatgggacagcccctcaacaatgacgaggatcatgcccactggacagaagctaagatgctgcttgacaacatcaatacccccgagggcattatccctgccctgttcgaacccgagcgcgaaaaatccgcggccattgatggggagtatcggctcagaggagaggctcgcaagacgtttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatctggaccaaggagggagaacgcaaaaagctgagaccgcggtggctggacgctagaacatacagcgaccccctcgccctgcgcgagttcaaggaatttgctgccggccggagatccgtttctggggatcttatcctggagattggaaaactccctcagcacctgacccagcgcgcgcagaatgccctggacaacctcgtgatgcttcataatagcgaacaaggcgggcgggcttatagacacgccatggaggagctgcccgatacaatcgaaaccctgatgctcctggctcttattgccgtgctgacaggaggcgtcaccctcttctttctgtccggccgggggctgggaaagacgagcatcggcctcctttgtgttatggcctcttccgtgctgctgtggatggctagcgtggagcctcattggattgcggcctctatcatcctcgagttctttctgatggtccttctgattcccgagccggaccgccagagaacacctcaggataaccagctcgcttacgtggttatcgggctgctgttcatgattctcaccgtggccgccaatgagatgggacttctggaaaccaccaagaaggacctgggcatcgggcacgtcgctgtggagaaccaccatcacgccgcgatgctcgatgtcgacctgcatcccgcctccgcttggaccctttacgccgtggctacaacgattatcacccctatgatgcggcacacaattgaaaacaccacagccaatatcagcctgaccgcgatcgccaaccaagctgccattctcatgggactggataaaggctggcccatctctaagatggacattggcgttcctctgctcgctcttgggtgctatagccaggtgaatcccctgacgctgaccgccgctgtcctcatgctggtggcccattacgcgatcattggaccgggccttcaggccaaggctacacgcgaggcccagaaaagaaccgctgccgggatcatgaagaaccctacagttgatggaatcgtggccattgacctggatcccgtcgtgtatgacgcgaaatttgaaaagcagctcggccagatcatgctgctgattctctgtacctcccagatccttctgatgcggacgacatgggctctgtgcgagtctattaccctcgccacagggcccctgaccaccctttgggagggaagccctggcaaattctggaatacaacgatcgctgtgtccatggccaacatcttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcattatggaggttgaccggagcgaagccaaggaggggctgaaaagaggagagacaaccaagcacgctgtctcccgcggcacggccaagctccggtggtttgtggaaagaaatctggtgaaaccggaggggaaggtcatcgatcttggatgtggccgcgggggatggtcttactattgcgctggcctgaaaaaggttacagaagtgaaaggctacaccaaagggggacccggccacgaggaacctattcccatggccacctacgggtggaacctcgtgaaactgcatagcggaaaggacgtcttctttatccctcccgagaagtgtgatacactgctctgcgacattggcgagtccagccctaatccgaccatcgaagaggggcggacacttagagtgctgaaaatggttgaaccctggctgcgcggaaaccagttctgtattaagatcctcaatccttatatgccctctgtggtcgagacgctggagcaaatgcagcggagacacggcggcatgcttgtgcgcaaccctctgtcccggaatagcacccatgaaatgtactgggtttcttgcgggacaggaaacatcgtgtccgcggtcaatatgaccagcagaatgctcctgaaccgctttacaatggcccaccggaaacccacctatgagagagatgtggacctgggcgctgggacgcgccacgtggccgtcgaaccggaggttgctaacctcgatattatcggacagagaattgaaaatatcaagcatgagcacaaatctacctggcattacgacgaggataacccttataagacatgggcctaccacggctcctatgaagtgaagcccagcgggtccgctagctctatggtgaatggagtcgtgaaactgcttaccaagccctgggacgttattcctatggtgacacagatcgccatgaccgatacaacccccttcggccaacagcgggtctttaaagagaaggtggacacgcgcacacctaaagcgaagagaggcaccgcccagatcatggaagttaccgctaagtggctgtgggggttcctcagccggaacaaaaagccgagaatttgtacacgggaggaatttacgcgcaaagtgagatccaatgccgctatcggagccgtcttcgtggacgagaaccaatggaactctgccaaggaggcggttgaagatgagcggttttgggacctggtgcatcgcgaaagagagcttcacaaacagggcaagtgcgctacctgcgtctacaacatgatggggaagcgggagaaaaagctgggagagttcggcaaagccaaggggagccgcgccatttggtacatgtggctcggcgctagattcctggagtttgaagccctgggattcatgaatgaggatcactggttttcccgggaaaactctctcagcggcgtggagggggagggactgcataaacttggctatatcctgcgcgacatttccaagatccccgggggaaatatgtacgctgatgacacagccggctgggataccagaatcacagaagacgatctccagaacgaggcgaaaattaccgacatcatggaacctgagcacgccctgcttgctaagtctattttcaagctgacatatcagaataaagtcgtgcgggttcaacgccccgccaagaacgggaccgtgatggatgtcatcagcagacgggaccagcgcggctccggacaggtgggcacgtacgggctcaatacctttacaaacatggaagctcagctgattagacaaatggagagcgagggaatcttctctccttccgaactggagacccccaacctcgccggccgggtgctggattggcttgaaaaacatggggttgagagactgaagcgcatggcgatcagcggagacgactgtgtggtcaaaccgattgatgaccggtttgccacagctctcaccgccctgaatgatatgggcaaggtgagaaaggacatccctcagtgggaaccctctaaagggtggaacgattggcagcaggttcctttctgctcccaccactttcatcaacttattatgaaggacggccgcgagatcgtggtcccctgtcggaatcaggatgagctggtgggcagagctcgcgtcagccagggcgccgggtggtccctccgggaaacggcttgcctgggaaaatcttatgcccagatgtggcaactgatgtacttccacagacgcgacctccggctggcggccaacgctatttgtagcgccgtgcctgttgattgggtgcccacatccagaaccacatggagcatccatgcccaccatcagtggatgaccacggaggacatgctttctgtctggaatcgcgtgtggattgaagagaacccgtggatggaagataagacccacatctccagctggggcgacgttccttatctggggaaacgggaggaccagtggtgcggatctctcatcggcctgacagctagagccacctgggcgacaaatattcaagtggctatcaaccaggtccggagacttattgggaatgagaactacctggattacatgaccagcatgaagcgctttaagaatgaatccgaccccgagggcgccctctggtga

SEQ ID NO: 18984 - RNA, 9879 nt, synthetic construct
  misc_feature 1..9879: note = derived and/or modified CDS sequence (opt5) from DENV-1__FJ882520__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacgagcgccggcgttaatatgtgcacccttatcgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggccgcgggctcggaaagacgagcatcggccttctgtgtgtgatggcttcttccgccctgctctggatggccagcgtcgagccccattggattgctgcgtctatcatcctggagttctttcttatggtgctgctcattccggagcctgacagacagcggacaccccaggataaccaactggcctacgttgtgatcgggctcctgttcatgattcttaccgtcgctgccaatgagatgggactgctggaaaccaccaagaaggacctcggcatcgggcacgtggccgtcgagaaccaccatcacgctaccatgctggatgtggaccttcatcctgcctccgcgtggacactgtacgccgttgctacgaccattatcacacccatgatgcgccacaccattgaaaacacaaccgccaatatcagcctcacggctatcgccaaccaggcggccattctgatgggactggataaaggctggcctatctctaagatggacattggcgtgcccctccttgctctggggtgctatagccaggtcaatccgctgaccctcacagccgctgtgctgatgcttgttgcccattacgctatcattggacctggcctgcaagccaaagcgaccagagaggcccagaagcggacagctgccgggatcatgaagaaccccaccgtggatggaatcgtcgctattgacctcgatcccgtggtgtatgacgccaaatttgaaaagcagctgggccagatcatgctgctcattctttgtacgtcccaaatcctgctgatgcgcacaacctgggccctctgcgagtctattacactggcgaccgggcctcttaccacactgtgggagggaagcccgggcaaattctggaatacgaccatcgctgtttccatggccaacatctttagaggcagctacctcgctggggccggactggccttctccctgatgaagtctctcggcgggggacggcgcggcacaggggctcagggagaaacccttggcgagaaatggaagagacagctgaatcagctgagcaagtccgagttcaacacatataaacggtctggcattatggaggtcgacagaagcgaagccaaggaggggctccgccggggagagaccacgaaacacgcggtgtccagaggcacagccaagctgcgctggtttgtggaacggaatcttgtcaaacccgaggggaaggttatcgatctgggatgtggcagagggggatggtcttactattgcgctggcctcaagaaagtgaccgaagtgaagggctacaccaaagggggacctggccacgaggaacccattcctatggccacatacgggtggaacctggtcaagctgcatagcggaaaagacgtgttctttattccccctgagaagtgtgataccctcctttgcgacattggcgagtccagcccgaatcccacaatcgaagaggggcgcacgctgcgggttctgaaaatggtggaaccttggctcagaggaaaccaattctgtattaagatcctgaatccctatatgccttctgtcgtggagacccttgagcagatgcagcgcaagcacggcggcatgctggttcggaaccccctctccagaaatagcacacatgaaatgtactgggtgtcttgcgggaccggaaacatcgtctccgctgtgaatatgacaagccgcatgctgctgaaccggtttaccatggcccacagaaaaccgacgtatgagcgcgatgtggacctcggcgcggggaccagacacgtcgccgttgaacctgaggtggctaacctggatattatcggacagcggattgaaaatatcaagcatgagcacaaatctacatggcattacgacgaggataacccctataagacctgggcctaccacggctcctatgaagtgaaacccagcgggtccgctagctctatggtcaatggagtggttaaacttctgacaaagccttgggacgtgattcccatggtcacccaaatcgccatgacagataccacgcctttcggccagcagcgcgtgtttaaagagaaggttgacacaagaaccccgaaagctaagcggggcaccgcccaaatcatggaagtgacagcgagatggctctgggggttcctgagccggaacaaaaagccccgcatttgtacgagagaggaatttacccggaaggtccgctccaatgccgctatcggagccgtgttcgttgacgagaaccagtggaactctgctaaagaggccgtggaagatgagagattttgggaccttgtccatcgggaacgcgagctgcacaagcagggcaaatgcgccacatgcgtgtacaacatgatggggaagagagagaagaagctcggagagttcggcaaggcgaaagggagccgggctatttggtacatgtggctgggcgcccgctttctggagttcgaagccctcggattcatgaatgaggatcactggttttccagagaaaactctctgagcggcgtcgagggggagggacttcataagctgggctatatcctccgggacatttccaaaatccctgggggaaatatgtacgctgatgacaccgccggctgggatacacgcatcaccgaagacgatctgcagaacgaggctaagattacagacatcatggaacccgagcacgcccttctggcgacctctattttcaaactcacgtatcaaaataaggtggttagagtgcagcggcctgcccgcaacgggaccgtcatggatgtgatcagcagacgggaccagagaggctccggacaggtgggcacatacgggctgaatacctttacaaacatggaagctcaactgattcgccagatggagagcgagggaatcttctctccctccgaactcgagaccccgaacctggccgaacgggttcttgattggctggagaaacatggcgtggaaagactcaagcgcatggctatcagcggggacgactgtgtcgtgaagcctattgatgaccggtttgccacggcgctgtctgcccttaatgatatgggaaaagttagaaaggacatcccccagtgggagccttccaaaggctggaacgattggcagcaagtgcccttctgcagccaccactttcatcagctgattatgaaggacgggcgcgagatcgtcgtgccttgtcggaatcaggatgaactcgtcggcagagctcgcgtgtcccagggagccggctggtctctgcgggagacagcttgcctggggaaaagctatgcccaaatgtggcagctcatgtacttccacagacgcgacctgcggcttgctgccaacgcgatttgttccgccgttcccgtggattgggtcccgaccagcagaacaacctggtctatccatgctcaccatcagtggatgacgaccgaagacatgctgtccgtgtggaatcgggtttggattgaggaaaacccttggatggaggataagacacacatcagctcttggggagacgtgccctatctcggcaagagagaggaccaatggtgcgggagcctgatcggacttaccgcccgcgccacatgggctaccaatattcaggtcgccatcaaccaggtgcggagactgattggcaatgaaaactacctcgattacatgacatccatgaaacgctttaagaatgagtctgaccccgaaggggcgctgtggtga

SEQ ID NO: 18985 - RNA, 9879 nt, synthetic construct
  misc_feature 1..9879: note = derived and/or modified CDS sequence (opt5) from DENV-1__FJ882523__SS-prME
  source 1..9879: mol_type = other RNA
agcgtgaccatgctgctcatgctgatgcccaccgcccttgctttccacctgacgacccggggaggggagcctcatatgattgtcaccaagcaggaacggggaaagtccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacgaggaaaaacctgtcaacatcgaggccgagccgccctttggcgaaagctatattgtgatcggggccggagagaaggctcttaaactctcttggttcaagaagggcagctccattgggaaaatgtttgaagccacagctagaggcgcccgccggatggcgatcctgggagataccgcctgggacttcggctctatcgggggagtgtttacaagcgttggcaagctggtccatcagattttcgggaccgcttacggagtgctcttttccggcgtgagctggacgatgaaaatcgggattggcgtcctgcttacctggctgggactcaattctagatccacaagcctgtctatgacctgtatcgccgtgggcctggttacactttacctcggggtgatggtccaggctgattccggatgcgtgattaactggaagggccgcgagctgaaatgtgggagcggaatcttcgttaccaatgaagtgcacacatggaccgagcaatataagtttcaggccgactcccctaagcggctgtctgcggccattggcaaggcttgggaggaaggggtctgcggcatcagaagcgccacgcgcctcgagaacatcatgtggaagcagatttccaacgaactgaatcatatccttctggagaacgacatgaaattcacagtggttgtgggagatgtcgtgggcattctcgctcaggggaagaaaatgatccggccgcaacccatggaacacaagtactcttggaaaagctggggaaaggccaagattatcggcgccgacgtgcagaataccacctttatcattgatgggcctaacacacccgagtgtcctgacgatcagagagcttggaatatctgggaggtcgaagactatggattcggcatttttaccacgaacatctggctgaaactgcgcgattcctacacacaggtttgcgaccaccggcttatgagcgcggccattaaggattctaaagctgtgcatgccgacatgggctattggatcgagtccgaaaagaatgagacctggaaactcgccagagctagcttcatcgaagtgaagacatgtatttggcccaagtctcacaccctgtggtccaacggggtcctggagagcgagatgatcattccgaaaatctacggaggccctatttctcaacataattatcgccccgggtacttcacacagaccgccggaccttggcacctcggcaagctggaacttgattttgacctgtgcgaggggacgaccgtggttgtggatgaacactgcggaaaccggggccccagcctcagaacaaccacagtcaccggcaaaatcatccatgagtggtgttgccggtcctgtacgctgcctcccctgcgcttcaagggggaggacggatgctggtacggcatggaaattagaccggtgaaagagaaggaagagaatcttgttaagagcatggtgtctgcggggtccggagaagtcgacagcttttccctcggcctgctgtgtatctctattatgatcgaggaggtgatgcggagcagatggtcccgcaaaatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaagatgcgccctatgttcgcggtcggactgctctttagacggctgacgagccgcgaagtgcttctgctcaccatcggcctgtccctggtggcttctgtcgagcttcccaacagcctggaggaactcggggatggactggccatgggcatcatgattctcaaactgcttacagacttccaatcccaccagctgtgggccaccctcctgagcctgacatttatcaagaccacgctttctctgcattacgcttggaaaacaatggccatggttctctccattgtgagcctgttccccctctgtctgtctaccacctcccagaagacaacctggcttcctgtgctgctggggagcctcggatgcaagccgctgacaatgtttcttatcgctgaaaataaaatttggggcagaaagtcttggcccctgaacgagggcatcatggccgtcggggtggtttccatcctcctgagctccctcctgaaaaacgatgtgcctcttgcgggacccctgattgccggcgggatgctgatcgcttgttatgtcattagcggatctagcgccgacctctccctggagaaggctgccgaagtgtcttgggaggaagaggccgaacacagcggcgcttcccataatatccttgttgaggtgcaggatgacgggacgatgaaaattaaggatgaggaacgggacgataccctgacaatcctcctgaaagcgaccctcctggccgtctctggagtgtaccctcttagcatccccgctacactgttcgtctggtatttttggcaaaagaagaaacagcgctccggcgtgctgtgggacaccccttctcccccggaggttgaaagagccgtgctcgatgacggcatttaccggatcatgcagcgcgggctgcttggaagaagccaggtcggcgtgggggttttccaagagaacgtgttccacacgatgtggcacgtcacccggggagccgtgctgatgtatcagggcaagcgcctcgagccttcctgggctagcgtgaaaaaggacctgatttcttacgggggaggctggagactccagggctcctggaatacaggggaagaggttcaggtcatcgccgtggaacccggcaagaaccctaagaatgtgcaaaccgcgcccggcacatttaagaccccggagggggaagtcggagctattgccctggatttcaaacctggcacaagcgggtctcccatcgtgaaccgggagggaaagattgttggcctttacggcaatggggtggtcacgacctccggaacatatgtgagcgccatcgctcaggccaaagcgtcccaggagggccctctgcccgaaatcgaggacgaagtttttagaaagcgcaacctgaccattatggatctccatcccgggtctggaaaaacccggagatacctgcctgctatcgtgcgcgaggccattaagcggaaacttagaacactgatcctcgccccgacgcgcgtcgtggctagcgaaatggccgaggctctgaaaggcatgcccattcggtatcaaaccacagccgttaagtccgagcacaccgggaaagaaatcgtggacctgatgtgccatgcgacattcaccatgagactccttagccctgtccgcgtgcccaattacaacatgatcattatggatgaggcccactttacggacccttcttccatcgctgcccggggctatattagcacaagagtgggaatgggcgaagctgccgccatcttcatgaccgctacaccccctgggtctgtcgaggcgtttccgcagagcaatgccgttattcaggatgaggaacgggacatccccgagcgctcctggaactctggatacgaatggatcacagatttccctggcaagaccgtgtggtttgtgcccagcattaaatccgggaatgacatcgctaactgtctgagaaagaatggaaagcgggtcattcagctgtctcgcaaaacattcgataccgagtatcaaaagacgaaaaacaacgactgggactacgtggttacaaccgatatcagcgaaatgggcgccaattttagagccgaccgggtgattgatcctagacgctgcctcaagcccgtcatcctgaaagacgggccggagcgggtgattcttgctggccctatgcccgttacagtggcctccgcggctcagagacgcggacggatcggcagaaaccataataaggagggggatcagtacatctatatgggacagcccctgaacaatgacgaagatcacgcccactggaccgaggccaagatgctcctggacaacattaatacgcctgaaggcatcattcccgctctgttcgagcctgaacgcgagaaaagcgccgcgatcgatggggagtaccggctcagaggagaagcccgcaagaccttcgtcgagcttatgagacggggcgacctgccggtgtggctgtcttataaagtcgcttccgaagggtttcaatacagcgatcgcagatggtgcttcgacggcgagcggaacaatcaggtgctcgaagagaacatggatgttgagatttggacaaaggaaggagagcgcaaaaagctgagaccccggtggcttgacgccagaacctattccgaccctctggctctccgcgaatttaaagagttcgccgctggccggagatctgtgagcggggatctgatcctggaaatcggaaagctcccccagcatcttacacagcgcgcccaaaatgcgctggacaacctggtgatgctccacaattccgagcagggcgggcgggcctacagacatgctatggaggaactgcctgataccattgagacacttatgctgctcgccctgatcgctgtcctgaccggaggcgttacgctctttttcctttctggccgggggctgggaaagacaagcattggcctgctctgtgtgatggcctccagcgtgctgctttggatggcctctgtcgaaccccactggatcgctgcgtccattatcctggagtttttcctcatggtgctgctgatcccggagcctgaccgccagagaacaccccaggataaccaactcgcctatgttgtgattgggcttctgtttatgatcctgaccgtcgctgccaatgaaatgggactcctggagacaaccaaaaaggaccttggcattgggcacgtggccgtcgaaaaccatcaccatgctacaatgctggatgtggacctccaccctgccagcgcgtggacgctgtacgccgttgctaccacaatcattacccccatgatgcggcatacaatcgagaacaccacggccaatatttctctgaccgctatcgccaaccaggcggccatcctcatgggacttgataaaggctggcctatttccaagatggacatcggcgtgcccctgctggctctcgggtgctacagccaggtcaatccgctgacacttaccgccgctgtgctgatgctcgttgcccactatgctattatcggacctggcctgcaagccaaagcgacacgcgaagcccagaagagaaccgctgccgggattatgaagaaccccacggtggatggaatcgtcgctatcgacctggatcccgtggtgtacgacgccaaattcgagaagcagctcggccagattatgcttctgatcctgtgtacatctcaaattctcctgatgcggaccacatgggccctttgcgagagcatcaccctggcgaccgggcctctcacaacgctgtgggaaggatccccgggcaaattttggaataccacaattgctgtttctatggccaacatcttccgcggcagctatctggctggggccggactcgccttttcccttatgaaaagcctgggcgggggaagacggggcaccggggctcagggagagacactgggcgaaaaatggaagcgccagctcaatcagctgtccaagtctgagttcaacatctacaaaagaagcggcattatggaagtcgaccggtccgaggccaaggaggggcttaaaagaggagaaaccacgcgccacgcggtgtctcggggcacagccaagctgagatggttcgtggagcgcaatctcgtcaaacccgaagggaaggttatcgatctgggatgtggcagaggcgggtggagctattactgcgctgggctgaagaaagtgaccgaggtgaagggctataccaaagggggacctggccatgaggaacccattcctatggccacatacgggtggaacctcgtcaaacttcactccggaaaagacgtgtttttcacaccccctgagaagtgtgatacactgctgtgcgacatcggcgaatctagcccgaatcccacgattgaggaagggagaaccctccgcgttctgaaaatggtggagccttggcttcggggaaaccaattttgtatcaagattctgaatccctacatgccttccgtcgtggagacactcgaacagatgcagagaaagcatggcggcatgctggttcgcaaccccctgagcagaaattctacccacgagatgtattgggtgtcctgcgggacaggaaacatcgtcagcgctgtgaatatgacctctagaatgctcctgaaccgcttcacgatggcccaccggaaaccgacctacgaaagagatgtggaccttggcgcggggacacgccatgtcgccgttgagcctgaagtggctaacctggatatcattggacagagaatcgagaatattaagcacgagcataaatccacctggcactatgacgaagataacccctacaagacatgggcctatcatggcagctacgaggtgaaaccctctgggtccgctagctccatggtcaatggagtggttaagctcctgaccaagccttgggacgtgatccccatggtcacacaaattgccatgaccgatacgacaccttttggccagcagcgggtgttcaaagaaaaggttgacacccgcaccccgaaagctaagagaggcacagcccaaatcatggaggtgacggcgcggtggctttgggggtttctgagcagaaacaaaaagccccggatctgtacccgcgaagagttcacaagaaaggtccggtctaatgccgctattggagccgtgtttgttgacgagaaccagtggaatagcgctaaagaagccgtggaggatgaacgcttctgggacctcgtccagaaggagagagaactgcacaaacagggcaagtgcgcgacctgcgtgtataacatgatggggaaacgggagaagaagctgggagagtttggcaaagcgaaggggtcccgcgctatctggtacatgtggctcggcgccagattcctggaatttgaggcccttggattcatgaatgaagatcactggttctctcgggagaacagcctgtccggcgtcgagggggaaggactccataaactgggctacattcttcgcgacatctctaagattcctgggggaaatatgtatgctgatgacacagccggctgggataccagaatcacagaggacgatctgcaaaacgaagctaaaatcaccgacattatggagcccgaacacgccctcctggcgacgagcatctttaagctgacctaccagaataaagtggttcgggtgcagcgccctgccaagaacgggacagtcatggatgtgatttccagacgggaccagcgcggctctggacaagtgggcacctatgggctcaatacattcaccaacatggaggctcagctgatcagacagatggagagcgaaggaatcttttcccccagcgagcttgaaatcccgaacctggccgagcgggttctcgattggctggaaaagtacggcgtggagagacttaaacgcatggctatctctggggacgactgtgtcgtgaagcctattgatgaccggttcgccacggcgctgacagccctcaatgatatgggaaaagttagaaaggacgtgccccagtgggagccttccaaaggctggaacgattggcaacaggtccccttttgcagccatcacttccaccagctgatcatgaaggacgggcgcgaaattgtggtcccttgtcggaatcaggatgagctggtgggcagagctcgcgtttctcaaggagccggctggtccctccgggaaaccgcttgcctgggaaagagctatgcccagatgtggcagcttatgtactttcatagacgcgacctgcggctcgctgccaacgcgatctgttccgccgtgcccgtcgattgggtgccgacatctagaaccacgtggagcattcacgctcatcaccaatggatgaccacagaggacatgctgtccgtttggaatcgcgtgtggatcgaagagaacccttggatggaggataaaacccatgtcagctcttggggagacgtgccctatcttggcaagcgggaagaccagtggtgcgggtccctgattggactcacagccagagccacctgggctagcaatatccaggtggccatcaaccaggttcggagactgattggcaatgagaactacctggattacatgacatctatgaaacgcttcaagaatgaaggggaccccgagggcgcgctctggtga

SEQ ID NO: 18986 - RNA, 9879 nt, synthetic construct
  misc_feature 1..9879: note = derived and/or modified CDS sequence (opt5) from DENV-1__FJ882524__SS-prME
  source 1..9879: mol_type = other RNA
agcgtgaccatgctgctcatgctgatgcccaccgcccttgctttccacctgacgacccggggcggggagcctcatatgatcgtgaccaagcaggaacggggaaaatccctcctgtttaagacctctgccggcgttaacatgtgcacccttattgcgatggacctgggggagctctgtgaagataccatgacgtacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaactacgtgtgccggcgcaccttcgtggatagaggctggggcaatgggtgtggactctttggcaaagggagcctgattacatgcgccaagttcaagtgcgtcacgaaacttgagggaaagatcgtgcagtatgaaaacctgaaatactctgttatcgtgaccgtccacacaggcgaccagcatcaagtggggaatgagtccaccgaacacggaacaaccgctacgattacaccccaggcccctacaagcgagatccagctcaccgactatggcgccctgacactggattgttctccccggaccggcctcgactttaacgaaatggttctgcttacgatgaaggagaaatcctggctggtgcataagcagtggttcctcgatctgcctcttccctggacaagcggggcttccacctctcaagagacatggaatcgccaggacctgctcgtcacctttaaaaccgcgcacgccaagaagcaggaagtggtcgtgctgggaagccaagagggcgctatgcacacagccctgacgggggccaccgaaattcagacatccggaaccacaaccatcttcgctggccatctcaaatgcagactgaagatggataaacttacgctgaaggggatgagctacgttatgtgtacaggctcttttaaactcgagaaggaagtggccgagacccagcacggaaccgtcctggtgcagattaagtatgagggcacagacgcgccgtgcaaaatccctttctccacccaagatgaaaagggggttacacagaacggacggctgatcacggctaatcccattgtgaccgacaaagagaagcctgtcaacatcgaagccgagccgcccttcggcgagagctacattgtgatcggggccggagaaaaagctcttaagctctcttggtttaagaaaggcagctccattgggaagatgttcgaggccacagctagaggcgcccgccggatggcgatcctgggagataccgcctgggactttggctctatcgggggagtgttcacaagcgttggcaaactggtccatcagatttttgggaccgcttacggagtcctgttctccggcgtgagctggacgatgaagatcgggattggcgtcctgcttacctggctgggactcaattctagatccacaagcctgtctatgacctgtatcgccgtgggcctggttacactttatctcggggtgatggtccaggctgattccggatgcgtgattaactggaaaggccgcgaactgaagtgtgggagcggaatctttgttaccaatgaggtgcacacatggaccgaacaatacaagttccaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagtttacagtggttgtgggagatgtcgtgggcattctcgctcaggggaaaaagatgatccggccgcaacccatggagcacaaatattcttggaaaagctggggaaaggccaagattatcggcgccgacgtgcagaataccaccttcatcattgatgggcctaacacacccgaatgtcctgacgatcagagagcttggaatatctgggaggtcgaggactacggatttggcattttcaccacgaacatctggctgaagctgcgcgattcctatacacaggtttgcgaccaccggcttatgagcgcggccattaaagattctaaggctgtgcatgccgacatgggctactggatcgaatccgagaaaaatgaaacctggaagctcgccagagctagctttatcgaggtgaagacatgtatttggcccaaatctcacaccctgtggtccaacggggtcctggaaagcgagatgatcattccgaagatctatggaggccctatttctcaacataattaccgccccgggtacttcacacagaccgccggaccttggcacctcggcaaactggagcttgatttcgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgctttaaaggggaggacggatgctggtatggcatggagattagaccggtgaaggaaaaggaggaaaatcttgttaaaagcatggtgtctgcggggtccggagaggtcgacagcttctccctcggcctgctgtgtatctctattatgatcgaagaggtgatgcggagcagatggtcccgcaagatgctcatgacagggaccctggctgtttttcttctgctcattatgggacagctgacatggaacgatctgatccggctttgcattatggtgggcgccaatgcctctgacagaatgggcatggggaccacctacctggctctcatggccacattcaaaatgcgccctatgtttgcggtcggactcctcttcagacggctgacgagccgcgaggtgcttctgctcaccatcggcctgtccctggtggcttctgtcgaacttcccaacagcctggaggaactcggggatggactggccatgggcatcatgattctcaagctgcttacagactttcaatcccaccagctgtgggccaccctcctgagcctgacattcatcaaaaccacgctttctctgcattatgcttggaagacaatggccatggttctctccattgtgagcctgtttcccctctgtctgtctaccacctcccagaagacaacctggcttcctgtgctgctggggagcctcggatgcaaaccgctgacaatgttccttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttacgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtatcctcttagcatccccgctacactgtttgtctggtacttctggcaaaagaaaaagcagcgctccggcgtgctgtgggacaccccttctcccccggaagttgagagagccgtgctcgatgacggcatttatcggatcatgcagcgcgggctgcttggaagaagccaggtcggcgtgggggtttttcaagaaaacgtgttccacacgatgtggcacgtcacccggggagccgtgctgatgtaccagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacattcaaaaccccggaaggggaggtcggagctattgccctggattttaagcctggcacaagcgggtctcccatcgtgaaccgggaaggaaaaattgttggcctttatggcaatggggtggtcacgacctccggaacatacgtgagcgccatcgctcaggccaaggcgtcccaggagggccctctgcccgagatcgaagacgaggttttcagaaaacgcaacctgaccattatggatctccatcccgggtctggaaagacccggagatatctgcctgctatcgtgcgcgaagccattaagcggaaacttagaacactgatcctcgccccgacgcgcgtcgtggctagcgagatggccgaagctctgaagggcatgcccattcggtaccaaaccacagccgttaaatccgagcacaccgggaaggagatcgtggacctgatgtgccatgcgacatttaccatgagactccttagccctgtccgcgtgcccaattataacatgatcattatggatgaagcccacttcacggacccttcttccatcgctgcccggggctacattagcacaagagtgggaatgggcgaggctgccgccatctttatgaccgctacaccccctgggtctgtcgaagcgttcccgcagagcaatgccgttattcaggatgaggaacgggacatccccgagcgctcctggaactctggatatgagtggatcacagattttcctggcaaaaccgtgtggttcgtgcccagcattaagtccgggaatgacatcgctaactgtctgagaaagaatggaaaacgggtcattcagctgtctcgcaagacatttgataccgaataccagaagacgaagaacaacgactgggactacgtggttacaaccgatatcagcgagatgggcgccaatttcagagccgaccgggtgattgatcctagacgctgcctcaaacccgtcatcctgaaggacgggccggaacgggtgattcttgctggccctatgcccgttacagtggcctccgcggctcagagacgcggacggatcggcagaaaccataataaggagggggatcagtatatctacatgggacagcccctgaacaatgacgaggatcacgcccactggaccgaagccaaaatgctcctggacaacattaatacgcctgagggcatcattcccgctctgtttgaacctgagcgcgaaaagagcgccgcgatcgatggggagtatcggctcagaggagaggcccgcaaaaccttcgtcgaacttatgagacggggcgacctgccggtgtggctgtcttacaaggtcgcttccgaggggttccaatatagcgatcgcagatggtgctttgacggcgaacggaacaatcaggtgctcgaggaaaacatggatgttgagatttggacaaaagagggagaacgcaagaaactgagaccccggtggcttgacgccagaacctactccgaccctctggctctccgcgagttcaaggaatttgccgctggccggagatctgtgagcggggatctgatcctggagatcggaaagctcccccagcatcttacacagcgcgcccaaaatgcgctggacaacctggtgatgctccacaattccgaacagggcgggcgggcctatagacatgctatggaggagctgcctgataccattgaaacacttatgctgctcgccctgatcgctgtcctgaccggaggcgttacactcttctttctttctggccgggggctgggaaaaacaagcattggcctgctctgtgtgaccgcctccagcgtgctgctttggatggcctctgtcgagccccactggatcgctgcgtccattatcctggagttctttctcatggtgctgctgatcccggagcctgaccgccagagaacaccccaggataaccaactcgcctacgttgtgattgggcttctgttcatgatcctgacagtcgctgccaatgagatgggactcctggaaaccacaaagaaagaccttggcattgggcacgtggccgtcgagaaccatcaccatgctacgatgctggatgtggacctccaccctgccagcgcgtggaccctgtacgccgttgctacaaccatcattacacccatgatgcggcataccatcgaaaacacgaccgccaatatttctctgacagctatcgccaaccaggcggccatcctcatgggacttgataagggctggcctatttccaaaatggacatcggcgtgcccctgctggctctcgggtgctatagccaggtcaatccgctgacccttacagccgctgtgctgatgctcgttgcccactacgctattatcggacctggcctgcaagccaaggcgacccgcgaggcccagaagagaacggctgccgggattatgaaaaaccccacagtggatggaatcgtcgctatcgacctggatcccgtggtgtatgacgccaagtttgaaaaacagctcggccagattatgcttctgatcctgtgtacctctcaaattctcctgatgcggacaacctgggccctttgcgagagcatcaccctggcgacagggcctctcacgaccctgtgggagggatccccgggcaagttctggaatacaaccattgctgtttctatggccaacatctttcgcggcagctacctggctggggccggactcgccttctcccttatgaaaagcctgggcgggggaagacggggcacaggggctcagggagaaaccctgggcgagaagtggaagcgccagctcaatcagctgtccaaatctgaatttaacatctataagagaagcggcattatggaggtcgaccggtccgaagccaaagaggggcttaagagaggagagacgacacgccacgcggtgtctcggggcaccgccaaactgagatggttcgtggaacgcaatctcgtcaagcccgaggggaaggttatcgatctgggatgtggcagagggggatggagctactattgcgctggcctgaaaaaggtgaccgaagtgaaaggctacacaaaagggggacctggccatgaggaacccattcctatggccacctacgggtggaacctcgtcaaacttcactccggaaaggacgtgttctttacaccccctgagaaatgtgatacgctgctgtgcgacatcggcgagtctagcccgaatcccaccattgaagaggggagaacactccgcgttctgaagatggtggaaccttggcttcggggaaaccaattctgtatcaagattctgaatccctatatgccttccgtcgtggagaccctcgagcagatgcagagaaaacatggcggcatgctggttcgcaaccccctgagcagaaattctacacacgaaatgtactgggtgtcctgcgggaccggaaacatcgtcagcgctgtgaatatgacgtctagaatgctcctgaaccgctttaccatggcccaccggaagccgacatatgagagagatgtggaccttggcgcggggacccgccatgtcgccgttgaacctgaggtggctaacctggatatcattggacagagaatcgaaaatattaaacacgagcataagtccacatggcactacgacgaggataacccctataaaacctgggcctaccatggcagctatgaagtgaagccctctgggtccgctagctccatggtcaatggagtggttaagctcctgacaaaaccttgggacgtgatccccatggtcacccaaattgccatgacggatacaacccctttcggccagcagcgggtgtttaaggagaaagttgacacccgcacaccgaaggctaaaagaggcacggcccaaatcatggaagtgaccgcgcggtggctttgggggttcctgagcagaaacaagaagccccggatctgtacacgcgaggaatttaccagaaaagtccggtctaatgccgctattggagccgtgttcgttgacgagaaccagtggaatagcgctaaggaggccgtggaagatgagcgcttttgggacctcgtccagaaagaaagagagctgcacaagcagggcaaatgcgccacatgcgtgtacaacatgatggggaagcgggaaaagaaactgggagagttcggcaaggcgaaagggtcccgcgctatctggtacatgtggctcggcgccagatttctggagttcgaagcccttggatttatgaatgaggatcactggttctctcgggaaaacagcctgtccggcgtcgagggggagggactccataagctgggctatattcttcgcgacatctctaaaattcctgggggaaatatgtacgctgatgacaccgccggctgggatacaagaatcaccgaagacgatctgcaaaacgaggctaagatcacggacattatggaacccgagcacgccctcctggcgaccagcatcttcaaactgacatatcagaataaggtggttcgggtgcagcgccctgccaagaacgggaccgtcatggatgtgatttccagacgggaccagcgcggctctggacaagtgggcacatacgggctcaatacctttacgaacatggaagctcagctgatcagacagatggagagcgagggaattttctcccccagcgaacttgagatcccgaacctggccgaacgggttctcgattggctggagaaatatggcgtggaaagacttaagcgcatggctatctctggggacgactgtgtcgtgaaacctattgatgaccggtttgccacagcgctgaccgccctcaatgatatgggaaaggttagaaaagacgtgccccagtgggagccttccaagggctggaacgattggcaacaggtccccttctgcagccatcactttcaccagctgatcatgaaggacgggcgcgagattgtggtcccttgtcggaatcaggatgaactggtgggcagagctcgcgtttctcaaggagccggctggtccctccgggagacagcttgcctggggaaaagctacgcccagatgtggcagcttatgtatttccatagacgcgacctgcggctcgctgccaacgcgatctgttccgccgtgcccgtcgattgggtgccgacctctagaacgacctggagcattcacgctcatcaccaatggatgacaaccgaagacatgctgtccgtttggaatcgcgtgtggatcgaggaaaacccttggatggaggataagacacatgtcagctcttggggagacgtgccctaccttggcaaacgggaggaccagtggtgcgggtccctgattggactcaccgccagagccacatgggctagcaatatccaggtggccatcaaccaggttcggagactgattggcaatgaaaactacctggattatatgacctctatgaagcgctttaaaaatgagggggaccccgaaggcgcgctctggtga

SEQ ID NO: 18987 - RNA, 9879 nt, synthetic construct
  misc_feature 1..9879: note = derived and/or modified CDS sequence (opt5) from DENV-1__FJ882525__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaagtctctcctgtttaagacaagcgccggcgttaacatgtgcacccttgtggcgatggacctgggggagttctgtgaagatacaatgacctacaagtgcccgcgcattacagaagctgaacccgacgatgtggactgttggtgcaatgccaccgatacgtgggtcacctatggaacatgttcccagaccggcgagcacagacgggacaagcgctctgtggccctcgctcctcatgttgggctgggactggagacaagaaccgaaacgtggatgagctccgagggcgcctggaaacagatccagcgggtggaaacatgggctctccgccaccccggctttaccgtcattgccctgttccttgcgcatgccatcgggacatctattacccagaagggaatcatctttattctgctcatgctggtgacccctagcatggctatgagatgcgttggcatcgggtcccgggatttcgtggagggacttagcggcgccacatgggtcgacgtggtgctggagcacgggtcttgtgtcacgaccatggctaaggataaacccacactcgacattgaactgctgaagaccgaggttacaaaccctgccgtgctccgcaaactgtgcatcgaagcgaagatttccaataccacgacagatagcagatgtccgacccaaggagaggccacccttgtggaagaacaggacgctaactttgtctgccggcgcacattcgtggatagaggctggggcaatgggtgtggactgtttggcaaagggtctctcattacctgcgccaagttcaagtgcgttacaaaactggagggaaagacggtgcagtacgaaaaccttaaatattccgtcattgtgaccgttcacacaggcgaccagcatcaagtggggaatgagagcaccgaacacggaacaaccgctacgatcacaccccaggccccttctacagagatccagctgaccgactacggcgccctcacactggattgtagcccccggaccggcctggactttaacgaaatggtcctcctgacgatgaaggagaaaagctggcttgtgcataagcagtggttcctggatctccctctgccctggacatccggggcttctaccagccaagagacatggaatcgcaaagaccttctggtcacctttaagaccgcgcacgccaagaaacaggaagtggttgtgctcggatcccaggagggcgctatgcacacagccctgacgggggccaccgaaattcaaacaagcggaaccacaaccatcttcgctggccatctgaagtgcagactcaaaatggataagctgacgcttaaagggatgtcttatgtcatgtgtacaggctccttcaagctggagaaggaagtggccgagacccagcacggaaccgttctcgtgcagattcggtacgagggcacagacgcgccgtgcaaaatcccttttagcacccaggatgaaaagggggtcacacaaaacggaagactgattacggctaatcccatcgtgaccgacaaagagaagcctgtgaacatcgaagccgagccgcccttcggcgagtcttatattgttatcggggccggagaaaaagctctgaaacttagctggtttaagaaaggctcctctattgggaagatgttcgaggccacagctcgcggcgcccggagaatggcgatcctcggagataccgcctgggactttggcagcattgggggagtcttcacatccgtgggcaaactggtgcatcagatctttgggaccgcttacggagtcctgttcagcggcgtgtcttggacgatgaagatcgggattggcgttctcctgacctggcttggactcaattcccgcagcacatctctctccatgacctgtatcgccgtgggcctggtcacactgtaccttggggtgatggttcaggctgatagcggatgcgtgattaactggaaaggccgggaactcaagtgtgggtccggaatctttgtcaccaatgaggtgcacacatggaccgaacagtataagttccaagccgactctcctaaaagactgagcgcggccattggcaaggcttgggaggagggggtttgcggcatccgctccgccacgcggctggaaaacattatgtggaaacagatctctaacgagctcaatcatatcctgcttgaaaacgacatgaagtttacagtggtcgtgggagatgtggctggcattctggcccaggggaaaaagatgatcagaccgcagcccatggagtacaaatatagctggaagtcctggggaaaggccaaaattatcggcgctgacgtccaaaataccaccttcattatcgatgggcctaacacacccgaatgtcctgacgatcagcgcgcgtggaatatctgggaggttgaggactacggatttggcattttcaccacgaacatctggctcaagctgcgggatagctatacacaggtgtgcgaccacagactgatgtctgccgctattaaagattccaaggccgtgcacgccgacatgggctactggatcgaaagcgagaaaaatgaaacctggaaacttgctcgcgcctctttcattgaggtcaagacatgtatctggcccaagtcccataccctctggagcaacggggtgctggaatctgagatgatcattccgaagatctatggaggccctattagccagcacaattaccggcccgggtactttacacaaaccgcgggaccttggcatctgggcaaactcgagctggatttcgacctttgcgaagggacgaccgttgtggtcgatgagcactgcggaaacagaggcccctccctgcggacaaccacagtgaccggcaagatcattcacgaatggtgttgccgcagctgtacgctccctcccctgagatttaaaggggaggacggatgctggtatggcatggagatccggccggttaaggaaaaggaggaaaatctggtgaaatctatggtctccgctgggagcggagaggtggactccttctctcttggcctcctgtgtatcagcattatgatcgaagaggttatgagatcccgctggtctcggaagatgctgatgacagggaccctcgccgtgtttttcctgcttattatcggacagctgacatggaacgatctcattagactgtgcatcatggtcggcgccaatgctagcgaccgcatgggcatggggaccacctacctggcccttatggcgacatttaaaatgagacctatgttcgctgtgggactgctctttcggcgcctgacgtccagagaggtgctcctgcttaccattggcctgtctctcgtcgccagcgttgaactgcccaactccctggaggaacttggggatggactggccatgggcatcatgatcctcaagctgctcacagacttccagagccatcaactgtgggctacccttctgtctctcacatttattaaaaccacgttctccctgcactatgcctggaagacaatggctatggtgctgagcatcgtgtctctttttcccctgtgtctctccaccaccagccagaagacaacctggctgcctgtcctcctggggtctcttggatgcaaaccgctgacaatgttcctgattgccgagaataagatctggggccggcgctcctggcccctcaacgaaggcattatggcggtggggatcgttagcatcctgctttccagcctgctcaaaaacgatgtgcctctggccggacccctcattgctggcgggatgctgatcgcctgttacgtcatttctggaagctccgctgacctttctctggagaaggccgccgaggtgagctgggaagaggaagctgagcattccggcgcgtctcacaatatcctggttgaagtgcaggatgacgggacgatgaaaattaaggatgaggagagagacgataccctcacaatcctgcttaaagccaccctgctcgctgtcagcggagtgtatcctctgtccatccccgccacactcttcgtctggtacttttggcagaagaagaaacaacggtctggcgtgctgtgggacaccccttcccctcccgaagttgagcgcgccgtgcttgatgacggcatttatagaatcatgcagcgggggctgctgggacgctcccaggtcggcgtgggggttttccaggaaaacgtgtttcatacgatgtggcacgtcaccagaggagctgtgctcatgtaccaaggcaagcggctggagcccagctgggcctctgtgaaaaaggaccttatttcctacgggggaggctggagactgcagggcagctggaatacaggggaggaagttcaggtcatcgcggtggagcccggcaagaatcctaagaatgtgcagaccgctcccggcacattcaagacctctgaaggggaggtcggagccattgccctcgattttaaaccgggcacatccgggagccctatcgtgaaccgcgaaggaaagattgttggcctgtatggcaatggggtggtcacgacctccggaacatacgtgtctgctatcgcccaagcgaaagctagccaggagggccccctccctgagatcgaagacgaggttttccggaagagaaacctgaccattatggatcttcaccccgggtccggaaaaacccgccggtatctgcccgccatcgtgagagaagccattaagcgcaagctgcggacactcatcctggctcctacgagagtcgtggccagcgagatggctgaagcccttaaaggcatgccgattcgctaccagaccacagcggttaagtctgagcataccgggaaagagatcgtggacctgatgtgccacgccacatttaccatgcggctcctgtcccccgtcagagtgcctaattataacatgatcattatggatgaagctcatttcacggaccccagctctatcgccgctcggggctacattagcacacgcgtgggaatgggcgaggccgccgctatctttatgaccgcgacccctcccgggtccgtcgaagccttccctcaatctaatgctgttattcaggatgaggaaagagacatcccggagcggagctggaactccggatatgagtggatcacagattttcccggcaagaccgtgtggttcgtgccttctattaaaagcgggaatgacatcgccaactgtctgcgcaagaatggaaagagagtcattcagctctcccggaaaacattcgataccgaataccagaagacgaaaaacaacgactgggactacgtggttacaaccgatatcagcgagatgggcgccaattttagagctgaccgcgtgattgatccccggagatgccttaagcctgtcatcctgaaagacgggcccgaacgcgtgattctggccggcccgatgcctgttacagtggcgtctgctgcccaacggagaggacgcatcggccggaaccacaataaggagggggatcagtatatctacatgggacagcccctcaacaatgacgaggatcatgcccactggaccgaagctaagatgctgcttgacaacattaatacgcccgagggcatcattcctgccctgttcgaacccgagagagaaaaatccgcggccatcgatggggagtatcgcctcagaggagaggctcggaagacctttgtcgaactgatgcgcagaggcgacctgcctgtgtggctcagctacaaagtcgcctccgaggggttccagtattctgatcggcgctggtgctttgacggcgaaagaaacaatcaagtgcttgaggaaaacatggatgttgagatttggacaaaggagggagaacggaaaaagctgagaccgcgctggctggacgctcggacctacagcgaccccctcgccctgagagagttcaaagaatttgctgccggccgccggtccgtgtctggggatcttatcctggagatcggaaagctccctcagcacctgacacagagagcgcagaatgccctggacaacctcgtgatgcttcataatagcgaacaaggcgggcgggcttatcgccacgccatggaggagctgcccgataccattgaaacactgatgctcctggctcttatcgccgtcctgaccggaggcgttacgctgttctttctgtccggcagagggctgggaaagacaagcattggcctcctttgtgtgatggcctcttccgtgctgctgtggatggctagcgtcgagcctcattggatcgcggcctctattatcctcgagttctttctgatggtgcttctgatccccgagccggaccggcagcgcacccctcaggataaccagctcgcttacgttgtgattgggctgctgttcatgatcctcaccgtcgccgccaatgagatgggacttctggaaacaaccaaaaaggacctgggcattgggcacgtggctgtcgagaaccaccatcacgccgcgatgctcgatgtggacctgcatcccgcctccgcttggacactttacgccgttgctacgaccatcattacacctatgatgagacacaccatcgaaaacacaaccgccaatattagcctgacggcgatcgccaaccaagctgccatcctcatgggactggataaaggctggcccatttctaagatggacatcggcgtgcctctgctcgctcttgggtgctatagccaggtcaatcccctgaccctgacagccgctgtgctcatgctggttgcccattacgcgattatcggaccgggccttcaggccaaagctacccgggaggcccaaaagcgcacagctgccgggattatgaagaaccctaccgtggatggaatcgtcgccatcgacctggatcccgtggtgtatgacgcgaaatttgaaaagcagctcggccagattatgctgctgatcctctgtacgtcccagattcttctgatgagaacaacctgggctctgtgcgagtctatcacactcgccaccgggcccctgaccacactttgggagggaagccctggcaaattctggaatacgaccattgctgtttccatggccaacatcttccggggcagctacctggccggggctggactcgccttttccctgatgaagtctctgggcgggggacgcagaggcacaggggcgcaaggagaaaccctcggcgagaaatggaagcggcagcttaatcagctgagcaagtccgagttcaacacatataaaagatctggcatcatggaggtcgaccgcagcgaagccaaggaggggctgaaacggggagagaccacgaagcacgctgtgtccagaggcacagccaaactccgctggtttgtggaacggaatttcgtcaagccggaggggaaggttattgatctgggatgtggcagagggggatggtcttactattgcgctggccttaaaaaggtgaccgaagtgaaaggctacaccaaagggggacccggccacgaggaacctatccccatggccacatacgggtggaacctggtcaaactccatagcggaaaggacgtgtttttcattcctcccgagaaatgtgataccctgctgtgcgacatcggcgagtccagccctaatccgacaattgaagaggggcgcacgctccgggttcttaagatggtggaaccctggctgagaggaaaccagttttgtatcaagattctgaatccttatatgccctctgtcgtggagaccctcgagcgcatgcaacggaaacacggcggcatgctggttagaaaccctctttcccgcaatagcacacatgaaatgtactgggtgtcttgcgggaccggaaacatcgtctccgcggtgaatatgacaagccggatgctgctcaacagattcaccatggcccaccgcaagcccacgtatgagagagatgtggacctgggcgctgggacccggcacgtcgccgttgaaccggaggtggctaacctggatatcattggacagcgcatcgaaaatattaaacatgagcacaagtctacatggcattacgacgaggataacccttataaaacctgggcctaccacggctcctatgaagtgaagcccagcgggtccgctagctctatggtcaatggagtggttaagctcctgacaaaaccctgggacgtgatccctatggtcacccagattgccatgacagataccacgccctttggccagcaaagagtgttcaaggagaaagttgacacacggacccctaaggcgaaaagaggcaccgcccagatcatggaagtgacagctaagtggctttgggggtttctgagccggaacaagaaaccgcgcatctgtacgagagaggagttcacccggaaggtccgctccaatgccgctattggagccgtgtttgttgacgagaaccagtggaactctgccaaagaggcggtggaagatgagagattctgggacctcgtccatcgggaacgcgagctgcacaagcaaggcaaatgcgctacatgcgtgtacaacatgatggggaagagagaaaagaaacttggagagttcggcaaggccaaagggagccgggccatctggtacatgtggctgggcgctcgctttctcgagttcgaagccctgggatttatgaatgaggatcactggttctccagagaaaactctctgagcggcgtcgagggggagggactccataagctgggctatattcttcgggacatctccaaaattcccgggggaaatatgtacgctgatgacaccgccggctgggatacacgcatcaccgaagacgatctgcagaacgaggcgaagatcacagacattatggaacctgagcacgccctcctggctaaatctatctttaaacttacctatcagaataaggtggttagagtgcagcggcccgccaaaaacgggacggtcatggatgtgattagccgcagagaccaacggggctccggacaggtgggcacctacgggctgaatacattcaccaacatggaagctcagctcatcagacagatggagagcgagggaatcttttctccttccgaactggagacacccaacctggccggccgcgttctcgattggctggaaaagcatggggtggagcggcttaaaagaatggcgatcagcggagacgactgtgtcgtgaagccgatcgatgaccgcttcgccaccgctctgacggccctcaatgatatgggcaaagttcggaaggacattcctcaatgggaaccctctaaggggtggaacgattggcaacaggtgcctttttgctcccaccacttccatcagctgatcatgaaagacggcagagagattgtcgtgccctgtcgcaatcaagatgagcttgtcggacgggctagagtgagccagggcgccgggtggtccctgcgcgaaacagcttgcctcggaaagtcttatgcccagatgtggcagctgatgtactttcaccggagagacctgcgcctcgcggccaacgctatctgtagcgccgttcctgtggattgggtccccacctcccggacaacctggagcattcatgcccaccatcaatggatgacgaccgaggacatgctgtctgtgtggaatagagtttggatcgaagagaacccgtggatggaagataaaacacacatttccagctggggcgacgtgccttatcttgggaagcgggaggaccagtggtgcggatctctgatcggcctcaccgctagagccacatgggcgaccaatatccaggtcgctattaaccaagtgcgccggctgatcgggaatgagaactaccttgattacatgacaagcatgaaaagattcaagaatgaatccgaccccgagggcgccctgtggtga

SEQ ID NO: 18988 - RNA, 9879 nt, synthetic construct
  misc_feature 1..9879: note = derived and/or modified CDS sequence (opt5) from DENV-1__FJ882526__SS-prME
  source 1..9879: mol_type = other RNA
tccgtgaccatgctgctgatgctgatgcccacagcccttgctttccacctgacgacccggggcggggaacctcatatgatcgtctccaagcaggaacggggaaagtctctcctgtttaagacaagcgccggcgttaatatgtgcacccttattgccatggacctgggggagttctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaagagctctgaaacttagctggtttaagaaaggctcctctattgggaagatgttcgaggccaccgctcgcggcgcccggagaatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattcccgcagcacctctctctccatgacatgtatcgccgttggcctggtgaccctgtaccttggggtcatggtgcaggctgatagcggatgcgttattaactggaaaggccgggaactcaagtgtgggtccggaatctttgtgacaaatgaggtccacacctggacagaacagtataagttccaagccgactctcctaaaagactgagcgcggccattggcaaggcttgggaggagggggtgtgcggcatccgctccgccacccggctggaaaacatcatgtggaaacagatttctaacgagctcaatcatatcctgcttgaaaacgacatgaagtttacggttgtggtcggagatgtggctggcattctggcccaggggaaaaagatgatcagaccgcagcccatggagtacaaatatagctggaagtcctggggaaaggccaaaattatcggcgctgacgtgcaaaatacaaccttcatcattgatgggcctaacacccccgaatgtcctgacgatcagcgcgcgtggaatatctgggaggtcgaggactacggatttggcattttcacaaccaacatctggctcaagctgcgggatagctatacgcaggtttgcgaccacagactgatgtctgccgctattaaagattccaaggccgtgcacgccgacatgggctactggatcgaaagcgagaaaaatgaaacatggaaacttgctcgcgcctctttcatcgaggtgaagacctgtatttggcccaaatcccatacactctggagcaacggggtcctggaatctgagatgatcattccgaagatctatggaggccctattagccagcacaattaccggcccgggtactttacccaaacagcgggaccttggcatctgggcaaactcgagctggatttcgacctttgcgaagggaccacggtggttgtggatgagcactgcggaaacagaggcccctccctgcggaccacaaccgtcacaggcaagatcatccacgaatggtgttgccgcagctgtaccctccctcccctgagatttaaaggggaggacggatgctggtatggcatggagattcggccggtgaaggaaaaggaggaaaatctggttaaatctatggtgtccgctgggagcggagaggtcgactccttctctcttggcctcctgtgtatcagcattatgatcgaagaggtgatgagatcccgctggtctcggaagatgctgatgacggggacactcgccgtctttttcctgcttattatgggacagctgacctggaacgatctcatcagactgtgcattatggtgggcgccaatgctagcgaccgcatgggcatggggacaacctacctggcccttatggcgacctttaaaatgagacctatgttcgctgtcggactgctctttcggcgcctgacatccagagaggtgctcctgcttacgatcggcctgtctctcgtggccagcgtcgaactgcccaactccctggaggaacttggggatggactggccatgggcatcatgattctcaagctgctcaccgacttccagagccatcaactgtgggctacacttctgtctctcacctttatcaaaacaaccttctccctgcactatgcctggaagacgatggctatggttctgagcattgtgtctctttttcccctgtgtctctccacaaccagccagaagaccacatggctgcctgtgctcctggggtctcttggatgcaaaccgctgaccatgttcctgatcgccgagaataagatttggggccggaaatcctggcccctcaacgaaggcatcatggcggtcgggatcgtgagcattctgctttccgccctgctcaagaacgatgttcctctggctggacccctcatcgccggcgggatgctgattgcttgttacgtgatcagcggatctagcgccgacctttccctggagaaagccgctgaggtctcttgggaagaggaagcggagcatagcggcgcctcccacaatattctggtggaagttcaggatgacgggacaatgaagatcaaagatgaggagcgcgacgatacgctcaccatcctgcttaaggctacactgctcgccgtgtctggagtctatcctctgagcattcccgccaccctcttcgtgtggtacttttggcagaagaaaaagcaaagatccggcgtcctgtgggacacaccttctcccccggaagtggagcgggctgttcttgatgacggcatctatcgcattatgcagagagggctgctgggacggagccaggtgggcgtcggggtgttccaggaaaacgtttttcataccatgtggcacgtgacgcgcggagccgtcctcatgtaccaaggcaaaagactggagccttcctgggcgagcgtgaagaaagaccttatctcttacgggggaggctggcggctgcagggctcctggaataccggggaggaagtgcaggttattgctgtcgagcccggaaagaaccctaagaatgtgcagacagcccccggcaccttcaaaacaagcgaaggggaggtgggagccatcgctctcgattttaagccgggcacctctgggtcccctattgtcaacagagaaggaaaaatcgtgggcctgtatggcaatggggttgtgacaacgagcggaacctacgtctccgccatcgcgcaagctaaggcctctcaggagggccccctccctgagattgaagacgaggtgttccgcaaacggaacctgacaatcatggatcttcaccccgggagcggaaagaccagacgctatctgcccgccattgttcgggaagctatcaagagaaaactgcgcaccctcattctggcccctacacgggtggtcgcttccgagatggccgaagcgcttaagggcatgccgatcagataccagacgaccgccgtgaaaagcgagcatacagggaaggagatcgttgacctgatgtgccacgctacctttacaatgcgcctcctgtctcccgtgcgggtccctaattataacatgattatcatggatgaagcccatttcaccgacccctccagcattgctgccagaggctacatctctacgcgggtgggaatgggcgaggccgctgcgatttttatgacagccacccctcccgggagcgtggaggctttccctcaatccaatgccgtcatccaggatgaagaacgcgacatcccggagagatcttggaacagcggatatgagtggattaccgattttcccggcaaaacagtttggttcgtgccttccatcaagtctgggaatgacattgccaactgtctgcggaagaatggaaaacgcgtgatccagctcagcagaaagaccttcgatacagaataccagaaaaccaagaacaacgactgggactacgtcgtgacgacagatatttccgagatgggcgctaattttcgggccgacagagttatcgatccccgccggtgccttaaacctgtgattctgaaggacgggcccgaaagagtcatcctggcgggcccgatgcctgtgaccgttgctagcgccgcccaacgccggggaagaatcggccgcaaccacaataaggagggggatcagtatatttacatgggacagcccctcaacaatgacgaggatcatgctcactggacagaagccaaaatgctgcttgacaacatcaatacccccgagggcattatccctgcgctgttcgaacccgagcgggaaaagtctgccgctattgatggggagtatagactccgcggagaggccagaaaaacgtttgtggaactgatgcggcgcggcgacctgcctgtctggctctcctacaaggtggctagcgaggggttccagtattccgatagacggtggtgctttgacggcgaacgcaacaatcaagtccttgaggaaaacatggatgtggagatctggaccaaagagggagaaagaaagaaactgcggccgagatggctggacgcccgcacatactctgaccccctcgctctgcgggagttcaaggaatttgccgcgggcagacgcagcgtttccggggatcttatcctggagattggaaagctccctcagcacctgacccagcgggcccagaatgctctggacaacctcgtgatgcttcataattctgaacaaggcgggagagcctatcggcacgctatggaggagctgcccgatacaatcgaaaccctgatgctcctggcccttattgccgtgctgacaggaggcgtcaccctcttctttctgagcggccgcgggctgggaaaaacgtccatcggcctcctttgtgttatggctagctctgtgctgctgtggatggcgtccgtggagcctcattggattgccgctagcatcatcctcgagttctttctgatggtccttctgattcccgagccggacagacagcggacacctcaggataaccagctcgcctacgtggttatcgggctgctgttcatgattctcaccgtggccgctaatgagatgggacttctggaaaccacaaagaaagacctgggcatcgggcacgtcgccgtggagaaccaccatcacgcggccatgctcgatgtcgacctgcatcccgcttctgcctggaccctttacgctgtggccacaacgattatcacccctatgatgcgccacacaattgaaaacaccacagcgaatatctccctgaccgccatcgctaaccaagccgctattctcatgggactggataagggctggcccatcagcaaaatggacattggcgttcctctgctcgcccttgggtgctattctcaggtgaatcccctgacgctgaccgctgccgtcctcatgctggtggcgcattacgccatcattggaccgggccttcaggctaaggccacaagagaggctcaaaagcggaccgccgccgggatcatgaaaaaccctacagttgatggaatcgtggcgattgacctggatcccgtcgtgtatgacgctaagtttgaaaaacagctcggccagatcatgctgctgattctctgtaccagccagatccttctgatgcgcacgacatgggccctgtgcgagtccattaccctcgctacagggcccctgaccaccctttgggagggatctcctggcaagttctggaatacaacgatcgccgtgagcatggccaacatcttcagaggctcctacctggctggggccggactcgcgtttagcctgatgaaatccctgggcgggggacggcgcggcaccggggcccaaggagaaacactcggcgagaagtggaagagacagcttaatcagctgtctaaaagcgagttcaacacctataagcggtccggcattatggaggttgacagatctgaagctaaagaggggctgaagcgcggagagacaaccaaacacgccgtcagccggggcacggctaagctcagatggtttgtggaacgcaatctggtgaagccggaggggaaagtcatcgatcttggatgtggcagagggggatggtcctactattgcgccggcctgaagaaagttacagaagtgaagggctacaccaaagggggacccggccacgaggaacctattcccatggcgacctacgggtggaacctcgtgaagctgcattctggaaaagacgtcttctttatccctcccgagaagtgtgatacactgctctgcgacattggcgagagctcccctaatccgaccatcgaagaggggagaacacttcgcgtgctgaagatggttgaaccctggctgcggggaaaccagttctgtattaaaatcctcaatccttatatgcccagcgtggtcgagacgctggagcaaatgcagagaaagcacggcggcatgcttgtgcgcaaccctctgtctagaaattccacccatgaaatgtactgggttagctgcgggacaggaaacatcgtgtctgccgtcaatatgacctccagaatgctcctgaaccgctttacaatggctcaccggaaacccacctatgagagagatgtggacctgggcgccgggacgcgccacgtggctgtcgaaccggaggttgccaacctcgatattatcggacagagaattgaaaatatcaagcatgagcacaaaagcacctggcattacgacgaggataacccttataagacatgggcttaccacggctcttatgaagtgaagccctccgggagcgcctccagcatggtgaatggagtcgtgaaactgcttaccaagccctgggacgttattcctatggtgacacagatcgcgatgaccgatacaacccccttcggccaacagcgggtctttaaagagaaggtggacacgcgcacacctaaagccaagagaggcaccgctcagatcatggaagttaccgccaagtggctgtgggggttcctctctcggaacaaaaagccgagaatttgtacacgggaggaatttacgcgcaaagtgagaagcaatgctgccatcggagccgtcttcgtggacgagaaccaatggaactccgcgaaggaggctgttgaagatgagcggttttgggacctggtgcatcgcgaaagagagcttcacaaacagggcaagtgcgcgacctgcgtctacaacatgatggggaagcgggagaagaagctgggagagttcggcaaagccaaggggtctcgcgctatttggtacatgtggctcggcgccagattcctggagtttgaagctctgggattcatgaatgaggatcactggtttagccgggaaaactccctctctggcgtggagggggagggactgcataaacttggctatatcctgcgcgacattagcaagatccccgggggaaatatgtacgccgatgacacagcgggctgggataccagaatcacagaagacgatctccagaacgaggccaaaattaccgacatcatggaacctgagcacgctctgcttgccaagtccattttcaagctgacatatcagaataaagtcgtgcgggttcaacgccccgctaagaacgggaccgtgatggatgtcatctctagacgggaccagcgcggcagcggacaggtgggcacgtacgggctcaatacctttacaaacatggaagcccagctgattagacaaatggagtccgagggaatcttcagcccttctgaactggagacccccaacctcgcgggccgggtgctggattggcttgaaaaacatggggttgagagactgaagcgcatggccatctccggagacgactgtgtggtcaaaccgattgatgaccggtttgctacagccctcaccgctctgaatgatatgggcaaggtgagaaaggacatccctcagtgggaacccagcaaagggtggaacgattggcagcaggttcctttctgctctcaccactttcatcaacttattatgaaggacggccgcgagatcgtggtcccctgtcggaatcaggatgagctggtgggacgggcccgcgtctcccagggcgctgggtggagcctccgggaaacggcctgcctgggaaaatcctatgcgcagatgtggcaactgatgtacttccacagacgcgacctccggctggccgctaacgccatttgttctgccgtgcctgttgattgggtgcccacaagcagaaccacatggtccatccatgctcaccatcagtggatgaccacggaggacatgcttagcgtctggaatcgcgtgtggattgaagagaacccgtggatggaagataagacccacatctcttcctggggcgacgttccttatctggggaaacgggaggaccagtggtgcggaagcctcatcggcctgacagccagagcgacctgggctacaaatattcaagtggccatcaaccaggtccggagacttattgggaatgagaactacctggattacatgacctctatgaagcgctttaagaatgaaagcgaccccgagggcgccctctggtga

SEQ ID NO: 18989 - RNA, 9879 nt, synthetic construct
  misc_feature 1..9879: note = derived and/or modified CDS sequence (opt5) from DENV-1__FJ882527__SS-prME
  source 1..9879: mol_type = other RNA
agcgtgaccatgctgctgatgctgatgcccacagcccttgctttccacctgacgaccagaggcggggaacctcatatgattgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgctggctgtcggactcctgttcagacggctcacgtcccgcgaggtgctgcttctgaccattggcctctctctggtggccagcgtcgaactgcccaactcccttgaggaactgggggatggactcgccatgggcatcatgatcctgaaactcctgacagactttcagagccatcaactttgggctaccctgctctctctgacattcattaagaccacgttttccctgcactatgcctggaagacaatggctatggttcttagcatcgtgtctctgttccccctctgtctgtccaccaccagccagaaaacaacctggctccctgtgctgcttgggtctctgggatgcaagccgctggccatgtttctcattgcggagaataaaatctggggcagaaagtcctggcccctgaacgaaggcattatggccgtcgggatcgtgagcatccttctgtccagcctcctgaaaaacgatgttcctctcgctggacccctgattgccggcgggatgcttatcgcttgttacgtgatttctggaagctccgccgacctgtctctggagaaggccgctgaggtcagctgggaagaggaagcggagcattccggcgcctctcacaatatcctcgtggaagttcaggatgacgggacaatgaaaattaaggatgaggagcgggacgatacgctgaccatccttctgaaggctacactcctggccgtgagcggagtctatcctctctccatccccgccaccctgttcgtgtggtacttctggcagaaaaagaaacaacgctctggcgtcctttgggacacaccttcccctcccgaagtggagagagctgttctggatgacggcatttatcggatcatgcagcgcgggctgctcggaagatcccaggtgggcgtcggggtgtttcaggaaaacgttttccataccatgtggcacgtgacgcggggagccgtcctgatgtaccaaggcaagcgccttgagcccagctgggcgtctgtgaaaaaggacctgatttcctacgggggaggctggagactccagggcagctggaataccggggaggaagtgcaggttatcgctgtcgagcccggaaagaaccctaaaaatgtgcagacagcccccggcacctttaagacatctgaaggggaggtgggagccattgctctggatttcaaaccgggcacctccgggagccctatcgtcaaccgggaaggaaagattgtgggcctctatggcaatggggttgtgacaacgtccggaacctacgtctctgccatcgcgcaagctaaagccagccaggagggccccctgcctgagatcgaagacgaggtgtttagaaagcgcaaccttacaattatggatctgcaccccgggtccggaaagacccggagatatctgcccgccatcgttcgcgaagctattaaacggaagctcagaaccctgatccttgcccctacacgcgtggtcgctagcgagatggccgaagcgctgaaaggcatgccgattcggtaccagacgaccgccgtgaagtctgagcatacagggaaagagatcgttgacctcatgtgccacgctaccttcacaatgagactgctgtcccccgtgcgcgtccctaattataacatgatcattatggatgaagcccattttaccgaccccagctctatcgctgcccggggctacattagcacgagagtgggaatgggcgaggccgctgcgatcttcatgacagccacccctcccgggtccgtggaggcttttcctcaatctaatgccgtcattcaggatgaagaacgggacatcccggagcgcagctggaactccggatatgagtggatcaccgatttccccggcaagacagtttggtttgtgccttctattaagagcgggaatgacatcgccaactgtctccgcaagaatggaaagcgggtgattcagctttcccgcaaaaccttcgatacagaataccagaagaccaaaaacaacgactgggactacgtcgtgacgacagatatcagcgagatgggcgctaatttcagagccgaccgggttattgatcccagacgctgcctgaagcctgtgatcctgaaggacgggcccgaacgggtcattctcgcgggcccgatgcctgtgaccgttgcttctgccgcccaaagacgcggacggatcggcagaaaccacaataaagagggggatcagtatatctacatgggacagcccctgaacaatgacgaggatcatgctcactggacagaagccaagatgcttctggacaacattaatacccccgagggcatcattcctgcgctctttgaacccgagcgcgaaaaatccgccgctatcgatggggagtatcggctgagaggagaggcccgcaagacgttcgtggaactgatgagacggggcgacctccctgtctggcttagctacaaagtggcttccgaggggtttcagtattctgatcgcagatggtgcttcgacggcgaacggaacaatcaagtcctggaggaaaacatggatgtggagatttggaccaaggagggagaacgcaaaaagctgagaccgcggtggctcgacgccagaacatacagcgaccccctggctcttagagagtttaaggagttcgccgcgggccggagatccgtttctggggatctgatcctcgagatcggaaaactgcctcagcacctgacccagcgcgcccagaatgctctcgacaaccttgtgatgctgcataatagcgaacaaggcgggcgggcctatagacacgctatggaggagctgcccgatacaattgaaaccctcatgctgcttgccctgatcgccgtgctcacaggaggcgtcaccctgtttttcctgtccggccgggggctcggaaagacgagcattggccttctgtgtgttatggcttcttccgtgctgctctggatggcgagcgtggagcctcattggatcgccgcttctattatcctggaatttttccttatggtcctgctcatccccgagccggaccgccagagaacacctcaggataaccagctggcctacgtggttattgggctgctctttatgatccttaccgtggccgctaatgagatgggactgctggaaaccaccaagaaggacctcggcattgggcacgtcgccgtggagaaccaccatcacgcggccatgctggatgtcgaccttcatcccgcttccgcctggaccctgtacgctgtggccacaacgatcattacccctatgatgcggcacacaatcgaaaacaccacagcgaatattagcctcaccgccatcgctaaccaagccgctatcctgatgggactggataaaggctggcccatttctaagatggacatcggcgttcctctccttgccctggggtgctatagccaggtgaatcccctgacgctcaccgctgccgtcctgatgcttgtggcgcattacgccattatcggaccgggcctgcaggctaaggccacacgcgaggctcagaagagaaccgccgccgggattatgaagaaccctacagttgatggaatcgtggcgatcgacctcgatcccgtcgtgtatgacgctaaattcgaaaagcagctgggccagattatgctgctcatcctttgtacctcccagattctgctgatgcggacgacatgggccctctgcgagtctatcaccctggctacagggccccttaccaccctgtgggagggaagccctggcaaattttggaatacaacgattgccgtgtccatggccaacatcttccgcggcagctacctcgctggggccggactggcgttctccctgatgaagtctctcggcgggggaagacggggcaccggggcccaaggagaaacacttggcgagaagtggaaacgccagctgaatcagctgagcaagtccgaatttaacacctataaaagatctggcatcatggaggttgaccggagcgaagctaaggaggggctcaaaagaggagagacaaccaagcacgccgtctcccgcggcacggctaagctgcggtggttcgtggaaagaaatcttgtgaaaccggaggggaaggtcattgatctgggatgtggccgcgggggatggtcttactattgcgccggcctcaaaaaggttacagaagtgaaaggctacaccaaagggggacccggccacgaggaacctatccccatggcgacctacgggtggaacctggtgaaactgcatagcggaaaggacgtctttttcattcctcccgagaagtgtgatacactcctttgcgacatcggcgagtccagccctaatccgaccattgaagaggggcggacactgagagtgctgaaaatggttgaaccctggctccgcggaaaccagttttgtatcaagattctgaatccttatatgccctctgtggtcgagacgcttgagcaaatgcagcggaaacacggcggcatgctggtgagaaaccctctctcccgcaatagcacccatgaaatgtactgggtttcttgcgggacaggaaacatcgtgtccgccgtcaatatgaccagccggatgctgctgaacagattcacaatggctcaccgcaagcccacctatgagcgggatgtggacctcggcgccgggacgagacacgtggctgtcgaaccggaggttgccaacctggatatcattggacagcgcatcgaaaatattaaacatgagcacaagtctacctggcattacgacgaggataacccttataagacatgggcttaccacggctcctatgaagtgaaacccagcgggtccgccagctctatggtgaatggagtcgtgaaacttctgaccaaaccctgggacgttatccctatggtgacacagattgcgatgaccgatacaaccccctttggccaacagagagtcttcaaggagaaagtggacacgcggacacctaaggccaagcgcggcaccgctcagatcatggaagttaccgccaaatggctctgggggtttctgagcagaaacaagaaaccgcggatctgtacaagagaggagttcacgcggaaggtgcgctccaatgctgccattggagccgtctttgtggacgagaaccaatggaactctgcgaaagaggctgttgaagatgagagattctgggaccttgtgcatcgggaacgcgagctgcacaagcagggcaagtgcgctacctgcgtctacaacatgatggggaaaagagaaaagaaactcggagagtttggcaaggccaaagggagccgggctatctggtacatgtggctgggcgcccgcttcctggagttcgaagctctcggatttatgaatgaggatcactggttctccagagaaaactctctgagcggcgtggagggggagggacttcataagctgggctatattctccgggacatctccaaaattcccgggggaaatatgtacgccgatgacacagcgggctgggatacccgcatcacagaagacgatctgcagaacgaggccaagatcaccgacattatggaacctgagcacgcccttctggccaagtctatctttaaactcacatatcagaataaggtcgtgagagttcaacggcccgctaaaaacgggaccgtgatggatgtcattagccgcagagaccagcggggctccggacaggtgggcacgtacgggctgaataccttcacaaacatggaagcccagctgatccgccaaatggagagcgagggaatcttttctccttccgaactcgagacccccaacctggcgggcagagtgcttgattggctggaaaagcatggggttgagcggctcaaaagaatggccatcagcggagacgactgtgtggtcaagccgatcgatgaccgcttcgctacagccctgaccgctcttaatgatatgggcaaggtgcggaaagacattcctcagtgggaaccctctaaggggtggaacgattggcagcaggttcctttttgctcccaccacttccatcaactgatcatgaaagacggcagagagattgtggtcccctgtcgcaatcaggatgagctcgtgggacgggccagagtcagccagggcgctgggtggtccctgcgcgaaacggcctgcctgggaaagtcttatgcgcagatgtggcaactcatgtactttcaccggagagacctgcgccttgccgctaacgccatctgtagcgccgtgcctgttgattgggtgcccacatcccggaccacatggagcattcatgctcaccatcagtggatgaccacggaggacatgctgtctgtctggaatagagtgtggatcgaagagaacccgtggatggaagataaaacccacatttccagctggggcgacgttccttatctcgggaagcgcgaggaccagtggtgcggatctctgatcggccttacagcccgggcgacctgggctacaaatatccaagtggccattaaccaggtcagacggctgatcgggaatgagaactacctcgattacatgaccagcatgaagagattcaaaaatgaatccgaccccgagggcgccctgtggtga

SEQ ID NO: 18990 - RNA, 9879 nt, synthetic construct
  misc_feature 1..9879: note = derived and/or modified CDS sequence (opt5) from DENV-1__FJ882529__SS-prME
  source 1..9879: mol_type = other RNA
agcgtgaccatgctgctgatgctgatgcccacggcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacgttaagtttacggtggtcgtgggagatgtggctggcattctggcccaggggaaaaagatgatccggccgcaacccatggagtacaaatatagctggaagtcctggggaaaggccaaaattatcggcgctgacgtccagaatacaaccttcatcattgatgggcctaacacccccgaatgtcctgacgatcagagagcgtggaatatctgggaggttgaggactacggatttggcattttcacaaccaacatctggctcaagctgcgcgatagctatacacaggtgtgcgaccaccggctgatgtctgccgctattaaagattccaaggccgtgcacgccgacatgggctactggatcgaaagcgagaaaaatgaaacatggaaacttgctagagcctctttcatcgaggtcaagacctgtatttggcccaaatcccatacactctggagcaacggggtgctggaatctgagatgatcattccgaagatctatggaggccctattagccaacacaattaccgccccgggtactttacccagacagcgggaccttggcatctgggcaaactcgagctggatttcgacctttgcgaagggaccacggttgtggtcgatgagcactgcggaaaccggggcccctccctgagaaccacaaccgtgacaggcaagatcatccacgaatggtgttgccggagctgtaccctccctcccctgcgctttaaaggggaggacggatgctggtatggcatggagattagaccggttaaggaaaaggaggaaaatctggtgaaatctatggtctccgctgggagcggagaggtggactccttctctcttggcctcctgtgtatcagcattatgatcgaagaggttatgcggtccagatggtctcgcaagatgctgatgacggggacactcgccgtgtttttcctgcttattatgggacagctgacctggaacgatctcatccggctgtgcattatggtcggcgccaatgctagcgacagaatgggcatggggacaacctacctggcccttatggcgacctttaaaatgcgccctatgttcgctgtgggactgctctttagacggctgacatcccgcgaggtgctcctgcttacgatcggcctgtctctcgtcgccagcgttgaactgcccaactccctggaggaacttggggatggactggccatgggcatcatgattctcaagctgctcaccgacttccaaagccatcagctgtgggctacacttctgtctctcacctttatcaaaacaaccttctccctgcactatgcctggaagacgatggctatggtgctgagcattgtgtctctttttcccctgtgtctctccacaaccagccagaagaccacatggctgcctgtcctcctggggtctcttggatgcaaaccgctgaccatgttcctgatcgccgagaataagatttggggcagaaaatcctggcccctcaacgaaggcatcatggcggtggggatcgttagcattctgctttccagcctgctcaagaacgatgtgcctctggccggacccctcatcgctggcgggatgctgattgcctgttacgtcatctctggaagctccgctgacctttctctggagaaagccgccgaggtgagctgggaagaggaagctgagcattccggcgcgtctcacaatattctggttgaagtgcaggatgacgggacaatgaagatcaaagatgaggagcgggacgatacgctcaccatcctgcttaaggccacactgctcgctgtcagcggagtgtatcctctgtccattcccgccaccctcttcgtctggtacttttggcaaaagaaaaagcagcgctctggcgtgctgtgggacacaccttcccctcccgaagttgagagagccgtgcttgatgacggcatctatcggattatgcagcgcgggctgctgggaagatcccaggtcggcgtgggggttttccaagaaaacgtgtttcataccatgtggcacgtcacgcggggagctgtgctcatgtaccagggcaaacgcctggagcccagctgggcctctgtgaagaaagaccttatctcctacgggggaggctggagactgcagggcagctggaataccggggaggaagttcaggtcattgcggtggagcccggaaagaaccctaagaatgtgcaaacagctcccggcaccttcaaaacatctgaaggggaggtcggagccatcgccctcgattttaagccgggcacctccgggagccctattgtgaaccgggaaggaaaaatcgttggcctgtatggcaatggggtggtcacaacgtccggaacctacgtgtctgctatcgcccaggcgaaggctagccaggagggccccctccctgagattgaagacgaggttttcagaaaacgcaacctgacaatcatggatcttcaccccgggtccggaaagacccggagatatctgcccgccattgtgcgcgaagccatcaagcggaaactgagaaccctcattctggctcctacacgcgtcgtggccagcgagatggctgaagcccttaagggcatgccgatccggtaccaaacgaccgcggttaaatctgagcatacagggaaggagatcgtggacctgatgtgccacgccacctttacaatgagactcctgtcccccgtccgcgtgcctaattataacatgattatcatggatgaagctcatttcaccgaccccagctctattgccgctcggggctacatcagcacgagagtgggaatgggcgaggccgccgctatttttatgacagcgacccctcccgggtccgtcgaagccttccctcagtctaatgctgttatccaggatgaggaacgggacatcccggagcgcagctggaactccggatatgagtggattaccgattttcccggcaaaacagtgtggttcgtgccttctatcaagagcgggaatgacattgccaactgtctgagaaagaatggaaaacgggtcatccagctctcccgcaagaccttcgatacagaataccagaagaccaagaacaacgactgggactacgtggttacgacagatattagcgagatgggcgccaattttagagctgaccgggtgatcgatcccagacgctgccttaaacctgtcattctgaaggacgggcccgaacgggtgatcctggccggcccgatgcctgttaccgtggcgtctgctgcccagagacgcggacggatcggcagaaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgcgaaaagtccgcggccattgatggggagtatcggctcagaggagaggctcgcaaaacgtttgtcgaactgatgagacggggcgacctgcctgtgtggctcagctacaaggtcgcctccgaggggttccaatattctgatcgcagatggtgctttgacggcgaacggaacaatcaggtgcttgaggaaaacatggatgttgagatctggaccaaagagggagaacgcaagaaactgagaccgcggtggctggacgctagaacatacagcgaccccctcgccctgcgcgagttcaaggaatttgctgccggccggagatccgtgtctggggatcttatcctggagattggaaagctccctcagcacctgacccagcgcgcgcaaaatgccctggacaacctcgtgatgcttcataatagcgaacagggcgggcgggcttatagacacgccatggaggagctgcccgatacaatcgaaaccctgatgctcctggctcttattgccgtcctgacaggaggcgttaccctcttctttctgtccggccgggggctgggaaaaacgagcatcggcctcctttgtgtgatggcctcttccgtgctgctgtggatggctagcgtcgagcctcattggattgcggcctctatcatcctcgagttctttctgatggtgcttctgattcccgagccggaccgccagagaacacctcaggataaccaactcgcttacgttgtgatcgggctgctgttcatgattctcaccgtcgccgccaatgagatgggacttctggaaaccacaaagaaagacctgggcatcgggcacgtggctgtcgagaaccaccatcacgccgcgatgctcgatgtggacctgcatcccgcctccgcttggaccctttacgccgttgctacaacgattatcacccctatgatgcggcacacaattgaaaacaccacagccaatatcagcctgaccgcgatcgccaaccaggctgccattctcatgggactggataagggctggcccatctctaaaatggacattggcgtgcctctgctcgctcttgggtgctatagccaggtcaatcccctgacgctgaccgccgctgtgctcatgctggttgcccattacgcgatcattggaccgggccttcaagccaaggctacacgcgaggcccagaagagaaccgctgccgggatcatgaaaaaccctacagtggatggaatcgtcgccattgacctggatcccgtggtgtatgacgcgaagtttgaaaaacagctcggccagatcatgctgctgattctctgtacctcccaaatccttctgatgcggacgacatgggctctgtgcgagtctattaccctcgccacagggcccctgaccaccctttgggagggaagccctggcaagttctggaatacaacgatcgctgtttccatggccaacatcttccgcggcagctacctggccggggctggactcgccttttccctgatgaaatctctgggcgggggaagacggggcaccggggcgcagggagaaacactcggcgagaagtggaagcgccagcttaatcagctgagcaaatccgagttcaacacctataagagatctggcattatggaggtcgaccggagcgaagccaaagaggggctgaagagaggagagacaaccaaacacgctgtgtcccgcggcacggccaagctccggtggtttgtggaaagaaatctggtcaagccggaggggaaagttatcgatcttggatgtggccgcgggggatggtcttactattgcgctggcctgaagaaagtgacagaagtgaagggctacaccaaagggggacccggccacgaggaacctattcccatggccacctacgggtggaacctcgtcaagctgcatagcggaaaagacgtgttctttatccctcccgagaagtgtgatacactgctctgcgacattggcgagtccagccctaatccgaccatcgaagaggggcggacacttagagttctgaagatggtggaaccctggctgcgcggaaaccaattctgtattaaaatcctcaatccttatatgccctctgtcgtggagacgctggagcagatgcagcggaagcacggcggcatgcttgttagaaaccctctgtcccgcaatagcacccatgaaatgtactgggtgtcttgcgggacaggaaacatcgtctccgcggtgaatatgaccagccggatgctcctgaacagatttacaatggtgcaccgcaaacccacctatgagcgggatgtcgacctgggcgccgggacgagacacgttgctgtggaaccggaggtggccaacctcgatattatcggacagcgcattgaaaatatcaagcatgagcacaaatctacctggcattacgacgaggataacccttataagacatgggcttaccacggctcctatgaagtcaagcccagcgggtccgccagctctatggtgaatggagttgtgaaactgcttaccaagccctgggacgtcattcctatggtgacacaaatcgctatgaccgatacaacccccttcggccagcagagagtttttaaagagaaggtggacacgcggacacctaaagccaagcgcggcaccgcgcaaatcatggaagtcaccgccaagtggctgtgggggttcctcagcagaaacaaaaagccgcggatttgtacaagagaggaatttacgcggaaagtgcgctccaatgctgccatcggagctgttttcgtggacgagaaccagtggaactctgccaaggaggccgtcgaagatgagagattttgggacctggtgcatcgggaacgcgagcttcacaaacagggcaagtgcgcgacctgcgtctacaacatgatggggaagagagagaagaagctgggagagttcggcaaagctaaggggagccgggccatttggtacatgtggctcggcgcccgcttcctggagtttgaagctctgggattcatgaatgaggatcactggttttccagagaaaactctctcagcggcgtggagggggagggactgcataaacttggctatatcctgcgggacatttccaagatccccgggggaaatatgtacgccgatgacacagctggctgggatacccgcatcacagaagacgatctccagaacgaggccaaaattaccgacatcatggaacctgagcacgcgctgcttgccaagtctattttcaagctgacatatcaaaataaagttgtgagagtccagcggcccgctaagaacgggaccgtgatggatgtgatcagccgcagagaccagcggggctccggacaggttggcacgtacgggctcaatacctttacaaacatggaagcccaactgattcgccagatggagagcgagggaatcttctctccttccgaactggagacccccaacctcgctggcagagtgctggattggcttgaaaaacatggggtcgagcggctgaagagaatggccatcagcggagacgactgtgtggttaaaccgattgatgaccgctttgcgacagccctcaccgctctgaatgatatgggcaaggtgcggaaggacatccctcagtgggaaccctctaaagggtggaacgattggcagcaagtccctttctgctcccaccactttcatcagcttattatgaaggacggcagagagatcgtggtcccctgtcgcaatcaggatgagctggtgggacgggccagagttagccagggcgctgggtggtccctccgcgaaacggcctgcctgggaaaatcttatgctcaaatgtggcagctgatgtacttccaccggagagacctccgcctggccgcgaacgccatttgtagcgctgtgcctgtcgattgggtgcccacatcccggaccacatggagcatccatgcccaccatcagtggatgaccacggaggacatgctttctgtttggaatagagtgtggattgaagagaacccgtggatggaagataagacccacatctccagctggggcgacgtcccttatctggggaaacgcgaggaccaatggtgcggatctctcatcggcctgacagcccgggctacctgggccacaaatattcaggtggcgatcaaccaggtgagacggcttattgggaatgagaactacctggattacatgaccagcatgaagagatttaagaatgaatccgaccccgagggcgctctctggtga

SEQ ID NO: 18991 - RNA, 9879 nt, synthetic construct
  misc_feature 1..9879: note = derived and/or modified CDS sequence (opt5) from DENV-1__FJ882530__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagccacacacaggtttgcgaccaccggctgatgtctgccgctatcaaggattccaaagccgtgcatgccgacatgggctattggattgaaagcgagaagaatgaaacctggaaacttgctagagcctctttcatcgaggtgaaaacatgtatctggcccaagtcccacaccctctggagcaacggggtcctggaatctgagatgattatcccgaaaatttacggaggccctatcagccagcataattatcgccccgggtactttacacaaaccgcgggaccttggcacctgggcaagctcgagctggatttcgacctttgcgaagggacgaccgtggttgtggatgagcactgcggaaaccggggcccctccctgagaacaaccacagtcaccggcaaaattatccatgaatggtgttgccggagctgtacgctccctcccctgcgctttaagggggaggacggatgctggtacggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctatctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccaccaactgtgggctacccttctgtctctcacatttattaagaccacgttctccctgcattacgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttatgtgatttctggaagctccgctgacctttctctggagaaggccgccgaggtcagctgggaagaggaagctgagcactccggcgcgtctcataatatcctggtggaagttcaggatgacgggacgatgaaaattaaggatgaggagcgggacgataccctcacaatcctgcttaaggccaccctgctcgctgtgagcggagtctaccctctgtccatccccgccacactcttcgtgtggtatttttggcagaaaaagaaacaacgctctggcgtcctgtgggacaccccttcccctcccgaagtggagagagccgttcttgatgacggcatttaccggatcatgcagcgcgggctgctgggaagatcccaggtgggcgtcggggtgttccaggaaaacgtttttcacacgatgtggcacgtgacccggggagctgtcctcatgtatcaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtacggcaatggggttgtgacgacctccggaacatatgtctctgctatcgcccaagcgaaagctagccaggagggccccctccctgagatcgaagacgaggtgttcagaaagcgcaacctgaccattatggatcttcatcccgggtccggaaagacccggagatacctgcccgccatcgttcgcgaagccattaaacggaagctgagaacactcatcctggctcctacgcgcgtggtcgccagcgagatggctgaagcccttaaaggcatgccgattcggtatcagaccacagcggtgaagtctgagcacaccgggaaagagatcgttgacctgatgtgccatgccacatttaccatgagactcctgtcccccgtgcgcgtccctaattacaacatgatcattatggatgaagctcacttcacggaccccagctctatcgccgctcggggctatattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatacgagtggatcacagattttcccggcaagaccgtttggttcgtgccttctattaagagcgggaatgacatcgccaactgtctgcgcaagaatggaaagcgggtgattcagctctcccgcaaaacattcgataccgaatatcagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccataataaagagggggatcagtacatctatatgggacagcccctcaacaatgacgaggatcacgcccactggaccgaagctaagatgctgcttgacaacattaatacgcccgagggcatcattcctgccctgttcgaacccgagcgcgaaaaatccgcggccatcgatggggagtaccggctcagaggagaggctcgcaagacctttgtggaactgatgagacggggcgacctgcctgtctggctcagctataaagtggcctccgaggggttccagtactctgatcgcagatggtgctttgacggcgaacggaacaatcaagtccttgaggaaaacatggatgtggagatttggacaaaggagggagaacgcaaaaagctgagaccgcggtggctggacgctagaacctatagcgaccccctcgccctgcgcgagttcaaggaatttgctgccggccggagatccgtttctggggatcttatcctggagatcggaaaactccctcagcatctgacacagcgcgcgcagaatgccctggacaacctcgtgatgcttcacaatagcgaacaaggcgggcgggcttacagacatgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcactggatcgcggcctctattatcctcgagttctttctgatggtccttctgatccccgagccggaccgccagagaacccctcaggataaccagctcgcttatgtggttattgggctgctgttcatgatcctcaccgtggccgccaatgagatgggacttctggaaacaaccaaaaaggacctgggcattgggcacgtcgctgtggagaaccatcaccatgccgcgatgctcgatgtcgacctgcaccccgcctccgcttggacactttacgccgtggctacgaccatcattacacctatgatgcggcataccatcgaaaacacaaccgccaatattagcctgacggcgatcgccaaccaagctgccatcctcatgggactggataaaggctggcccatttctaagatggacatcggcgttcctctgctcgctcttgggtgctacagccaggtgaatcccctgaccctgacagccgctgtcctcatgctggtggcccactatgcgattatcggaccgggccttcaggccaaggctacccgcgaggcccagaagagaacagctgccgggattatgaagaaccctaccgttgatggaatcgtggccatcgacctggatcccgtcgtgtacgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctatctggccggggctggactcgccttttccctgatgaagtctctgggcgggggaagacggggcacaggggcgcaaggagaaaccctcggcgagaagtggaaacgccagcttaatcagctgagcaagtccgagttcaacacatacaaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttattactgcgctggcctgaaaaaggttaccgaagtgaaaggctataccaaagggggacccggccatgaggaacctatccccatggccacatacgggtggaacctcgtgaaactgcacagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttacatgccctctgtggtcgagaccctggagcaaatgcagcggaaacatggcggcatgcttgtgagaaaccctctgtcccgcaatagcacacacgaaatgtattgggtttcttgcgggaccggaaacatcgtgtccgcggtcaatatgacaagccggatgctcctgaacagatttaccatggcccaccgcaagcccacgtacgagcgggatgtggacctgggcgctgggaccagacatgtggccgtcgaaccggaggttgctaacctcgatatcattggacagcgcatcgaaaatattaaacacgagcataagtctacatggcactatgacgaggataacccttacaagacctgggcctatcatggctcctacgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcaccgggaacgcgagcttcacaagcagggcaagtgcgctacatgcgtctataacatgatggggaaaagagaaaagaaactgggagagttcggcaaggccaaagggagccgggccatctggtacatgtggctcggcgctcgcttcctggagtttgaagccctgggattcatgaatgaggatcattggttttccagagaaaactctctcagcggcgtggagggggagggactgcacaaacttggctacattctgcgggacatctccaaaattcccgggggaaatatgtatgctgatgacaccgccggctgggatacacgcatcaccgaagacgatctccagaacgaggcgaagatcacagacattatggaacctgagcatgccctgcttgctaagtctatcttcaaactgacctaccagaataaggtcgtgagagttcaacggcccgccaaaaacgggacggtgatggatgtcattagccgcagagaccagcggggctccggacaggtgggcacctatgggctcaatacatttaccaacatggaagctcagctgatccgccaaatggagagcgagggaattttctctccttccgaactggagacacccaacctcgccggcagagtgctggattggcttgaaaagcacggggttgagcggctgaaaagaatggcgatcagcggagacgactgtgtggtcaagccgatcgatgaccgctttgccaccgctctcacggccctgaatgatatgggcaaggtgcggaaagacattcctcagtgggaaccctctaaggggtggaacgattggcagcaggttcctttctgctcccaccattttcaccaacttatcatgaaagacggcagagagattgtggtcccctgtcgcaatcaggatgagctggtgggacgggctagagtcagccagggcgccgggtggtccctccgcgaaacagcttgcctgggaaagtcttacgcccagatgtggcaactgatgtatttccatcggagagacctccgcctggcggccaacgctatctgtagcgccgtgcctgttgattgggtgcccacctcccggacaacctggagcattcacgcccatcaccagtggatgacgaccgaggacatgctttctgtctggaatagagtgtggatcgaagagaacccgtggatggaagataaaacacacatttccagctggggcgacgttccttacctggggaagcgcgaggaccagtggtgcggatctctcatcggcctgaccgctcgggccacatgggcgaccaatatccaagtggctattaaccaggtcagacggcttatcgggaatgagaactatctggattacatgacaagcatgaagagatttaaaaatgaatccgaccccgagggcgccctctggtga

SEQ ID NO: 18992 - RNA, 9879 nt, synthetic construct
  misc_feature 1..9879: note = derived and/or modified CDS sequence (opt5) from DENV-1__GQ868605__SS-prME
  source 1..9879: mol_type = other RNA
agcgtgaccatgctgctcatgctgatgcccacagcccttgctttccacctgacgaccagaggcggggagcctcatatgatcgtcaccaagcaggaacgggggaaatccctcctgtttaagacctctgttggcgtgaacatgtgcacacttattgccatggacctgggggagctctgtgaagataccatgacatacaaatgcccgcgcatcaccgaggcggaacccgacgatgtggactgttggtgcaatgctacggatacctgggtcacatatggaacctgtagccaaacaggcgagcacagacgggacaagcgctccgtggccctggcccctcatgttgggctgggactcgagaccagaacggaaacatggatgtctagcgagggcgcttggaaacagattcagcgggtggaaacctgggccctgcgccaccccggcttcacagtcatcgctctttttctggcccatgcgattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataaacccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggttggagaaaaagcccttaagctctcttggttcaagaaaggcagctccattgggaagatgtttgaggccacagctagaggcgcccgccggatggctatcctgggagataccgcctgggacttcggctctatcgggggagtctttacaagcgtgggcaaactggtgcatcagattttcgggaccgcgtacggagtcctcttttccggcgtgagctggacgatgaagatcgggattggcgttctgcttacctggctgggactcaattctagatccacaagcctgtctatgacctgtatcgccgtgggcctggtcacactttacctcggggtgatggttcaggctgattccggatgcgtgattaactggaaaggccgcgaactgaagtgtgggagcggaatcttcgtcaccaatgaggtgcacacatggaccgaacaatataagtttcaggccgactcccctaaacggctgtctgctgccattggcaaggcgtgggaggagggggtttgcggcatcagaagcgccacgcgcctcgaaaacatcatgtggaaacagatttccaacgagctgaatcatatccttctggaaaacgacatgaagttcacagtggtcgtgggagatgtggtcggcattctcgctcaggggaaaaagatgatccggccgcaacccatggagcacaaatactcttggaaaagctggggaaaggccaagattatcggcgctgacgttcagaataccacctttatcattgatgggcctaacacacccgaatgtcctgacgatcagagagcctggaatatctgggaggtggaggactatggattcggcatttttaccacgaacatctggctgaagctgcgcgattcctacacacaggtgtgcgaccaccggcttatgagcgccgctattaaagattctaaggcggtccatgccgacatgggctattggatcgaatccgagaaaaatgatacctggaagctcgctagagccagcttcatcgaagtgaagacatgtatttggcccaaatctcacaccctgtggtccaacggggttctggagagcgaaatgatcattccgaagatctacggaggccctatttctcaacataattatcgccccgggtacttcacacagaccgccggaccttggcacctcggcaaactggagcttgactttgatctgtgcgaggggacgaccgtggtcgtggacgaacactgcggaaaccggggccccagcctcagaacaaccacagttaccggcaagatcatccatgagtggtgttgccggtcctgtacgctgcctcccctgcgcttcaaaggggaagacggatgctggtacggcatggagattagaccggtgaaggagaaggaagagaatcttgtcaaaagcatggtgtctgctgggtccggagaagttgatagcttttccctcggcctgctgtctatcagcattatgatcgaggaagtgatgcggtccagatggtctcgcaagatgctcatgacagggaccctggccgtcttccttctgctcattgtgggacagctgacatggaacgacctgatccggctttgtattatggtgggcgcgaatgctagcgatagaatgggcatggggaccacctatctggccctcatggccacatttaaaatgcgccctatgttcgctgtcggactgctctttagacggctgacgtcccgcgaggttcttctgctcaccatcggcctgtctctggtggccagcgtggagcttcccaactccctggaagaactcggggacggactggcgatgggcatcatgattctcaagctgcttacagatttccaaagccaccagctgtgggctaccctcctgtctctgacatttatcaaaaccgccctttccctgcattacgcctggaagacgatggctatggtcctcagcattgtgtctctgttccccctctgcctgtccacaaccagccagaagaccacatggcttcctgttctgctggggtctctcggatgtaaaccgctgaccatgtttcttatcgccgaaaataagatttggggcagaaaatcctggcccctgaacgagggcatcatggctgtgggggtcgtgagcatcctcctgtccagcctcctgaagaacgacgttcctcttgccggacccctgattgcgggcgggatgctgatcgcctgctatgtgatttctggaagctccgctgatctctctctggaaaaagccgctgaggtcagctgggaggaagaggccgaacactccggcgcctctcataatatccttgtggaggtccaggacgatgggacaatgaagattaaagacgaagaacgggatgacacgctgaccatcctcctgaaggctacactcctggcggtgagcggagtttaccctctttccatccccgccaccctgttcgtgtggtatttttggcaaaagaaaaagcagcgctctggcgtcctgtgggatacacctagccctcccgaggtggaaagagctgttctcgacgacggcatttaccggatcatgcagcgcgggctgcttggaagatcccaggtgggcgtcggggtgttccaagagaacgtgttccacaccatgtggcacgttacgcggggagccgtcctgatgtatcagggcaaacgcctcgaacccagctgggcctctgtgaagaaagatctgatttcctacgggggaggctggagactccagggcagctggaataccggggaggaggtgcaggtcatcgctgtggaacccggaaagaaccctaagaatgttcaaacagcccccggcacctttaaaacaccggagggggaagtgggagcgattgctctggacttcaagcctggcacctctgggtcccccatcgtcaaccgggagggaaaaattgtgggcctttacggcaatggggttgtgacaacgagcggaacctatgtctccgccatcgcccaggctaaggcctctcaggaaggccctctgcccgagatcgaggatgaagtgtttagaaaacgcaacctgacaattatggacctccatcccgggagcggaaagacccggagatacctgcctgcgatcgttcgcgaggctattaagcggaaacttagaaccctgatcctcgccccgacacgcgtggtcgcctccgaaatggctgaggccctgaagggcatgcccattcggtatcaaacgaccgctgtgaaaagcgaacacacagggaaggagatcgtggatctgatgtgtcatgccaccttcacaatgagactcctttctcctgtccgcgttcccaattacaacatgatcattatggacgaggcgcactttaccgatccttccagcatcgccgctcggggctatatttctacgagagtgggaatgggcgaagccgctgccatcttcatgacagccacaccccctgggagcgtggaggcttttccgcagtccaatgcggtcattcaggacgaagaacgggatatccccgaacgctcttggaacagcggatacgagtggatcaccgacttccctggcaaaacagtgtggtttgttccctccattaagtctgggaatgatatcgccaactgcctgagaaagaatggaaaacgggtgattcagctgagccgcaagaccttcgagacagaatatcagaagaccaagaacaacgactgggactacgtcgtgacgacagatatctccgagatgggcgctaattttagagccgaccgggttattgatcctagacgctgtctcaaacccgtgatcctgaaggacgggagcgaacgggtcattcttgccggcccgatgcctgtgaccgtcgcttctgccgcgcagagacgcggacggatcggcagaaaccataataaggagggggatcagtacatctatatgggacagcccctgaacaatgacgaggatcacgctcactggacagaagccaaaatgctcctggacaacattaatacccccgagggcatcattcctgccctgttcgaacccgagcgcgaaaagtccgctgccatcgatggggagtaccggctcagaggagaggcgcgcaaaacgttcgtggaacttatgagacggggcgacctgcctgtttggctgagctataaggtggcctccgaggggtttcaatactctgatcgcagatggtgcttcgacggcgaacggaacaatcaggtgctcgaggaaaacatggatgtcgagatttggaccaaagagggagaacgcaagaaactgagaccgcggtggcttgacgctagaacatatagcgaccccctggccctccgcgagtttaaggagttcgctgccggccggagatccgtttctggggatctgatcatcgagattggaaagctgcctcagcatctcacccagaaagctcaaaatgcccttgacaacctggtgatgctgcacaatagcgaacagggcgggcgcgcgtaccggcatgccatggaggagctccccgatacaatcgaaaccctgatgcttctggctctcattgccgtgctgacaggaggcgtcaccctgtttttcctctccggcagagggcttggaaagacgagcatcggcctgctgtgcgtgatggcttcttccgttctcctgtggatggccagcgtggagcctcactggattgccgcttctatcatccttgaatttttcctgatggtcctcctgattcccgagccggaccggcagcgcacacctcaggataaccaactggcgtatgtggtcatcgggctcctttttatgattctgaccgtggccgctaatgagatgggactgctcgaaaccaccaaaaaggacctgggcatcgggcacgttgccgtggagaaccatcaccatgccaccatgcttgatgtcgacctgcaccccgcttccgcctggacactctacgcggtggccacgaccattatcacacctatgatgagacataccattgaaaacacaaccgctaatatcagcctgacggccatcgctaaccaggccgcgattctgatgggactcgataaaggctggcccatctctaagatggacattggcgttcctcttctggccctggggtgttacagccaggtgaatcccctcaccctgacagctgccgtccttatgctggtggctcactatgccatcattggaccgggcctccaagctaaggccacccgggaggcgcagaaacgcacagccgctgggatcatgaagaaccctaccgtggatggaatcgttgccattgacctggatcccgtcgtgtacgacgctaaattcgaaaagcagctgggccagatcatgctccttattctgtgcacgtcccaaatcctgctcatgagaacaacctgggccctgtgtgagtctattacacttgccaccgggcccctgaccacactctgggagggaagccctggcaaattttggaatacgaccatcgcggtgtccatggctaacatcttccggggcagctatctggccggggctggactggccttttccctcatgaagtctcttggcgggggacgcagaggcacaggggcccagggagaaaccctgggcgagaagtggaaacggcagctgaatcagctcagcaagtccgagttcaacatttacaaacgctctggcatcatggaggtcgacagaagcgaagctaaggaggggctgaaacggggagagacaaccagacacgccgtttcccgcggcacggcgaaacttcggtggttcgtggaaagaaatctggtgaagccggaggggaaagtcattgatctcggatgcggccgcgggggatggtcttattactgtgccggcctgaagaaagtgacagaagttaagggctataccaaagggggacccggccatgaggaacctatccccatggctacctacgggtggaacctggtgaagctccacagcggaaaagacgtctttttcacacctcccgagaagtgcgatacccttctgtgtgacattggcgagtccagccctaatccgacaatcgaagaggggcggacgctgagagtgctcaagatggttgaaccctggctgcgcggaaaccaattttgcattaaaatccttaatccttacatgccctctgtggtcgagaccctggagcagatgcagcggaagcatggcggcatgctcgtgagaaaccctctgtcccgcaatagcacacacgaaatgtattgggtgtcttgtgggaccggaaacatcgtctccgccgttaatatgacaagccggatgctgctcaacagattcaccatggctcaccgcaaacccacgtacgagcgggatgtggacctgggcgccgggaccagacatgtggcggtcgaaccggaggtggccaaccttgatattatcggacagcgcattgaaaatatcaagcacgagcataaatctacatggcactatgacgaggataacccttacaagacctgggcttatcatggctcctacgaagttaagcccagcgggtccgccagctctatggtgaatggagtcgtgaaactgctcacaaagccctgggacgttattcctatggtgacccaaatcgctatgacagataccacgccctttggccagcagagagtcttcaaagagaaggtggacacacggacccctaaagccaagcgcggcaccgctcaaatcatggaagttacagccagatggctgtggagctttctttcccggaacaagaaaccgagaatttgcacgcgggaggagttcacccgcaaggtgagatctaatgcggccatcggggctgtctttgtggacgagaaccagtggaatagcgccaaagaggctgtcgaagatgagcggttctgggacctggtgcagaaggaacgcgagctccacaaacagggaaagtgtgccacatgcgtttataacatgatgggcaagagagagaaaaagctgggggagtttggaaaagccaagggctcccgggcgatttggtacatgtggctgggggctcgcttcctcgagtttgaagccctgggcttcatgaatgaggatcactggttctctagagaaaacagcctttccggagtggagggcgaggggctgcataaactcggatacatcctgcgggacatttctaagatccccggcgggaatatgtatgccgatgacaccgctggatgggatacacgcatcaccgaagacgatcttcaaaacgaggccaaaattacagacatcatggaacctgagcacgctctgctcgccaccagcatttttaagctgacgtaccagaataaggtcgtgagagtgcagcggcccgcgaaaaacggcaccgttatggatgtgatctcccgcagagaccagcgggggagcggccaagtcggaacatatggcctgaataccttcacaaacatggaagcccagctcattcgccagatggagtctgaggggatctttctgccttccgaacttgagacccccaacctggctgaaagagtgctcgattggctggagaagcatggagttgaacggcttaaaagaatggccatcagcggcgacgactgcgtggtcaagccgattgatgaccgcttcgctacggccctgacagcgctcaatgatatggggaaagtgcggaaggacatccctcagtgggagccctctaagggatggaacgattggcaacaggtccctttttgttcccaccacttccatcagctgattatgaaagacggcagagagatcgtggttccctgccgcaatcaggatgaactggtggggcgggccagagtcagccaaggcgctggatggtccctccgcgagaccgcctgtctgggcaagtcttacgctcagatgtggcagcttatgtattttcaccggagagacctgcgcctcgccgctaacgccatttgcagcgcggtgcctgttgattgggtgcccacatcccggaccacgtggagcatccatgcccaccatcaatggatgaccacagaagacatgctgtctgtctggaatagagtgtggattgaggaaaacccgtggatggaggataaaacccacgtgtccagctggggagacgttccttaccttggaaagcgcgaggaccagtggtgtggctctctgatcgggctcacagctcgggccacctgggccagcaatatccaggtcgctattaaccaggtgagacggctgatcggaaatgaaaactatctggattacatgacatccatgaaaagattcaagaatgagggcgaccccgaaggggccctctggtga

SEQ ID NO: 18993 - RNA, 9879 nt, synthetic construct
  misc_feature 1..9879: note = derived and/or modified CDS sequence (opt5) from DENV-1__FJ882534__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagagcaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaccgcaagagggcgctatgcacacagccctgacgggggccaccgaaattcagacaagcggaaccacaaccatctttgctggccatctcaaatgcagactgaagatggataaacttacgctgaaggggatgtcctatgtgatgtgtacaggcagcttcaaactcgagaaggaagtcgccgagacccagcacggaaccgtgctggttcagattaagtacgagggcacagacgcgccttgcaaaatccccttctctacccaagatgaaaagggggtgacacagaacggacggctgatcacggctaatcctattgtcaccgacaaagagaagcccgtgaacatcgaagccgagcccccttttggcgagtcctatattgtgatcggggccggagaaaaagctcttaagctcagctggttcaagaaaggctctagcattgggaagatgtttgaggccacagctagaggcgcccgccggatggcgatcctgggagataccgcctgggacttcggctccatcgggggagtttttacatctgtcggcaaactggtgcatcagattttcgggaccgcttacggagtgctctttagcggcgtctcctggacgatgaagatcgggattggcgtgctgcttacctggctgggactcaatagcagatctacatccctgagcatgacctgtatcgccgttggcctggtgacactttacctcggggtcatggtgcaggctgattctggatgcgttattaactggaaaggccgcgaactgaagtgtgggtccggaatcttcgtgaccaatgaggtccacacatggaccgaacaatataagtttcaggccgacagcccgaaacggctgtccgcggccattggcaaggcttgggaggagggggtgtgcggcatcagatctgccacgcgcctcgaaaacatcatgtggaaacagattagcaacgagctgaatcatatccttctggaaaacgacatgaagctcacagttgtggtcggagatgtggctggcattctggggcagggaaaaaagatgatccggccccaacctatggagtacaaatattcctggaagtcttggggcaaggccaaaattatcggggccgacgctcagaataccaccttcatcattgatggacccaacacacctgaatgtcccgacgatcagagagcgtggaatatctgggaggtggaggactacggctttggcattttcaccacgaacatctggctgaagcttcgcgatagctatacacaggtctgcgaccaccggctcatgtccgccgctattaaagatagcaaggccgttcacgccgacatggggtactggatcgaatctgagaaaaatgaaacctggaagctggctagagcctcctttatcgaggtgaagacatgtatttggccgaaaagccataccctgtggtctaacggagtgctcgaatccgagatgatcattcctaagatctatggcgggcccattagccaacacaattaccgccctggatacttcacacagaccgcgggcccctggcatctggggaaacttgagctggatttcgacctctgcgaaggaacgaccgtcgtggttgatgagcactgcggcaaccggggcccttctctgagaacaaccacagtgaccgggaagatcatccacgaatggtgttgccggagctgtacgctgcccccgcttcgctttagaggagaggacggctgctggtatgggatggagattcggcctgtcaaagaaaaggaggaaaatctcgtgaagtccatggttagcgctggatctggcgaggtggactccttcagcctggggctgctctgtatctccattatgatcgaagaggtcatgagatctcgctggagccggaaaatgctgatgacaggaacccttgccgtgtttttcctgctcattatgggccagctgacatggaacgatctgatcagactttgcattatggttggcgccaatgcttccgaccgcatggggatgggaaccacctacctggccctcatggcgacatttaagatgagacccatgttcgctgtgggcctgctctttcggcgcctgacgtctagagaggtccttctgctcaccatcgggctgagcctggtggcctccgtggaacttcccaactctctggaggaactcggagatggcctggccatggggatcatgattctcaaactgcttacagacttccaaagccatcagctgtgggctaccctcctgtccctgacatttatcaagaccacgttcagccttcactatgcctggaaaacaatggctatggtcctgtctattgtttccctctttcctctgtgtctcagcaccacctctcagaagacaacctggctgccggtgcttctgggatccctgggctgcaagcccctcacaatgttcctgatcgtggagaataaaatttggggccggaagagctggcctcttaacgaagggatcatggccgtcggaatcgtgtctattctgctctccagcctgctcaaaaacgatgttcccctggcgggccctcttatcgccgggggaatgctgattgcttgttacgtgatctccggcagctctgccgacctgagcctcgagaaggctgccgaggtctcctgggaagaggaagccgagcattctggggctagccacaatattctggtggaagttcaggatgacggaacgatgaaaatcaaggatgaggagcgcgacgatacccttacaatcctgctcaaagcgaccctgctcgccgtgtccggcgtctatcccctgtctattcctgctacactttttgtgtggtacttctggcaaaagaagaaacagagaagcggcgtcctgtgggacaccccctccccgcctgaagtggagcgggccgttctggatgacgggatctatcgcattatgcagagaggactcctgggccggtctcaggtgggggtcggagtgttccaagaaaacgtttttcatacgatgtggcacgtgacccgcggcgccgtccttatgtaccaggggaagagactggagcccagctgggcttccgtgaaaaaggacctcatcagctacggaggcggctggcggctgagagggtcttggaatacaggagaggaagtgcaggttattgccgtcgagcctggcaaaaaccccaagaatgtgcagaccgcgccggggacattcaagacccctgaaggagaggtgggcgctatcgccctcgattttaaacccgggacatccggaagccctattgtcaaccgcgaaggcaagatcgtgggcctgtatgggaatggagttgtgacgacctctggcacatacgtctccgccatcgctcaagccaaagcgagccaggaggggccccttcccgagattgaagacgaggtgttccggaagagaaacctgaccatcatggatctgcaccctggatccggcaaaacccgccggtatctcccggctattgttagagaagccatcaagcgcaagctgcggacacttattctggcccccacgagagtggtcgcttctgagatggccgaagctctcaaagggatgcctatccgctaccagaccacagccgtgaagagcgagcataccggcaaagagatcgttgacctgatgtgccacgcgacatttaccatgcggctgctctcccccgtgagagtccctaattataacatgattatcatggatgaagcccatttcacggaccccagctctattgctgcccggggatacatctccacacgcgtgggcatgggggaggctgccgccatttttatgaccgctacccctccgggaagcgtggaagcgttcccccaatctaatgccgtcatccaggatgaggaaagagacatccctgagcggagctggaactccggctatgagtggattacagattttcccgggaagaccgtttggttcgtgccttctatcaaaagcggaaatgacattgctaactgtcttcgcaagaatggcaagagagtgatccagctgtcccggaaaacatttgataccgaataccagaagacgaaaaacaacgactgggactacgtcgtgacaaccgatatttctgagatgggggccaatttcagagccgaccgcgttatcgatccccggagatgcctgaagccggtgattctcaaagacggccctgaacgcgtcatcctggctggacccatgcccgtgacagttgccagcgcggctcaacggagaggccgcatcgggcggaaccacaataaggagggagatcagtatatttacatgggccagcctcttaacaatgacgaggatcatgcccactggaccgaagccaagatgctgctcgacaacatcaatacgcccgaggggattatccctgctctgttcgaaccggagagagaaaaatccgccgcggtggatggagagtatcgcctgagaggcgaggcccggaagacctttgtcgaactcatgcgcagaggggaccttcccgtgtggctgagctacaaagtcgcttctgagggcttccagtattccgatcggcgctggtgctttgacggagaaagaaacaatcaagtgctggaggaaaacatggatgttgagatttggacaaaggagggcgaacggaaaaagctcagacctcgctggctggacgcccggacctacagcgacccccttgctctgagagagttcaaagaatttgccgctgggcgccggtccgtgtctggagatctcatcctggagatcggcaagctgcctcagcacctcacacagagagcccagaatgcgcttgacaacctggtgatgctgcataatagcgaacaagggggacgggcctatcgccacgctatggaggagctccccgataccattgaaacactgatgcttctggccctcatcgctgtcctgaccggcggcgttacgctgttctttctctccgggagaggacttggcaagacatctattgggctgctgtgtgtgatggccagctccgtgctcctgtggatggccagcgtcgagccgcattggatcgctgcgtctattatccttgaattctttctgatggtgctcctgatccctgagcccgaccggcagcgcacccctcaggataaccagctggcctacgttgtgattggactccttttcatgatcctgaccgtcgctgccaatgagatgggcctgctcgaaacaaccaaaaaggacctggggattggacacgtggccgtcgagaaccaccatcacgctgccatgcttgatgtggacctgcatcccgcgtccgcctggacactctacgctgttgccacgaccatcattacacctatgatgagacacaccatcgaaaacacaaccgctaatattagcctgacggccatcgcgaaccaagccgctatcctgatgggcctcgataaaggctggcccatttctaagatggacatcggggtgccgcttctggccctgggatgctattcccaggtcaatcctctcaccctgacagctgccgtgcttatgctggttgctcattacgccattatcggccccgggctccaggcgaaagccacccgggaggctcaaaagcgcacagccgctggaattatgaagaaccccaccgtggatggcatcgtcgccatcgacctggatcctgtggtgtatgacgccaaatttgaaaagcagctggggcagattatgctccttatcctgtgtacgagccagattctgctcatgagaacaacctgggcgctgtgcgagtctatcacacttgctaccggaccgctgaccacactctgggagggcagccccggcaaattctggaatacgaccattgccgtttccatggctaacatctttcgggggtcttacctggccggagccggcctggctttcagcctcatgaagtcccttgggggaggccgcagagggacaggagcccaaggcgaaaccctgggcgagaaatggaagcggcagctgaatcagctcagcaagtccgaattcaacacatataaaagatctgggatcatggaggtcgaccgcagcgaagcgaaggagggactgaaacggggcgagaccacgaagcacgccgtgtccagagggacagctaaacttcgctggtttgtggaacggaatctggtcaagcctgagggaaaggttattgatctcggctgtgggagaggaggctggtcttactattgcgccggcctgaaaaaggtgaccgaagtgaaagggtacaccaagggaggccccgggcacgaggaacctatccccatggctacatacggatggaacctggtcaaactccatagcggcaaggacgtgttctttattcctccggagaaatgtgatacccttctgtgcgacatcggggagtcctctcccaatcctacaattgaagagggacgcacgctgcgggttctcaagatggtggaaccctggctgagaggcaaccagttctgtatcaagattcttaatccttatatgcccagcgtcgtggagaccctggagcaaatgcagcgcaaacacggcgggatgctcgttcggaacccgctgtccagaaatagcacacatgaaatgtactgggtgtcttgcggaaccggcaacatcgtctccgccgtgaatatgacaagccgcatgctgctcaaccggtttaccatggcgcacagaaagcctacgtatgagcgcgatgtggacctggggaccggaacaagacacgtcgccgttgaacccgaggtggctaaccttgatatcattggccagcggatcgaaaatattaaacatgagcacaagtctacctggcattacgacgaggataacccctataaaacatgggcctaccacgggtcctatgaagtgaagcctagcggatctgcttccagcatggtcaatggcgtggttaagctgctcaccaaaccctgggacgtgatccctatggtcacacagattgccatgaccgatacgacaccgttcggccaacagcgcgtgtttaaggagaaagttgacaccagaacccccaaggctaaacgggggacagcccagatcatggaagtgacggcgagatggctgtggggattcctttcccggaacaagaagcctcgcatctgtaccagagaggaatttacacggaaagtccgcagcaatgccgctattggcgccgtgttcgttgacgagaaccaatggaattctgctaaggaggccgtggaagatgagagattttgggacctggtccatcgggaacgcgagctccacaaacaggggaagtgcgccacctgcgtgtacaacatgatgggaaaaagagaaaagaagctgggcgagttcgggaaagcgaagggcagccgggctatctggtacatgtggctgggagcccgctttctcgagttcgaagccctgggcttcatgaatgaggatcactggttttccagagaaaactctcttagcggggtcgagggagagggcctgcataaactcgggtatattctgcgggacatctccaagattcccggaggcaatatgtacgctgatgacacagccgggtgggatacccgcatcacagaagacgatcttcagaacgaggctaaaatcaccgacattatggaacctgagcacgccctgctcgcgaaggccatcttcaaactgacgtatcagaataaggtggttagagtgcaacggcccgctaagaacggcaccgtcatggatgtgatttctcgcagagaccagcggggaagcggccaggtggggacatacggactgaatacctttacaaacatggaagcccagctcatcagacaaatggagtccgagggcattttctctccgagcgaactggagacccctaaccttgctgaacgcgccctggattggctcgagaaatatggggttgaacggctgaagagaatggcgatctccggagacgactgtgtggtcaaacccatcgatgaccgctttgccacggctcttacagccctgaatgatatgggcaaggtgcggaaagacattcctcagtgggagcccagcaaggggtggaacgattggcagcaggttcctttctgctctcatcactttcaccaactcatcatgaaggacggcagagagattgtggtcccctgtcgcaatcaggatgaactggtgggacgggctagagtctcccagggcgccgggtggagcctgcgcgagaccgcttgcctcggaaaatcttacgcccagatgtggcaactgatgtatttccatcggagagaccttcgcctggcggccaacgctatctgttccgccgtgccggttgattgggtgcctacaagccggaccacgtggtccattcacgcccatcaccagtggatgaccacagaagacatgctctctgtctggaatagagtgtggatcgaggaaaacccctggatggaggataagacccatattagctcctgggaggacgttccctacctgggcaaacgggaagaccagtggtgcgggagccttatcggactgacagctagagccacctgggcgacaaatatccaagtggctattaaccaggtccgccggctcatcggcaatgagaactacctggattatatgacctctatgaagagatttaaaaatgaatccgaccctgagggggccctgtggtga

SEQ ID NO: 18994 - RNA, 9879 nt, synthetic construct
  misc_feature 1..9879: note = derived and/or modified CDS sequence (opt5) from DENV-1__FJ882536__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgccggtctgttagcggagatctcatcctggagatcggcaagctgccccagcacctcacacagagagcgcagaatgcccttgacaacctggtgatgctgcataattccgaacaagggggacgggcttatcgccacgccatggaggagctccctgataccattgaaacactgatgcttctggctctcatcgccgtgctgaccggcggcgtcacgctgttctttctctctgggagaggacttggcaagacaagcattgggctgctgtgtgttatggcctccagcgtgctcctgtggatggcttctgtggagccccattggatcgcggcctccattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctacgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctatagccaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgtacgtctcagattctgctcatgagaacaacctgggctctgtgcgagagcatcacacttgccaccggacctctgaccacactctgggagggctccccgggcaaattctggaatacgaccattgctgtgtctatggccaacatctttcgggggagctacctggccggagctggcctggccttctccctcatgaaaagccttgggggaggccgcagagggacaggagcgcaaggcgaaaccctgggcgagaaatggaagcggcagctgaatcagctctccaagtctgagttcaacacatataaaagaagcgggatcatggaggttgaccgctccgaagccaaggagggactgaaacggggcgagaccacgaagcacgctgtctctagagggacagccaaacttcgctggtttgtggaacggaatctggtgaagcccgagggaaaggtcattgatctcggctgtgggagaggaggctggagctactattgcgctggcctgaaaaaggttaccgaagtgaaagggtacaccaagggaggccctgggcacgaggaacccatccctatggccacatacggatggaacctggtgaaactccattccggcaaggacgtcttctttattccccctgagaaatgtgatacccttctgtgcgacatcggggagtctagcccgaatcccacaattgaagagggacgcacgctgcgggtgctcaagatggttgaaccttggctgagaggcaaccagttctgtatcaagattcttaatccctatatgccttccgtggtcgagaccctggagcaaatgcagcgcaaacacggcgggatgctcgtgcggaaccccctgagcagaaattctacacatgaaatgtactgggtttcctgcggaaccggcaacatcgtgagcgcggtcaatatgacatctcgcatgctgctcaaccggtttaccatggcccacagaaagccgacgtatgagcgcgatgtggacctggggaccggaacaagacacgtggctgtcgaacctgaggttgccaaccttgatatcattggccagcggatcgaaaatattaaacatgagcacaagtccacctggcattacgacgaggataacccctataaaacatgggcttaccacgggagctatgaagtgaagccctctggatccgccagctccatggtgaatggcgtcgtgaagctgctcaccaaaccttgggacgttatccccatggtgacacagattgctatgaccgatacgacacctttcggccaacagcgcgtctttaaggagaaagtggacaccagaaccccgaaggccaaacgggggacagcgcagatcatggaagttacggccagatggctgtggggattccttagccggaacaagaagccccgcatctgtaccagagaggaatttacacggaaagtgcgctctaatgctgccattggcgctgtcttcgtggacgagaaccaatggaatagcgccaaggaggccgttgaagatgagagattttgggacctggtgcatcgggaacgcgagctccacaaacaggggaagtgcgcgacctgcgtctacaacatgatgggaaaaagagaaaagaagctgggcgagttcgggaaagctaagggctcccgggccatctggtacatgtggctgggagcccgctttctcgagttcgaagctctgggcttcatgaatgaggatcactggttttctagagaaaacagcctttccggggtggagggagagggcctgcataaactcgggtatattctgcgggacatctctaagattcctggaggcaatatgtacgccgatgacacagctgggtgggatacccgcatcacagaagacgatcttcagaacgaggccaaaatcaccgacattatggaacccgagcacgcgctgctcgccaaggctatcttcaaactgacgtatcagaataaggtcgtgagagttcaacggcctgccaagaacggcaccgtgatggatgtcattagccgcagagaccagcggggatccggccaggtggggacatacggactgaatacctttacaaacatggaagctcagctcatcagacaaatggagtctgagggcattttcagcccctccgaactggagaccccgaaccttgccgaacgcgcgctggattggctcgagaaatatggggtggaacggctgaagagaatggccatcagcggagacgactgtgttgtgaaacctatcgatgaccgctttgctacggcccttacagctctgaatgatatgggcaaggtccggaaagacattccccagtgggagccttctaaggggtggaacgattggcaacaggtgcccttctgctcccatcactttcaccaactcatcatgaaggacggcagagagattgttgtgccttgtcgcaatcaggatgaactggtcggacgggccagagtgagccagggcgctgggtggtctctgcgcgagaccgcctgcctcggaaaatcctacgcgcagatgtggcaactgatgtatttccatcggagagaccttcgcctggccgctaacgccatctgtagcgccgtccccgtggattgggttccgacatcccggaccacgtggtctattcacgctcatcaccagtggatgaccacagaagacatgctcagcgtgtggaatagagtctggatcgaggaaaacccttggatggaggataagacccatatttccagctgggaggacgtgccctacctgggcaaacgggaagaccagtggtgcgggtctcttatcggactgacagccagagcgacctgggctacaaatatccaagttgccattaaccaggtgcgccggctcatcggcaatgagaactacctggattatatgacctccatgaagagatttaaaaatgaaagcgaccccgagggggccctgtggtga

SEQ ID NO: 18995 - RNA, 9879 nt, synthetic construct
  misc_feature 1..9879: note = derived and/or modified CDS sequence (opt5) from DENV-1__FJ882537__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttattgcgatggacctgggggaactctgtgaagatacaatgacctacaaatgcccgagaatcacagaggtggaacccgacgatgtggactgttggtgcaataccacggatacctgggtcacatatggaacctgttcccagacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccattgccacaatcacaccccaggctcctacgtctgagattcagctcaccgactacggcgccctgacactggattgttcccccagaaccggcctcgacttcaacgaaatggtcctgcttacaatgaaagaaaagagctggctggtgcataaacagtggtttctcgatctgcctcttccctggacctccggggcctctacgagccaagagacatggaatcggcaggacctgctcgtcaccttcaagacagctcacgcgaagaaacaggaagtggttgtgctgggatcccaagagggcgccatgcacaccgctctgaccggggccacagaaatccagacgaccggaacaaccacaatttttgccggccatctcaagtgccgcctgaaaatggataaacttaccctgaaagggatgagctatgtcatgtgtacgggctctttcaagctcgagaaggaagtggctgagacacagcacggaaccgttctggtgcagatcaaatacgagggcaccgacgccccgtgcaagatccctttctccacacaagatgaaaaaggggtcacccagaacggaagactgattacagcgaatcccatcgtgacggacaaggagaaacctgtgaacattgaagctgagccgccctttggcgagagctatatcgttattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtctttaccagcgtgggcaagctggtgcatcagatcttcgggacagcctacggagtcctcttttccggcgtgagctggaccatgaaaattgggatcggcgttctgcttacgtggctgggactcaattctcggtccaccagcctgtctatgacatgtattgctgtgggcctgatcaccctttacctcggggtcatggtgcaggccgattccggatgcgttattaactggaagggcagagaactgaagtgtgggagcggaatcttcgtgacaaatgaggtccacacctggacagaacaatataaatttcaggctgactcccctaagcgcctgtctgccgcgatcggcaaagcctgggaggagggggtgtgcggcattcggagcgctaccagactcgaaaacatcatgtggcgccagatttccaacgagctgaatcatatccttctggaaaacgacatgaagttcacggttgtggtcggagatgtggtgggcattctcgcccaggggaaaaagatggtccggccgcaacccatggagcacaaatactcttggaaaagctggggaaaggctaagatcatcggcgccgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacacaggtgtgcgaccaccggcttatgagcgctgcgatcaaagattctaaggccgtccatgctgacatgggctattggatcgaatccgagaaaaatgaaacatggaagctcgccagagccagcttcattgaggtgaagacctgtatctggcccaaatctcacacactgtggtccaacggggttctggaaagcgagatgattatcccgaagatttacggaggccctatctctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcattcatgaatggtgttgccggtcctgtaccctgcctcccctgcgcttcaaaggggaggacggatgctggtacggcatggagatcagaccggtgaaggaaaaggaggaaaatcttgtcaaaagcatggtgtctgccgggtccggagaggttgacagcttttccctcggcctgctgtgtatttctatcatgattgaagaggtgatgcggagcagatggtcccgcaagatgctcatgacggggacactggcggtcttctttcttctgatcatgggacagctcacctggaacgatctgattcggtcttgcatcatggtgggcgctaatgccagcgacagaatgggcatggggacaacctatctggcccttatggctaccttcaaaatgcgccctatgtttgccgtgggactcctgttcagacggctgacatcccgcgaggtcctcctgcttacgatcggcctgtctctcgttgcgagcgtggaactgcccaactccctggaggaacttggggatggactggctatgggcattatgatcctcaagctgctcaccgactttcaaagctaccagctgtgggccacacttctgtctctcaccttcattaaaacaaccttttccctgcactatgcctggaagacgatggctatggtgctgagcatcgtctctcttctgcccctctgtctgtccacaaccagccagaagaccacatggctccctgtgctgcttgggtctctgggatgcaaaccgctgaccatgttcctcattgccgagaataagatctggggcagaaaatcctggcccctgaacgaaggcatcatggctgttgggattgtgagcatccttctgtccagcctcctgaagaacgatgtccctctcgccggacccctgattgcgggcgggatgcttatcgcctgttacgtgatttctggaagctccgctgacctgtctctggagaaagccgctgaggttagctgggaagaggaagccgagcattccggcgcctctcacaatatcctcgtggaagtccaggatgacgggacaatgaagatcaaagatgaggagcgggacgatacgctgaccattcttctgaaggctacactcctggcggtgagcggagtctatcctctctccatccccgccaccctgtttgtgtggtacttctggcaaaagaaaaagcagcgctctggcgttctttgggacacacctagccctcccgaagtggagagagctgtcctggatgacggcatttatcggatcatgcagcgcgggctgctcggaagatcccaggtgggcgttggggtgttccaagaaaacgtctttcataccatgtggcacgtgacgcggggagccgtgctgatgtaccagggcaaacgccttgagcccagctgggcctctgttaagaaagacctgatttcctacgggggaggctggagactccagggcagctggaataccggggaggaagtccaggtgatcgctgtggagcccggaaagaaccctaagaatgtccaaacagcccccggcaccttcaaaacaccggaaggggaggtgggagcgattgctctggattttaagcctggcacctctgggtcccccatcgttaaccgggaaggaaaaatcgtgggcctctatggcaatggggtcgtgacaacgagcggaacctacgtttccgccattgcccaggctaaggcctctcaggagggccctctgcccgagatcgaagacgaggtgttcagaaaacgcaaccttacaattatggatctgcaccccgggagcggaaagacccggagatatctgcctgcgatcgtccgcgaagctattaagcggaaactcagaaccctgatccttgccccgacacgcgtggttgcctccgagatggctgaagccctgaagggcatgcccatccggtaccaaacgaccgctgtgaaaagcgagcatacagggagagagattgtcgacctcatgtgccacgccacctttacaatgcgcctgctgtctcctgtgcgggtgcccaattataacatgatcattatggatgaagcgcatttcaccgacccttccagcatcgccgctagaggctacatttctacgcgggtcggaatgggcgaggccgctgccatctttatgacagccacaccccctgggagcgttgaggctttcccgcagtccaatgcggtgatccaggatgaggaacgcgacattcccgagagatcttggaacagcggatatgagtggatcaccgattttcctggcaagacagtgtggttcgtcccctccattaaatctgggaatgacatcgccaactgtctccggaagaatggaaagcgcgtgattcagcttagcagaaaaacctttgatacagaataccaaaagaccaaaaacaacgactgggactacgttgtgacgacagatatctccgagatgggcgctaatttccgggccgacagagtcattgatcctcgccggtgcctgaagcccgtgatcctgaaagacgggccggaaagagttatcctcgccggccctatgcccgtgaccgtcgctagcgccgcgcagcgccggggaagaattggccgcaaccacaataaggagggggatcagtatatctacatgggacagcccctgaacaatgacgaggatcatgctcactggacagaagccaagatgcttctggacaacattaatacccctgagggcatcattcccgccctcttcgaacctgagcgggaaaaatctgctgccatcgatggggagtatagactgcgcggagaggcgagaaagacgtttgtggaactgatgcggcgcggcgacctcccggtctggctttcctacaaagtggccagcgaggggttccaatattccgatagacggtggtgctttgacggcgaacgcaacaatcaggttctggaggaaaacatggatgtggagatctggaccaaggagggagaacgcaagaagctgcggcccagatggctcgacgctcgcacatactctgaccctctggcccttcgggagttcaaagaatttgctgccggcagacgcagcgtgtccggggatctgattctcgagatcggaaagctgccccagcacctgacccagcgggctcaaaatgccctcgacaaccttgtcatgctgcataattctgaacagggcgggagagcgtatcggcacgccatggaggagctgcctgatacaattgaaaccctcatgctgcttgctctgatcgccgttctcacaggaggcgtgaccctgttctttctgagcggccgcgggctcggaaagacgtccattggccttctgtgtgtgatggctagctctgccctgctctggatggcctccgtcgagccccattggatcgctgcgagcatcattctggagttctttcttatggtgctgctcatcccggagcctgacagacagcggacaccccaggataaccaactggcctacgttgtgattgggctcctgttcatgatccttaccgtcgctgccaatgagatgggactgctggaaaccaccaagaaggacctcggcattgggcacgtggccgtcgagaaccaccatcacgctaccatgctggatgtggaccttcatcctgcctctgcgtggacactgtacgccgttgctacgaccatcattacacccatgatgcgccacaccatcgaaaacacaaccgccaatatctccctcacggctattgccaaccaggcggccatcctgatgggactggataaaggctggcctattagcaagatggacatcggcgtgcccctccttgctctggggtgctattctcaggtcaatccgctgaccctcacagccgctgtgctgatgcttgttgcccattacgctattatcggacctggcctgcaagccaaagcgaccagagaggcccagaagcggacagctgccgggatcatgaagaaccccaccgtggatggaattgtcgctatcgacctcgatcccgtggtgtatgacgccaaatttgaaaagcagctgggccagattatgctgctcatcctttgtacgagccaaattctgctgatgcgcacaacctgggccctctgcgagtccatcacactggcgaccgggcctcttaccacactgtgggagggatctccgggcaaattctggaatacgaccatcgctgttagcatggccaacatttttagaggctcctacctcgctggggccggactggccttcagcctgatgaagtccctcggcgggggacggcgcggcacaggggctcagggagaaacccttggcgagaaatggaagagacagctgaatcagctgtctaagagcgagttcaacacatataaacggtccggcatcatggaggtcgacagatctgaagccaaggaggggctccgccggggagagaccacgaaacacgcggtgagcagaggcacagccaagctgcgctggtttgtggaacggaatcttgtcaaacccgaggggaaggttattgatctgggatgtggcagagggggatggtcctactattgcgctggcctcaagaaagtgaccgaagtgaagggctacaccaaagggggacctggccacgaggaacccatccctatggccacatacgggtggaacctggtcaagctgcattctggaaaagacgtgttctttattccccctgagaagtgtgataccctcctttgcgacatcggcgagagctccccgaatcccacaattgaagaggggcgcacgctgcgggttctgaaaatggtggaaccttggctcagaggaaaccaattctgtatcaagatcctgaatccctatatgcctagcgtcgtggagacccttgagcacatgcagcgcaagcatggcggcatgctggttcggaaccccctctctagaaattccacacacgaaatgtactgggtgagctgcgggaccggaaacattgtctctgctgtgaatatgacatcccgcatgctgctgaaccggtttaccatggcccacagaaaaccgacgtatgagcgcgatgtggacctcggcgcggggaccagacatgtcgccgttgaacctgaggtggctaacctggatatcattggacagcggatcgaaaatattaagcacgagcataaaagcacatggcactacgacgaggataacccctataagacctgggcctaccatggctcttatgaagtgaaaccctccgggagcgcttccagcatggtcaatggagtggttaaacttctgacaaagccttgggacgtgatccccatggtcacccagatcgccatgacagataccacgcctttcggccaacagcgcgtgtttaaagagaaggttgacacaagaaccccgaaagctaagcggggcaccgcccagattatggaagtgacagcgagatggctctgggggttcctgtctcggaacaaaaagccccgcatctgtacgagagaggaatttacccggaaggtccgcagcaatgccgctattggagccgtgttcgttgacgagaaccaatggaactccgctaaagaggccgtggaagatgagagattttgggaccttgtccaccgggaacgcgagctgcacaagcagggcaaatgcgccacatgcgtgtacaacatgatggggaagagagagaagaagctcggagagttcggcaaggcgaaagggtctcgggctatctggtacatgtggctgggcgcccgctttctggagttcgaagccctcggattcatgaatgaggatcattggtttagcagagaaaactccctgtctggcgtcgagggggagggacttcacaagctgggctatattctccgggacatcagcaaaatccctgggggaaatatgtacgctgatgacaccgccggctgggatacacgcattaccgaagacgatctgcagaacgaggctaagatcacagacattatggaacccgagcatgcccttctggcgacctccatcttcaaactcacgtatcagaataaggtggttagagtgcaacggcctgccaaaaacgggaccgtcatggatgtgatttctcgcagagaccagcggggcagcggacaggtgggcacatacgggctgaatacctttacaaacatggaagctcagctgatcagacaaatggagtccgagggaatcttcagcccctctgaactcgagaccccgaacctggccgaacgcgttcttgattggctggagaagtatggcgtggaacggctcaagagaatggctatttccggggacgactgtgtcgtgaaacctatcgatgaccgctttgccacggcgctgacagcccttaatgatatgggaaaggttcggaaagacattccccagtgggagcctagcaagggctggaacgattggcaacaggtgcccttctgctctcaccactttcatcaactgatcatgaaagacgggagagagattgtcgtgccttgtcgcaatcaggatgaactcgtcggccgggctagagtgtcccagggagccggctggagcctgcgcgagaccgcttgcctggggaagtcctacgcccagatgtggcaactcatgtatttccaccggagagacctgcgccttgctgccaacgcgatctgttctgccgttcccgtggattgggtcccgacaagccggaccacgtggtccattcatgctcaccatcagtggatgaccacagaagacatgctgagcgtgtggaatagagtttggatcgaggaaaacccttggatggaggataagacccacatctcttcctggggagacgtgccctacctcggcaaacgggaggaccagtggtgcgggagcctgattggacttacagccagagccacctgggctacaaatatccaagtcgccattaaccaggtgcgccggctgatcggcaatgaaaactacctcgattatatgacctctatgaagagatttaaaaatgagagcgaccccgaaggggcgctgtggtga

SEQ ID NO: 18996 - RNA, 9879 nt, synthetic construct
  misc_feature 1..9879: note = derived and/or modified CDS sequence (opt5) from DENV-1__GQ868606__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaatcatcgccccgggtactttacacaaaccgcgggaccttggcacctgggcaagctcgagctggatttcgacctttgcgaagggacgaccgtggttgtggatgagcactgcggaaaccggggcccctccctgagaacaaccacagtcaccggcaaaattatccatgaatggtgttgccggagctgtacgctccctcccctgcgctttaagggggaggacggatgctggtacggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctatctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccaccaactgtgggctacccttctgtctctcacatttattaagaccacgttctccctgcattacgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttatgtgatttctggaagctccgctgacctttctctggagaaggccgccgaggtcagctgggaagaggaagctgagcactccggcgcgtctcataatatcctggtggaagttcaggatgacgggacgatgaaaattaaggatgaggagcgggacgataccctcacaatcctgcttaaggccaccctgctcgctgtgagcggagtctaccctctgtccatccccgccacactcttcgtgtggtatttttggcagaaaaagaaacaacgctctggcgtcctgtgggacaccccttcccctcccgaagtggagagagccgttcttgatgacggcatttaccggatcatgcagcgcgggctgctgggaagatcccaggtgggcgtcggggtgttccaggaaaacgtttttcacacgatgtggcacgtgacccggggagctgtcctcatgtatcaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtacggcaatggggttgtgacgacctccggaacatatgtctctgctatcgcccaagcgaaagctagccaggagggccccctccctgagatcgaagacgaggtgttcagaaagcgcaacctgaccattatggatcttcatcccgggtccggaaagacccggagatacctgcccgccatcgttcgcgaagccattaaacggaagctgagaacactcatcctggctcctacgcgcgtggtcgccagcgagatggctgaagcccttaaaggcatgccgattcggtatcagaccacagcggtgaagtctgagcacaccgggaaagagatcgttgacctgatgtgccatgccacatttaccatgagactcctgtcccccgtgcgcgtccctaattacaacatgatcattatggatgaagctcacttcacggaccccagctctatcgccgctcggggctatattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatacgagtggatcacagattttcccggcaagaccgtttggttcgtgccttctattaagagcgggaatgacatcgccaactgtctgcgcaagaatggaaagcgggtgattcagctctcccgcaaaacattcgataccgaatatcagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccataataaagagggggatcagtacatctatatgggacagcccctcaacaatgacgaggatcacgcccactggaccgaagctaagatgctgcttgacaacattaatacgcccgagggcatcattcctgccctgttcgaacccgagcgcgaaaaatccgcggccatcgatggggagtaccggctcagaggagaggctcgcaagacctttgtggaactgatgagacggggcgacctgcctgtctggctcagctataaagtggcctccgaggggttccagtactctgatcgcagatggtgctttgacggcgaacggaacaatcaagtccttgaggaaaacatggatgtggagatttggacaaaggagggagaacgcaaaaagctgagaccgcggtggctggacgctagaacctatagcgaccccctcgccctgcgcgagttcaaggaatttgctgccggccggagatccgtttctggggatcttatcctggagatcggaaaactccctcagcatctgacacagcgcgcgcagaatgccctggacaacctcgtgatgcttcacaatagcgaacaaggcgggcgggcttacagacatgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcactggatcgcggcctctattatcctcgagttctttctgatggtccttctgatccccgagccggaccgccagagaacccctcaggataaccagctcgcttatgtggttattgggctgctgttcatgatcctcaccgtggccgccaatgagatgggacttctggaaacaaccaaaaaggacctgggcattgggcacgtcgctgtggagaaccatcaccatgccgcgatgctcgatgtcgacctgcaccccgcctccgcttggacactttacgccgtggctacgaccatcattacacctatgatgcggcataccatcgaaaacacaaccgccaatattagcctgacggcgatcgccaaccaagctgccatcctcatgggactggataaaggctggcccatttctaagatggacatcggcgttcctctgctcgctcttgggtgctacagccaggtgaatcccctgaccctgacagccgctgtcctcatgctggtggcccactatgcgattatcggaccgggccttcaggccaaggctacccgcgaggcccagaagagaacagctgccgggattatgaagaaccctaccgttgatggaatcgtggccatcgacctggatcccgtcgtgtacgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctatctggccggggctggactcgccttttccctgatgaagtctctgggcgggggaagacggggcacaggggcgcaaggagaaaccctcggcgagaagtggaaacgccagcttaatcagctgagcaagtccgagttcaacacatacaaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttattactgcgctggcctgaaaaaggttaccgaagtgaaaggctataccaaagggggacccggccatgaggaacctatccccatggccacatacgggtggaacctcgtgaaactgcacagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttacatgccctctgtggtcgagaccctggagcaaatgcagcggaaacatggcggcatgcttgtgagaaaccctctgtcccgcaatagcacacacgaaatgtattgggtttcttgcgggaccggaaacatcgtgtccgcggtcaatatgacaagccggatgctcctgaacagatttaccatggcccaccgcaagcccacgtacgagcgggatgtggacctgggcgctgggaccagacatgtggccgtcgaaccggaggttgctaacctcgatatcattggacagcgcatcgaaaatattaaacacgagcataagtctacatggcactatgacgaggataacccttacaagacctgggcctatcatggctcctacgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcaccgggaacgcgagcttcacaagcagggcaagtgcgctacatgcgtctataacatgatggggaaaagagaaaagaaactgggagagttcggcaaggccaaagggagccgggccatctggtacatgtggctcggcgctcgcttcctggagtttgaagccctgggattcatgaatgaggatcattggttttccagagaaaactctctcagcggcgtggagggggagggactgcacaaacttggctacattctgcgggacatctccaaaattcccgggggaaatatgtatgctgatgacaccgccggctgggatacacgcatcaccgaagacgatctccagaacgaggcgaagatcacagacattatggaacctgagcatgccctgcttgctaagtctatcttcaaactgacctaccagaataaggtcgtgagagttcaacggcccgcccgcaacgggacggtgatggatgtcattagcagacgggaccagcgcggctccggacaggtgggcacctatgggctcaatacatttaccaacatggaagctcagctgatcagacaaatggagagcgagggaattttctctccttccgaactggagacacccaacctcgccggccgggtgctggattggcttgaaaaacacggggttgagagactgaagcgcatggcgatcagcggagacgactgtgtggtcaaaccgatcgatgaccggtttgccaccgctctcacggccctgaatgatatgggcaaggtgagaaaggacattcctcagtgggaaccctctaaagggtggaacgattggcagcaggttcctttctgctcccaccattttcaccaacttatcatgaaggacggccgcgagattgtggtcccctgtcggaatcaggatgagctggtgggcagagctcgcgtcagccagggcgccgggtggtccctccgggaaacagcttgcctgggaaaatcttacgcccagatgtggcaactgatgtatttccatagacgcgacctccggctggcggccaacgctatctgtagcgccgtgcctgttgattgggtgcccacctccagaacaacctggagcattcacgcccatcaccagtggatgacgaccgaggacatgctttctgtctggaatcgcgtgtggatcgaagagaacccgtggatggaagataagacacacatttccagctggggcgacgttccttacctggggaaacgggaggaccagtggtgcggatctctcatcggcctgaccgctagagccacatgggcgaccaatatccaagtggctattaaccaggtccggagacttatcgggaatgagaactatctggattacatgacaagcatgaagcgctttaagaatgaatccgaccccgagggcgccctctggtga

SEQ ID NO: 18997 - RNA, 9879 nt, synthetic construct
  misc_feature 1..9879: note = derived and/or modified CDS sequence (opt5) from DENV-1__FJ882539__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgttcaagacaagcgccggcgttaatatgtgcacccttattgcgatggacctgggggagttctgtgaagatacaatgacctacaaatgcccccgcatcacagaagctgaacccgacgatgtggactgttggtgcaatgccaccgatacgtgggtgacctatggaacatgttcccagaccggcgagcacagacgggacaagcgctctgtggccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggctcttgcgtctcaagagacctggaatcgcaaagacctgctcgtgacatttaagaccgcccacgctaagaaacaggaagtcgtggttctgggaagccaggagggcgccatgcacaccgccctgacaggggctacggaaatccaaacctccggaacaaccacaattttcgccggccatctcaagtgcagactgaaaatggataaacttaccctgaaagggatgagctatgtgatgtgtacgggctctttcaagctcgagaaggaagtcgcggagacacagcacggaaccgtgctggttcagatcaaatacgagggcaccgacgctccgtgcaagattcctttttccacacaggatgaaaaagggatcacccaaaacggacggctgatcacagccaatcccattgtgacggacaaggagaaacctgtcaacatcgaagccgagccgcccttcggcgagagctatattgtgatcggggctggagaaaaggcccttaagctctcttggtttaaaaagggcagctccattgggaaaatgttcgaggctaccgccagaggcgcgcgccggatggccatcctgggagatacagcttgggactttggctctatcgggggagtgttcaccagcgttggcaagctggtccatcagatttttgggacagcctacggagtcctgttctccggcgtgagctggaccatgaaaatcgggattggcgtcctgcttacgtggctgggactcaattctagatccaccagcctgtctatgacatgtatcgctgtgggcctggttaccctttacctcggggtgatggtccaggccgattccggatgcgtgattaactggaagggccgcgaactgaagtgtgggagcggaatctttgttacaaatgaggtgcacacctggacagaacagtataaattccaagcggactcccctaagcggctgtctgccgctattggcaaagcctgggaggagggggtctgcggcatcagaagcgctacccgcctcgaaaacatcatgtggaagcagatttccaacgagctgaatcatatccttctggaaaacgacatgaaatttacggtggttgtgggagatgtcgccggcattctcgcccaggggaagaaaatgatccggccgcagcccatggagtacaagtattcttggaaaagctggggaaaggctaagattatcggcgcggacgtgcaaaatacaaccttcatcattgatgggcctaacacccccgaatgtcctgacgatcagagagcctggaatatctgggaggtggaggactacggatttggcattttcacaaccaacatctggctgaaactgcgcgattcctatacgcaggtctgcgaccaccggcttatgagcgctgccattaaggattctaaagccgttcacgctgacatgggctactggatcgaatccgagaagaatgaaacatggaagctcgccagagcgagcttcatcgaggtgaaaacctgtatttggcccaagtctcatacactgtggtccaacggggtgctggaaagcgagatgatcattccgaaaatctatggaggccctatttctcagcacaatcatcgccccgggtactttacccaaacagctggaccttggcacctcggcaagctggagcttgatttcgacctgtgcgaagggaccacggtcgtggttgatgagcactgcggaaaccggggccccagcctcagaaccacaaccgtgacaggcaaaatcatccatgaatggtgttgccggtcctgtaccctgcctcccctgcgctttaagggggaggacggatgctggtacggcatggagattagaccggtcaaggaaaaagaggaaaatcttgtgaagtccatggtttctgccgggtccggagaggtggacagcttctccctcggcctgctgtgtatctctattatgatcgaagaggtcatgcggagcagatggtcccgcaaaatgctcatgacggggacactggccgtgtttttccttctgattatgggacagctcacctggaacgatctgatccggctgtgcattatggttggcgctaatgcctctgacagaatgggcatggggacaacctatcttgcgctgatggctacctttaagatgcgccctatgttcgccgtgggactcctgtttagacggctcacaagccgcgaggtcctgcttctgacgatcggcctctccctggtggcctctgtggaactgcccaacagccttgaggaactgggggatggactcgctatgggcatcatgattctgaaactcctgaccgacttccagtcccaccaactttgggccacactgctcagcctgacctttatcaagacaaccttctctctgcattacgcttggaagacgatggccatggtcctttccattgttagcctgtttcccctctgtctgtctacaacctcccagaaaaccacatggctccctgtgctgcttgggagcctgggatgcaagccgctgaccatgttcctcatcgcggagaataaaatttggggcagaaagtcttggcccctgaacgaaggcatcatggccgtggggatcgtctccattcttctgagctccctcctgaaaaacgatgtgcctctcgctggacccctgatcgccggcgggatgcttattgcttgttatgttatcagcggatctagcgccgacctgtccctggagaaggccgctgaggtgtcttgggaagaggaagcggagcacagcggcgcctcccataatattctcgtcgaagtgcaggatgacgggacaatgaaaatcaaggatgaggagcgggacgatacgctgaccatccttctgaaggctacactcctggccgtttctggagtgtaccctctcagcattcccgccaccctgttcgtctggtatttttggcagaaaaagaaacaacgctccggcgtgctttgggacacaccttctcccccggaagtcgagagagctgtgctggatgacggcatctaccggattatgcagcgcgggctgctcggaagaagccaggttggcgtgggggtcttccaggaaaacgtgtttcacaccatgtggcacgttacgcggggagccgtgctgatgtatcaaggcaagcgccttgagccttcctgggcgagcgtcaaaaaggacctgatctcttacgggggaggctggagactccagggctcctggaataccggggaggaagtccaggtgattgctgttgagcccggaaagaaccctaaaaatgtccagacagcccccggcaccttcaagacaagcgaaggggaggtgggagccatcgctctggattttaaaccgggcacctctgggtcccctattgtgaaccgggaaggaaagatcgtcggcctctacggcaatggggtggttacaacgagcggaacctatgtgtccgccatcgcgcaagctaaagcctctcaggagggccccctgcctgagattgaagacgaggtcttcagaaagcgcaaccttacaatcatggatctgcatcccgggagcggaaagacccggagatacctgcccgccattgtgcgcgaagctatcaaacggaagctcagaaccctgattcttgcccctacacgcgttgtggcttccgagatggccgaagcgctgaaaggcatgccgatccggtatcagacgaccgccgtcaagagcgagcacacagggaaagagatcgtggacctcatgtgccatgctacctttacaatgagactgctgtctcccgttcgcgtgcctaattacaacatgattatcatggatgaagcccacttcaccgacccctccagcattgctgcccggggctatatctctacgagagtcggaatgggcgaggccgctgcgatttttatgacagccacccctcccgggagcgtggaggctttccctcaatccaatgccgtgatccaggatgaggaacgggacatcccggagcgctcttggaacagcggatacgagtggattaccgattttcccggcaagacagtctggttcgttccttccatcaagtctgggaatgacattgccaactgtctccgcaagaatggaaagcgggtgatccagcttagccgcaaaaccttcgatacagaatatcagaagaccaaaaacaacgactgggactacgtggtcacgacagatatttccgagatgggcgctaattttagagccgaccgggtgatcgatcccagacgctgcctgaagcctgttattctgaaggacgggcccgaacgggtgatcctcgcgggcccgatgcctgtcaccgtggctagcgccgcccaaagacgcggacggatcggcagaaaccataataaagagggggatcagtacatttatatgggacagcccctgaacaatgacgaggatcacgctcactggacagaagccaagatgcttctggacaacatcaatacccccgagggcattatccctgcgctctttgaacccgagcgcgaaaaatctgccgctattgatggggagtaccggctgagaggagaggcccgcaagacgtttgttgaactgatgagacggggcgacctccctgtgtggctttcctataaagtcgctagcgaggggttccagtactccgatcgcagatggtgctttgacggcgaacggaacaatcaagtgctggaggaaaacatggatgtcgagatctggaccaaggagggagaacgcaaaaagctgagaccgcggtggctcgacgccagaacatattctgaccccctggctcttagagagttcaaggaatttgccgcgggccggagaagcgtgtccggggatctgatcctcgagattggaaaactgcctcagcatctgacccagcgcgcccagaatgctctcgacaaccttgttatgctgcacaattctgaacaaggcgggcgggcctacagacatgctatggaggagctgcccgatacaatcgaaaccctcatgctgcttgccctgattgccgtgctcacaggaggcgtgaccctgttctttctgagcggccgggggctcggaaagacgtccatcggccttctgtgtgtcatggctagctctgttctgctctggatggcgtccgtggagcctcactggattgccgctagcatcatcctggagttctttcttatggtgctgctcattcccgagccggaccgccagagaacacctcaggataaccagctggcctatgtcgtgatcgggctcctcttcatgattcttaccgttgccgctaatgagatgggactgctggaaaccaccaagaaggacctcggcatcgggcacgtggccgtcgagaaccatcaccatgcggccatgctggatgtggaccttcaccccgcttctgcctggaccctgtacgctgtcgccacaacgattatcacccctatgatgcggcatacaattgaaaacaccacagcgaatatctccctcaccgccatcgctaaccaagccgctattctgatgggactggataaaggctggcccatcagcaagatggacattggcgtgcctctccttgccctggggtgctactctcaggttaatcccctgacgctcaccgctgccgtgctgatgcttgtcgcgcactatgccatcattggaccgggcctgcaggctaaggccacacgcgaggctcagaagagaaccgccgccgggatcatgaagaaccctacagtggatggaatcgttgcgattgacctcgatcccgtggtctacgacgctaaatttgaaaagcagctgggccagatcatgctgctcattctttgtaccagccagatcctgctgatgcggacgacatgggccctctgcgagtccattaccctggctacagggccccttaccaccctgtgggagggatctcctggcaaattctggaatacaacgatcgccgtgagcatggccaacatcttccgcggctcctatctcgctggggccggactggcgtttagcctgatgaagtccctcggcgggggaagacggggcaccggggcccaaggagaaacacttggcgagaagtggaaacgccagctgaatcagctgtctaagagcgagttcaacacctacaaaagatccggcattatggaggtggaccggtctgaagctaaggaggggctcaaaagaggagagacaaccaagcacgccgttagccgcggcacggctaagctgcggtggtttgtcgaaagaaatcttgtgaaaccggaggggaaggtgatcgatctgggatgtggccgcgggggatggtcctattactgcgccggcctcaaaaaggtcacagaagttaaaggctataccaaagggggacccggccatgaggaacctattcccatggcgacctacgggtggaacctggtgaaactgcactctggaaaggacgtgttctttatccctcccgagaagtgtgatacactcctttgcgacattggcgagagctcccctaatccgaccatcgaagaggggcggacactgagagtcctgaaaatggtggaaccctggctccgcggaaaccagttctgtattaagatcctgaatccttacatgcccagcgttgtggagacgcttgagcaaatgcagcggaaacatggcggcatgctggtcagaaaccctctctctcgcaattccacccacgaaatgtattgggtgagctgcgggacaggaaacatcgtttctgccgtgaatatgacctcccggatgctgctgaacagatttacaatggctcaccgcaagcccacctacgagcgggatgtcgacctcggcgccgggacgagacatgtggctgtggaaccggaggtcgccaacctggatattatcggacagcgcattgaaaatatcaaacacgagcataagagcacctggcactatgacgaggataacccttacaagacatgggcttatcatggctcttacgaagttaaaccctccgggagcgcctccagcatggtgaatggagtggtcaaacttctgaccaaaccctgggacgtgattcctatggttacacagatcgcgatgaccgatacaacccccttcggccaacagagagtgtttaaggagaaagtcgacacgcggacacctaaggccaagcgcggcaccgctcagatcatggaagtgaccgccaaatggctctgggggttcctgtctagaaacaagaaaccgcggatttgtacaagagaggaatttacgcggaaggttcgcagcaatgctgccatcggagccgtgttcgtcgacgagaaccaatggaactccgcgaaagaggctgtggaagatgagagattttgggaccttgttcaccgggaacgcgagctgcacaagcagggcaagtgcgctacctgcgtgtataacatgatggggaaaagagaaaagaaactcggagagttcggcaaggccaaagggtctcgggctatttggtacatgtggctgggcgcccgcttcctggagtttgaagctctcggattcatgaatgaggatcattggtttagcagagaaaactccctgtctggcgtcgagggggagggacttcacaagctgggctacatcctccgggacattagcaaaatccccgggggaaatatgtatgccgatgacacagcgggctgggatacccgcatcacagaagacgatctgcagaacgaggccaagattaccgacatcatggaacctgagcatgcccttctggccaagtccattttcaaactcacataccagaataaggtggtcagagtgcaacggcccgctaaaaacgggaccgttatggatgtgatctctcgcagagaccagcggggcagcggacaggtcggcacgtatgggctgaatacctttacaaacatggaagcccagctgattcgccaaatggagtccgagggaatcttcagcccttctgaactcgagacccccaacctggcgggcagagtgcttgattggctggaaaagcacggggtggagcggctcaaaagaatggccatctccggagacgactgtgttgtgaagccgattgatgaccgctttgctacagccctgaccgctcttaatgatatgggcaaggtccggaaagacatccctcagtgggaacccagcaaggggtggaacgattggcaacaggtgcctttctgctctcaccattttcaccaactgattatgaaagacggcagagagatcgttgtgccctgtcgcaatcaggatgagctcgtcggacgggccagagtgtcccagggcgctgggtggagcctgcgcgaaacggcctgcctgggaaagtcctacgcgcagatgtggcaactcatgtatttccatcggagagacctgcgccttgccgctaacgccatttgttctgccgtccctgtggattgggttcccacaagccggaccacatggtccatccacgctcatcaccagtggatgaccacggaggacatgctgagcgtgtggaatagagtctggattgaagagaacccgtggatggaagataaaacccacatctcttcctggggcgacgtgccttacctcgggaagcgcgaggaccagtggtgcggaagcctgatcggccttacagcccgggcgacctgggctacaaatattcaagttgccatcaaccaggtgagacggctgattgggaatgagaactatctcgattacatgacctctatgaagagatttaaaaatgaaagcgaccccgagggcgccctgtggtga

SEQ ID NO: 18998 - RNA, 9879 nt, synthetic construct
  misc_feature 1..9879: note = derived and/or modified CDS sequence (opt5) from DENV-1__FJ882541__SS-prME
  source 1..9879: mol_type = other RNA
agcgtgaccatgctgctcatgctgatccccacggcgcttgctttccacctgacgaccagaggaggggagcctcatatgattgtctccaagcaggaacggggaaagtctctcctgtttaagaccagcgccggagttaatatgtgcacccttatcgcgatggacctgggggagctctgtgaagatacaatgacctacaaatgcccgcgcattacagaggtggaacccgacgatgtggactgttggtgcaataccacggatacctgggtcacatatggaacctgttcccagacaggagagcacagacgggacaagcgctctgtggctctggcccctcatgttgggctgggactcgagaccagagccgaaacgtggatgagctccgagggcgcttggaaacagatccagaaggtggaaacatgggccctgcggcaccccggcttcaccgtcattgctctttttctggcccatgcgatcgggacatctatcacccagaagggaattatcttcattctcctgatgcttgtgacccctagcatggccatgcgctgcgttggcatcgggtccagagattttgtggagggactgagcggcgctacatgggtcgacgtggtgctcgagcacgggtcttgtgtcacgaccatggccaaagataagcccacactggacattgaactgctcaaaaccgaggttacaaaccctgctgtgctgcggaaactttgcatcgaagccaaaatttccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgatcacatgcgctaagtttaaatgcgttacaaaacttgagggaaaaatcgtgcagtacgaaaacctgaagtattccgtcattgtgacggttcacaccggcgaccagcatcaagtggggaatgagagcacagaacacggaaccacagccaccatcacgccccaggctcctacctctgagattcagctcacagactacggcgccctgaccctggattgttcccccagaacaggcctcgacttcaacgaaatggtcctgcttaccatgaaagggaagtcctggctggtgcataaacagtggtttctcgatctgcctcttccctggacgtccggagcctctacaagccaagagacctggaatcggcaggacctgctcgtcacattcaagaccgctcacgcgaagaaacaggaggtggttgtgctgggctcccaagaaggggccatgcacaccgctctgacaggagccacggagatccagaccagcggcacaaccacaatttttgccgggcatctcaagtgccgcctgaaaatggataaacttaccctgaaaggcatgtcttatgtcatgtgtacgggatccttcaagctcgaaaaggaggtggctgaaacacagcacggcaccgttctggtgcagatcaaatacgaggggaccgacgccccgtgcaagatccctttcagcacacaagatgagaaaggagtcacccagaacggcagactgattacagcgaatcccatcgtgacggacaaggaaaaacctgtgaacattgaggctgaaccgccctttggggagtcttatatcgttattggagccggcgagaaggcccttaagctcagctggttcaaaaaggggtcctctatcggcaaaatgtttgaagctaccgcccggggagctagacgcatggccatcctgggcgatacagcgtgggacttcgggagcattggaggcgtctttacctccgtggggaagctggtgcatcagatcttcggaacagcctacggcgtcctctttagcggggtgtcttggaccatgaaaattggcatcggagttctgcttacgtggctgggcctcaattcccggagcacctctctgtccatgacatgtattgctgtggggctggtcaccctttacctcggagtgatggttcaggccgatagcggctgcgtgatcaactggaaggggagagagctgaagtgtggatccggcattttcgtcacaaatgaagtgcacacctggacagagcaatataaatttcaggctgactctcctaagcgcctgagcgccgcgatcgggaaagcctgggaagagggcgtttgcggaatccggtccgctaccagactcgagaacattatgtggcgccagatctctaacgaactgaatcatattcttctggagaacgacatgaagttcacggtggtcgtgggcgatgtggtcgggatcctcgcccagggcaagaagatgattcggccgcaacccatggaacacaaatacagctggaagtcctggggcaaggctaaaatcatcggggccgacgttcagaatacaacctttattatcgatggacctaacacccccgagtgtcctgacgatcagagagcctggaatatttgggaagtggaggactatggcttcggcatctttacaaccaacatttggctgaagctgcgcgatagctacacacaggtgtgcgaccaccggcttatgtctgctgcgatcaaagattccaaggccgtccatgctgacatggggtattggatcgagagcgagaaaaatgagacatggaagctcgccagagcctctttcattgaagtgaagacctgtatctggcccaaatcccacacactgtggagcaacggagttctggagtctgaaatgattatcccgaagatttacggcgggcctatcagccaacataattatcgccccggatacttcacccagacagctggcccttggcacctcgggaaactggagcttgattttgacctgtgcgagggaaccacggtggtcgtggatgaacactgcggcaaccggggcccctccctcagaaccacaaccgttacagggaagatcattcatgagtggtgttgccggagctgtaccctgcctcccctgcgcttcaaaggagaagacggctgctggtacgggatggagatcagaccggtgaaggagaaggaagagaatcttgtcaaatctatggtgtccgccggaagcggcgaagttgactccttttctctcgggctgctgtgtattagcatcatgattgaggaagtgatgcggtccagatggtctcgcaagatgctcatgacgggaacactggcggtcttctttcttctgatcatgggccagctcacctggaacgatctgattcggagctgcatcatggtgggcgctaatgcctccgacagaatggggatgggaacaacctatctggcccttatggctaccttcaaaatgcgccctatgtttgccgtgggcctcctgttcagacggctgacatctcgcgaggtcctcctgcttacgatcgggctgagcctcgttgcgtccgtggagctgcccaacagcctggaagaacttggagatggcctggctatggggattatgatcctcaagctgctcaccgactttcaatcttaccagctgtgggccacacttctgtccctcaccttcattaaaacaacctttagcctgcactatgcctggaagacgatggctatggtgctgtctatcgtctcccttctgcccctctgtctgagcacaacctctcagaagaccacatggctccctgtgctgcttggatccctgggctgcaaaccgctgaccatgttcctcattgccgaaaataagatctggggcagaaaaagctggcccctgaacgaggggatcatggctgttggaattgtgtccatccttctgagctctctcctgaagaacgatgtccctctcgccggccccctgattgccgggggaatgcttatcgcctgttacgtgattagcggctcctctgctgacctgagcctggaaaaagccgctgaggtttcctgggaggaagaggccgaacattctggggccagccacaatatcctcgtggaggtccaggatgacggaacaatgaagatcaaagatgaagaacgggacgatacgctgaccattcttctgaaggctacactcctggcggtgtccggcgtctatcctctctctatccccgccaccctgtttgtgtggtacttctggcaaaagaaaaagcagcgcagcggcgttctttgggacacacctagccctcccgaggtggaaagagctgtcctggatgacgggatttatcggatcatgcagcgcggactgctcggcagaagccaggtgggggttggagtgttccaagagaacgtctttcataccatgtggcacgtgacgcggggcgccgtgctgatgtaccaggggaaacgccttgaaccctcttgggcctccgttaagaaagacctgattagctacggaggcggctggagactccaggggtcttggaataccggagaggaggtccaggtgatcgctgtggaacccggcaagaaccctaagaatgtccaaacagcccccgggaccttcaaaacaccggagggagaagtgggcgcgattgctctggattttaagcctgggacctccggaagccccatcgttaaccgggagggcaaaatcgtgggcctctatgggaatggagtcgtgacaacgtccggcacctacgtttctgccattgcccaggctaaggccagccaggaagggcctctgcccgagatcgaggacgaagtgttcagaaaacgcaaccttacaattatggatctgcaccccggatccggcaagacccggagatatctgcctgcgatcgtccgcgaggctattaagcggaaactcagaaccctgatccttgccccgacacgcgtggttgccagcgaaatggctgaggccctgaaggggatgcccatccggtaccaaacgaccgctgtgaaatctgaacatacaggcagagagattgtcgacctcatgtgccacgccacctttacaatgcgcctgctgtcccctgtgcgggtgcccaattataacatgatcattatggatgaggcgcatttcaccgaccctagctctatcgccgctagaggatacattagcacgcgggtcggcatgggggaagccgctgccatctttatgacagccacaccccctggatccgttgaggctttcccgcagtctaatgcggtgatccaggatgaagaaagagacattcccgaaagaagctggaactccggctatgagtggatcaccgattttcctgggaagacagtgtggttcgtcccctctattaaaagcggaaatgacatcgccaactgtctccggaagaatggcaagcgcgtgattcagctttccagaaaaacctttgatacagagtaccaaaagaccaaaaacaacgactgggactacgttgtgacgacagatatcagcgaaatgggggctaatttccgggccgacagagtcattgatcctcgccggtgcctgaagcccgtgatcctgaaagacggcccggagagagttatcctcgccggacctatgcccgtgaccgtcgcttctgccgcgcagcgccggggcagaattgggcgcaaccacaataaggaaggagatcagtatatctacatgggccagcccctgaacaatgacgaggatcatgctcactggacagaggccaagatgcttctggacaacattaatacccctgaagggatcattcccgccctcttcgagcctgaacgggagaaatccgctgccatcgatggagaatatagactgcgcggcgaggcgagaaagacgtttgtggagctgatgcggcgcggggacctcccggtctggcttagctacaaagtggcctccgaaggcttccaatattctgatagacggtggtgctttgacggagagcgcaacaatcaggttctggaagagaacatggatgtggaaatctggaccaaggagggcgagcgcaagaagctgcggcccagatggctcgacgctcgcacatacagcgaccctctggcccttcgggagttcaaagagtttgctgccgggagacgctccgtgtctggagatctgattctcgaaatcggcaagctgccccagcacctgacccagcgggctcaaaatgccctcgacaaccttgtcatgctgcataatagcgagcaagggggcagagcgtatcggcacgccatggaggaactgcctgatacaattgagaccctcatgctgcttgctctgatcgccgttctcacaggcggcgtgaccctgttctttctgtccgggcgcggactcggcaagacgagcattgggcttctgtgtgtgatggcttcttccgccctgctctggatggccagcgtcgaaccccattggatcgctgcgtctatcattctggagttctttcttatggtgctgctcatcccggaacctgacagacagcggacaccccaggataaccaactggcctacgttgtgattggactcctgttcatgatccttaccgtcgctgccaatgagatgggcctgctggagaccaccaagaaggacctcgggattggacacgtggccgtcgaaaaccaccatcacgctaccatgctggatgtggaccttcatcctgcctccgcgtggacactgtacgccgttgctacgaccatcattacacccatgatgcgccacaccatcgagaacacaaccgccaatatcagcctcacggctattgccaaccaggcggccatcctgatgggcctggataaaggctggcctatttctaagatggacatcggggtgcccctccttgctctgggatgctatagccaggtcaatccgctgaccctcacagccgctgtgctgatgcttgttgcccattacgctattatcggccctgggctgcaagccaaagcgaccagagaagcccagaagcggacagctgccggaatcatgaagaaccccaccgtggatggcattgtcgctatcgacctcgatcccgtggtgtatgacgccaaatttgagaagcagctggggcagattatgctgctcatcctttgtacgtcccaaattctgctgatgcgcacaacctgggccctctgcgaatctatcacactggcgaccggacctcttaccacactgtgggagggcagcccgggcaaattctggaatacgaccatcgctgtttccatggccaacatttttagagggagctacctcgctggagccggcctggccttctccctgatgaagtctctcgggggaggccggcgcgggacaggagctcagggcgagacccttggcgaaaaatggaagagacagctgaatcagctgagcaagtccgagttcaacacatataaacggtctgggatcatggaagtcgacagaagcgaggccaaggaaggactccgccggggcgagaccacgaaacacgcggtgtccagagggacagccaagctgcgctggtttgtggagcggaatcttgtcaaacccgaaggaaaggttattgatctgggctgtgggagaggaggctggtcttactattgcgctggcctcaagaaagtgaccgaggtgaaggggtacaccaaaggaggccctgggcacgaggagcccatccctatggccacatacggatggaacctggtcaagctgcatagcggcaaagacgtgttctttattccccctgaaaagtgtgataccctcctttgcgacatcggggagtccagcccgaatcccacaattgaggaaggacgcacgctgcgggttctgaaaatggtggagccttggctcagaggcaaccaattctgtatcaagatcctgaatccctatatgccttctgtcgtggaaacccttgagcagatgcagcgcaagcacggcgggatgctggttcggaaccccctctccagaaatagcacacatgagatgtactgggtgtcttgcggaaccggcaacattgtctccgctgtgaatatgacaagccgcatgctgctgaaccggtttaccatggcccacagaaaaccgacgtatgaacgcgatgtggacctcggggcgggaaccagacacgtcgccgttgagcctgaagtggctaacctggatatcattggccagcggatcgagaatattaagcatgaacacaaatctacatggcattacgacgaggataacccctataagacctgggcctaccacgggtcctatgaggtgaaacccagcggatccgctagctctatggtcaatggcgtggttaaacttctgacaaagccttgggacgtgatccccatggtcacccaaatcgccatgacagataccacgcctttcggccagcagcgcgtgtttaaagaaaaggttgacacaagaaccccgaaagctaagcgggggaccgcccaaattatggaggtgacagcgagatggctctggggattcctgagccggaacaaaaagccccgcatctgtacgagagaagagtttacccggaaggtccgctccaatgccgctattggcgccgtgttcgttgacgaaaaccagtggaactctgctaaagaggccgtggaggatgaaagattttgggaccttgtccatcgggagcgcgaactgcacaagcaggggaaatgcgccacatgcgtgtacaacatgatgggaaagagagagaaaaagctcggcgagttcgggaaggcgaaaggcagccgggctatctggtacatgtggctgggagcccgctttctggagttcgaggccctcggcttcatgaatgaagatcactggttttccagagagaactctctgagcggggtcgaaggagagggccttcataagctggggtatattctccgggacatctccaaaatccctggaggcaatatgtacgctgatgacaccgccgggtgggatacacgcattaccgaggacgatctgcagaacgaagctaagatcacagacattatggagcccgaacacgcccttctggcgacctctatcttcaaactcacgtatcaaaataaggtggttagagtgcagcggcctgcccgcaacggcaccgtcatggatgtgattagcagacgggaccagagaggatccggccaggtggggacatacggactgaatacctttacaaacatggaggctcaactgatccgccagatggaaagcgagggcatcttctctccctccgagctcgaaaccccgaacctggccgagcgggttcttgattggctggaaaaacatggggtggagagactcaagcgcatggctattagcggagacgactgtgtcgtgaagcctatcgatgaccggtttgccacggcgctgtctgcccttaatgatatgggcaaagttagaaaggacattccccagtgggaaccttccaaagggtggaacgattggcagcaagtgcccttctgcagccaccactttcatcagctgatcatgaaggacggccgcgagattgtcgtgccttgtcggaatcaggatgagctcgtcggcagagctcgcgtgtcccagggcgccgggtggtctctgcgggaaacagcttgcctgggaaaaagctatgcccaaatgtggcagctcatgtacttccacagacgcgacctgcggcttgctgccaacgcgatctgttccgccgttcccgtggattgggtcccgaccagcagaacaacctggtctattcatgctcaccatcagtggatgacgaccgaggacatgctgtccgtgtggaatcgggtttggatcgaagagaacccttggatggaagataagacacacatcagctcttggggcgacgtgccctatctcgggaagagagaggaccaatggtgcggaagcctgattggccttaccgcccgcgccacatgggctaccaatatccaggtcgccattaaccaggtgcggagactgatcgggaatgagaactacctcgattacatgacatccatgaaacgctttaagaatgaatctgaccccgagggcgcgctgtggtga

SEQ ID NO: 18999 - RNA, 9879 nt, synthetic construct
  misc_feature 1..9879: note = derived and/or modified CDS sequence (opt5) from DENV-1__FJ882542__SS-prME
  source 1..9879: mol_type = other RNA
agcgtgaccatgctgctcatgctgatgcccaccgcccttgctttccacctgacgacccggggcggggagcctcatatgatcgtgacaaagcaggaacggggaaaatccctcctgtttaagacctctgccggcgttaatatgtgcacccttattgccatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggccttccacacccgaatgtcctgacgatcagagagcttggaacatttgggaggttgaggactatggattcggcatctttaccacgaatatttggctgaagctgcgcgatagctacacacaggtgtgcgaccaccggcttatgtctgcggccatcaaagattccaaggctgtgcatgccgacatgggctattggattgaaagcgagaaaaacgaaacctggaagctcgccagagcttctttcatcgaggtcaagacatgtatctggcccaaatcccacaccctgtggagcaatggggtgctggaatctgagatgattatcccgaagatttacggaggccctatcagccaacataactatcgccccgggtacttcacacagaccgccggaccttggcacctcggcaaactggagcttgattttgacctgtgcgaagggacgaccgttgtggtcgatgagcactgcggaaatcggggcccctccctcagaacaaccacagtgaccggcaagattatccatgaatggtgttgccggagctgtacgctgcctcccctgcgcttcaaaggggaggacggatgctggtacggcatggagatcagaccggttaaggaaaaggaggaaaaccttgtgaaatctatggtctccgcggggagcggagaggtggactccttttctctcggcctgctgtgtattagcatcatgattgaagaggttatgcggtccagatggtctcgcaagatgctcatgacagggaccctggctgtgttccttctgctcatcatgggacagctgacatggaatgatctgattcggctttgcatcatggtcggcgccaacgccagcgacagaatgggcatggggaccacctatctggctctcatggccacatttaaaatgcgccctatgttcgcggtgggactgctctttagacggctgacgtcccgcgaggtgcttctgctcaccattggcctgtctctggtcgctagcgttgaacttcccaattccctggaggaactcggggatggactggccatgggcatcatgatcctcaagctgcttacagacttccaaagccaccagctgtgggccaccctcctgtctctgacatttattaaaaccacgctttccctgcattacgcttggaagacaatggccatggtgctcagcatcgcttctctgttccccctctgtctgtccaccaccagccagaagacaacctggcttcctgtgctgctggggtctctcggatgcaaaccgctgacaatgtttcttattacggagaccaagatctggggcagaaaatcctggcccctgaacgaaggcattatggccgtcggggtggttagcatcctcctgtccagcctcctgaagaatgatgtgcctcttgcgggacccctgatcgccggcgggatgctgattgcttgttatgtcatctctggaagctccgccgacctctctctggagaaagctgccgaggtgagctgggaagaggaagccgagcactccggcgcttctcataacattcttgttgtggtccaggatgacgggacaatgaagatcaaagatgaggaacgggacgataccctgacaattctcctgaaggcgaccctcctggccgtgagcggagtctaccctctttccatccccgctacgctgttcgtgtggtatttttggcaaaagaaaaagcagcgctctggcgttctgtgggacacccctagccctcccgaggtggaaagagccgtcctcgatgacggcatctaccggattatgcagcgcgggctgcttggaagatcccaggtgggcgttggggtgttccaagagaacgtcttccacacaatgtggcacgtgacccggggagccgtgctgatgtatcagggcaaacgcctcgaacccagctgggcttctgttaagaaagacctgatctcctacgggggaggctggagactccagggcagctggaatacaggggaggaggtccaggtgattgccgtggaacccggaaagaaccctaagaatgtccaaaccgcgcccggcacatttaaaacgccggagggggaagtgggagctatcgccctggatttcaagcctggcacctctgggtcccccattgttaaccgggagggaaaaatcgtgggcctttacggcaatggggtcgtgacaaccagcggaacctatgtttccgccattgctcaggccaaggcgtctcaggaaggccctctgcccgagatcgaggacgaagtgtttagaaaacgcaacctgacaatcatggatctccatcccgggagcggaaagacgcggagatacctgcctgctattgtccgcgaggccatcaagcggaaacttagaaccctgattctcgccccgacacgcgtggttgcttccgaaatggccgaggctctgaagggcatgcccatccggtatcaaaccacagccgtgaaaagcgaacacaccgggaaggagattgtcgacctgatgtgccatgcgacgttcacaatgagactcctttctcctgtgcgcgtgcccaattacaacatgatcatcatggatgaggcccactttaccgacccttccagcattgctgcccggggctatatctctaccagagtcggaatgggcgaagctgccgccattttcatgacagctacaccccctgggagcgttgaggcgtttccgcagtccaatgccgtgatccaggatgaggaacgggacattcccgaacgctcttggaacagcggatacgagtggatcacagatttccctggcaaaaccgtgtggtttgtcccctccatcaagtctgggaatgacattgctaactgtctgagaaagaatggaaaacgggtgatccagctgagccgcaagacgttcgatacagagtatcagaagaccaagaacaatgactgggactacgttgtgacaaccgatatttccgaaatgggcgccaactttagagccgaccgggtcatcgatcctagacgctgcctcaaacccgtgattctgaaggacgggccggagcgggttatccttgctggccctatgcccgtgacggtcgccagcgcggctcagagacgcggacggattggcagaaaccataataaggaaggggatcagtacatctatatgggacagcccctgaacaatgacgaggatcacgcccactggaccgaggccaaaatgctcctggacaacatcaatacacctgaaggcattatccccgctctgttcgagcctgaacgcgagaagtctgccgcgattgatggggaataccggctcagaggagaggcccgcaaaaccttcgtggagcttatgagacggggcgacctgccggtctggctgtcctataaggtggctagcgaagggtttcaatactccgatcgcagatggtgcttcgacggcgagcggaacaatcaggttctcgaagagaacatggatgtggaaatctggacaaaagagggagagcgcaagaaactgagaccccggtggcttgacgccagaacctattctgaccctctggctctccgcgaatttaaggagttcgccgctggccggagaagcgtgtccggggatctgattctggaaatcggaaagctcccccagcatcttacacagcgcgcccaaaatgcgctggacaacctggtcatgctccacaattctgagcagggcgggcgggcctacagacatgctatggaggaactgcctgataccatcgagacgcttatgctgctcgccctgattgctgttctgacaggaggcatgaccctctttttccttagcggccgggggctgggaaaaacctccatcggcctgctctgtgtgatggccagctctgtgctgctttggatggcctccgtcgaaccccactggattgctgcgagcatcattctggagtttttcctcatggtgctgctgatcccggaacctgaccgccagagaacaccccaggataaccaactcgcctatgttgtgatcgggcttctgtttatgattctgaccgtcgctgccaatgagatgggactcctggagacaacgaagaaagaccttggcatcgggcacgtggccgtcgaaaaccatcaccatgctaccatgctggatgtggacctccaccctgcctctgcgtggacactgtacgccgttgctaccacaattatcacccccatgatgcggcatacgattgagaataccacagccaacatctccctgaccgctattgccaaccaggcggccatcctcatgggacttgataagggctggcctatcagcaaaatggacattggcgtgcccctgctggctctcgggtgctactctcaggtcaatccgctgacacttaccgccgctgtgctgatgctcgttgcccactatgctatcattggacctggcctgcaagccaaggcgacgcgcgaagcccagaagagaacagctgccgggatcatgaaaaaccccaccgtggatggaattgtcgctatcgacctggatcccgtggtgtacgacgccaagttcgagaaacagctcggccagatcatgcttctgattctgtgtacaagccaaatcctcctgatgcggaccacctgggccctttgcgaatccattacactggcgacggggcctctcaccacactgtgggagggatctccgggcaagttttggaataccacaatcgctgttagcatggccaacattttccgcggctcctatctggctggggccggactcgcctttagccttatgaaatccctgggcgggggaagacggggcaccggggctcagggagagacgctgggcgaaaagtggaagcgccagctcaatcagctgtctaaaagcgagttcaacatctacaagagatccggcatcatggaagtcgaccggtctgaggccaaagaagggcttaagagaggagagacaacccgccacgcggtgagccggggcaccgccaaactgagatggttcgtggagcgcaatctcgtcaagcccgaagggaaggttattgatctgggatgtggcagagggggatggtcctattactgcgctggcctgaaaaaggtgacagaggtgaaaggctataccaaagggggacctggccatgaggagcccatccctatggccacatacgggtggaacctcgtcaaacttcactctggaaaggacgtgtttttcacgccccctgaaaaatgtgataccctgctgtgcgacattggcgagagctccccgaatcccacaatcgaggaagggagaaccctccgcgttctgaagatggtggagccttggcttcggggaaaccaattttgtattaagatcctgaatccctacatgcctagcgtcgtggaaacactcgagcagatgcagagaaaacatggcggcatgctggttcgcaaccccctgtctagaaattccacccacgagatgtattgggtgagctgcgggacgggaaacattgtctctgctgtgaatatgacctccagaatgctcctgaaccgcttcacaatggcccaccggaagccgacctacgaaagagatgtggaccttggcgcggggacacgccatgtcgccgttgagcctgaagtggctaatctggatatcatcggacagagaattgagaacatcaaacacgaacataagagcacctggcactatgacgaggataacccctacaaaacatgggcctatcatggctcttacgaggtgaagccctccgggagcgcttccagcatggtcaatggagtggttaagctcctgaccaaaccttgggacgtgattcccatggtcacgcaaatcgccatgacagataccaccccttttggccagcagcgggtgttcaaggaaaaagttgacacacgcacgccgaaggctaaaagaggcaccgcccaaattatggaggtgacagcgcggtggctttgggggtttctgtctagaaacaagaagccccggatctgtacccgcgaagagttcacaagaaaagtccggagcaatgccgctatcggagccgtgtttgttgacgaaaaccagtggaactccgctaaggaggccgtggaggatgaacgcttctgggacctcgtccagaaagagagagaactgcacaagcagggcaaatgcgcgacctgcgtgtataacatgatggggaagcgggagaagaaactgggagaatttggcaaggcgaaagggtctcgcgctatttggtacatgtggctcggcgccagattcctggagtttgaggcccttggattcatgaatgaagatcactggttcagccgggagaactccctgtctggcgtcgaaggggagggactccataagctgggctacatccttcgcgacattagcaaaatccctgggggaaatatgtatgctgatgacacagccggctgggataccagaattacggaggacgatctgcaaaacgaagctaagatcaccgacatcatggagcccgaacacgccctcctggcgacatccatttttaaactgacctaccagaataaggtggttcgggtgcagcgccctgccaagaacgggacagtcatggatgtgatctctagacgggaccagcgcggcagcggacaagtgggcacctatgggctcaatacgttcacaaacatggaggctcagctgattagacagatggaatccgagggaatctttcttcccagcgagctggaaaccccgaatctcgccgagcgggttctggattggcttgaaaaatacggcgtggagagactgaagcgcatggctatttctggggacgactgtgtcgtgaaacctatcgatgaccggttcgccacagcgctcaccgccctgaacgatatgggaaaggttagaaaagacatcccccagtgggaaccttccaagggctggaacgattggcaacaggtgcccttttgcagccatcacttccaccagctgattatgaaggacgggcgcgagatcgtcgtgccttgtcggaatcaggatgagctcgtcggcagagctcgcgtgtctcaaggagccggctggtccctgcgggaaacggcttgccttgggaaaagctatgcccagatgtggcagctgatgtactttcatagacgcgacctccggctggctgccaacgcgatttgttccgccgttcccgtggattgggtcccgacctctagaacaacctggagcatccacgctcatcaccaatggatgacaaccgaggacatgctttccgtgtggaatcgcgtttggattgaagagaacccttggatggaagataagacacatgtgagctcttggggagacgtcccctatctgggcaaacgggaggaccagtggtgcgggtccctcatcggactgaccgccagagccacgtgggctagcaatattcaggtggccatcaaccaggtgcggagactgatcggcaatgagaactacctcgattacatgacatctatgaagcgcttcaaaaatgaaggggaccccgagggcgcgctgtggtga

SEQ ID NO: 19000 - RNA, 9879 nt, synthetic construct
  misc_feature 1..9879: note = derived and/or modified CDS sequence (opt5) from DENV-1__FJ882543__SS-prME
  source 1..9879: mol_type = other RNA
agcgtgaccatgctgctcatgctgatgcccaccgcccttgctttccacctgacgacccggggcggggagcctcatatgatcgtcacaaagcaggaacggggaaagtccctcctgtttaagacctctgccggcgttaacatgtgcacccttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagatgcgcgattcctacacacaggtctgcgaccaccggctgatgagcgcggccatcaaagattctaaggctgttcatgccgacatgggctattggatcgaatccgagaaaaatgaaacctggaaacttgccagagctagcttcattgaggtgaagacatgtatctggcccaaatctcacaccctctggtccaacggggtgctggaaagcgagatgattatcccgaagatttacggaggccctatctctcaacataatcaccgccccgggtatttcacacagaccgccggaccttggcacctgggcaaactcgagctggattttgacctttgcgaagggacgaccgtcgtggttgatgagcattgcggaaaccggggccccagcctgagaacaaccacagtgaccggcaagatcattcacgaatggtgttgccggtcctgtacgctccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgacagggaccctcgctgtgttcctgcttctgatcatgggacagctcacatggaacgatctgattcggctgtgcatcatggttggcgccaatgcctctgacagaatgggcatggggaccacctaccttgctctgatggccacatttaaaatgcgccctatgttcgcggtgggactcctgtttagacggctcacgagccgcgaggtcctgcttctgaccatcggcctctccctggtggcttctgtggaactgcccaacagccttgaggaactgggggatggactcgccatgggcattatgatcctgaagctcctgacagacttccaatcccatcagctttgggccgctctgctcagcctgacctttattaaaacaaccctgtctcttcactatgcctggaagacgatggctatggtcctgtccatcgttagcctcattcccctgtgtctctctacaacctcccagaagaccacatggctgcctgtgcttctggggagcctgggatgcaaaccgctcaccatgttcctgatcgccgagaataagatctggggcagaaaatcttggccccttaacgaaggcattatggcggtgggggtcgtgtccatcctgctcagctccctgctcaagaacgatgttcctctggccggaccccttattgctggcgggatgctgatcgcctgttacgtgattagcggatctagcgctgacctgtccctcgagaaagccgccgaggtctcttgggaagaggaagctgagcatagcggcgcgtcccacaatatcctggtggaagttcaggatgacgggacaatgaagatcaaagatgaggagcgggacgatacgcttaccattctgctcaaggccacactgctcgctgtgtctggagtctatcctctgagcatccccgccaccctttttgtgtggtacttctggcaaaagaaaaagcagcgctccggcgtcctgtgggacacaccttctcccccggaagtggagagagccgttctggatgacggcatttatcggatcatgcagcgcgggctcctgggaagaagccaggtgggcgtcggggtgtttcaagaaaacgttttccacaccatgtggcatgtgacgcggggagctgtccttatgtaccagggcaaacgcctggagccttcctgggccagcgtgaagaaagacctcatttcttatgggggaggctggagactgcagggctcctggaataccggggaggaagtgcaggttatcgcggtcgagcccggaaagaaccctaagaatgtgcaaacagctcccggcaccttcaaaacaccggaaggggaggtgggagccattgccctcgattttaagcctggcaccagcgggtctcccatcgtcaaccgggaaggaaaaatcgtgggcctgtacggcaatggggttgtgacaacgtccggaacctacgtcagcgctattgcccaggcgaaggcttcccaggagggccctcttcccgagatcgaagacgaggtgttcagaaaacgcaacctgacaattatggatctgcaccccgggtctggaaagacccggagatatctccctgccatcgttcgcgaagccattaagcggaaactgagaacccttatcctggctccgacacgcgtggtcgccagcgagatggctgaagccctcaagggcatgcccatccggtaccaaacgaccgcggtgaaatccgagcatacagggaaggagattgttgacctgatgtgccacgccacctttacaatgagactgctcagccctgtgcgcgtccccaattataacatgatcattatggatgaagctcatttcaccgacccttcttccatcgccgctcggggctacattagcacgagagtgggaatgggcgaggccgccgctatctttatgacagcgacaccccctgggtctgtggaagccttcccgcagagcaatgctgtcatccaggatgaggaacgggacattcccgagcgctcctggaactctggatatgagtggatcaccgattttcttggcaaaacagtttggttcgtgcctagcattaagtccgggaatgacatcgccaactgtctgagaaagaatggaaaacgggtgattcagctgtctcgcaagacctttgatacagaataccagaagaccaagaacaacgactgggactatgtcgtgacgacagatatcagcgagatgggcgccaatttcagagctgaccgggttattgatcccagacgctgcctcaaacctgtgatcctgaaggacgggcccgaacgggtcatccttgccggcccgatgcctgtgaccgttgcgtccgctgcccagagacgcggacggattggcagaaaccacaataaggagggggatcagtacatctacatgggacagcccctgaacaatgacgaggatcacgcccattggacagaagctaaaatgctcctggacaacattaatacccccgagggcatcattcctgccctgtttgaacccgagcgcgaaaagagcgcggccatcgatggggagtatcggctcagaggagaggctcgcaaaacgttcgtggaacttatgagacggggcgacctgcctgtctggctgtcttacaaggtggcctccgaggggttccaatatagcgatcgcagatggtgctttgacggcgaacggaacaatcaggtcctcgaggaaaacatggatgtggagatctggaccaaagagggagaacgcaagaaactgagaccgcggtggcttgacgctagaacatactccgaccccctggccctccgcgagttcaaggaatttgctgccggccggagatctgttagcggggatctgattctggagatcggaaagctccctcagcaccttacccagcgcgcgcaaaatgccctggacaacctggtgatgctccataattccgaacagggcgggcgggcttatagacacgccatggaggagctgcccgatacaattgaaacccttatgctgctcgctctgatcgccgtgctgacaggaggcgtcaccctcttctttctttctggccgggggctgggaaaaacgagcattggcctgctctgtgttatggcctccagcgtgctgctttggatggcttctgtggagcctcactggatcgcggcctccatcattctggagttctttctcatggtcctgctgatccccgagccggaccgccagagaacacctcaggataaccaactcgcttacgtggttattgggcttctgttcatgatcctgaccgtggccgccaatgagatgggactcctggaaaccacaaagaaagaccttggcattgggcatgtcgctgtggagaaccaccatcacgccaccatgctggatgtcgacctccatcccgcgagcgcctggacactgtatgctgtggccacgaccatcattacacctatgatgcggcacaccatcgaaaacacaaccgctaatatctctctgacggccattgcgaaccaggccgctatcctcatgggacttgataagggctggcccatttccaaaatggacatcggcgttcctctgctggccctcgggtgctacagccaggtgaatcccctgacccttacagctgccgtcctgatgctcgtggctcactacgccattatcggaccgggcctgcaagcgaaggccacccgcgaggctcagaagagaacagccgctgggatcatgaaaaaccctaccgttgatggaattgtggccatcgacctggatcccgtcgtgtatgacgccaagtttgaaaaacagctcggccagattatgcttctgatcctgtgtacgtctcaaattctcctgatgcggacaacctgggcgctttgcgagagcatcacactggctaccgggcccctcaccacactgtgggagggatcccctggcaagttctggaatacgaccatcgccgtgtctatggctaacatttttcgcggcagctacctggccggggccggactcgctttctcccttatgaaaagcctgggcgggggaagacggggcacaggggcccagggagaaaccctgggcgagaagtggaagcgccagctcaatcagctgtccaaatctgaatttaacatctataagagaagcggcattatggaggttgaccggtccgaagcgaaagaggggcttaagagaggagagacaacccgccatgccgtctctcggggcacggctaaactgagatggttcgtggaacgcaatctcgtgaagccggaggggaaggtcatcgatctgggatgtggcagagggggatggagctactattgcgccggcctgaaaaaggttacagaagtgaaaggctacaccaaagggggacccggccacgaggaacctattcccatggctacctatgggtggaacctcgtgaaacttcattccggaaaggacgtcttctttacacctcccgagaaatgtgataccctgctgtgcgacatcggcgagtctagccctaatccgacaattgaagaggggagaacgctccgcgtgctgaagatggttgaaccctggcttcggggaaaccaattctgtatcaagatcctgaatccttacatgccctccgtggtcgagaccctcgagcagatgcagagaaaacacggcggcatgctggtgcgcaaccctctgagcagaaattctacacacgaaatgtactgggtttcctgcgggaccggaaacattgtgagcgccgtcaatatgacatctagaatgctcctgaaccgctttaccatggcgcatcggaagcccacgtatgagaaagatgtggaccttggcgccgggaccagacacgtggctgtcgaaccggaggttgccaacctggatatcattggacagcgcatcgaaaatattaagcatgagcacaaatccacatggcattacgacgaggataacccttataagacctgggcttaccacggcagctatgaagtgaagccctctgggtccgccagctccatggtgaatggagtcgtgaaactcctgacaaagccctgggacgttatccctatggtgacccaaatcgctatgacagataccacgcccttcggccagcagagagtctttaaagagaaggtggacacacggacccctaaagccaagcgcggcaccgttcaaattatggaagtgacagcgagatggctttgggggttcctgagccggaacaagaaaccgagaatctgtacgcgggaggaatttacccgcaaggtcagatctaatgccgctattggagccgtgttcgttgacgagaaccagtggaatagcgctaaagaggccgtggaagatgagcggttttgggacctcgtcaagaaagaacgcgagctgcacaagcagggcaagtgcgccacatgcgtgtacaacatgatggggaaaagagaaaagaaactgggagagttcggcaaggcgaaagggtcccgggctatctggtatatgtggctcggcgcccgctttctggagttcgaagcccttggatttatgaatgaggatcattggttctctagagaaaacagcctgtccggcgtcgagggggagggactccacaagctgggctacattcttcgggacatctctaaaatccccgggggaaatatgtacgctgatgacaccgccggctgggatacacgcattaccgaagacgatctgcagaacgaggctaagatcacagacattatggaacctgagcatgccctcctggcgaccagcatcttcaagctgacgtatcaaaataaagtggttagagtgcagcggcccgccaagaacgggaccgtcatggatgtgatttcccgcagagaccagcggggctctggacaggtgggcacatacgggctcaatacctttacaaacatggaagctcaactgatccgccagatggagagcgagggaatcttccttccttccgaactggagacccccaacctcgccgaaagagttctggattggcttgagaaatatggcgtggaacggctgaagagaatggctattagcggggacgactgtgtcgtgaaaccgatcgatgaccgctttgccacggcgctcacagccctgaatgatatgggaaaggttcggaaggacattcctcagtgggagccctctaaaggctggaacgattggcagcaagtgcctttctgctcccaccactttcatcagctgatcatgaaggacgggagagagattgtcgtgccctgtcgcaatcaggatgaactcgtcggccgggctagagtgagccagggagccggctggtctctgcgcgagaccgcttgccttgggaaatcctacgcccaaatgtggcagctgatgtatttccaccggagagacctccgcctggctgccaacgcgatctgtagcgccgttcctgtggattgggtccccacatcccggaccacgtggtctattcatgctcaccatcagtggatgaccacagaagacatgcttagcgtgtggaatagagtttggatcgaggaaaacccgtggatggaggataagacccacgtgtccagctgggaggacgtcccttacctgggaaaacgcgaagaccaatggtgcggctctctcatcgggctgacagcccgggccacctgggcttccaatattcaggtggccatcaaccaggtgagacggctgattggaaatgagaactatctcgattacatgacaagcatgaagagatttaagaatgaaggcgaccccgagggggcgctgtggtga

SEQ ID NO: 19001 - RNA, 9879 nt, synthetic construct
  misc_feature 1..9879: note = derived and/or modified CDS sequence (opt5) from DENV-1__FJ882544__SS-prME
  source 1..9879: mol_type = other RNA
tccgtgaccatgctgctcatgctgatgcccacagcccttgctttccacctgacgacccggggaggggaacctcatatgatcgtctccaagcaggaacgggggaaatctctcctgtttaagacaagcgccggcgttaacatgtgcacccttatcgcgatggacctgggggaactctgtgaagatacaatgacctacaaatgcccgcgcatcacagagaccgaacccgacgatgtggactgttggtgcaatgctacggatacctgggtgacatatgggacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggaaccgggattttgttgagggactgtccggcgctacgtgggtggacgtcgtgctcgagcacgggagctgtgtgaccacaatggccaaggataaacccaccctggacatcgaactgctcaagacagaggtcaccaatcctgctgttctgcgcaaactttgcattgaagccaagatctctaacacgacaaccgattccagatgtccgacccaaggagaggcgacactggtggaagaacaagacgccaatttcgtgtgccggcgcacctttgtcgatagaggctggggcaacgggtgtggactcttcggcaaagggagcctgattacatgcgctaagtttaagtgcgtgacgaaacttgagggaaagatcgttcagtacgaaaatctgaaatattctgtgatcgtcaccgtgcacacaggcgaccagcatcaagttgggaacgagtccaccgaacacggaacaaccgccacgattacaccccaagctcctaccaccgagatccagctcacagactacggcgccctgaccctggattgtagcccccggacgggcctcgacttcaatgaaatggtgctgcttacaatgaaggagaaatcttggctggtccataagcagtggtttctcgatctgcctcttccctggacctccggggccagcacatcccaagagacctggaaccgccaggacctgctcgtgaccttcaaaacagctcacgcgaagaagcaggaagtcgtggttctgggatctcaagagggcgccatgcacacggctctgaccggggccacagaaattcagaccagcggaacaaccacgatctttgccggccatctcaaatgcagactgaagatggataaacttacactgaaggggatgtcctatgtgatgtgtaccggcagcttcaaactcgagaaggaagtcgctgagacccagcacggaacagtgctggttcagattaagtacgagggcaccgacgccccgtgcaaaatccctttctctacacaagatgaaaagggggtgacgcagaatggacggctgatcaccgcgaaccccattgtcacagacaaaggcaagcctgtgaatatcgaggctgaaccgccctttggggagtcctatattgtgatcggagccggcgagaaagcccttaagctcagctggttcaagaaagggtctagcattggcaagatgtttgaagctaccgccagaggagctcgccggatggccatcctgggcgatacagcgtgggacttcgggtccatcggaggcgtttttacctctgtcgggaaactggtgcatcagattttcggaacggcctacggcgtgctctttagcggggtctcctggaccatgaagatcggcattggagtgctgcttacatggctgggcctcaacagcagatctacctccctgagcatgacatgtatcgctgttgggctggtgaccctttacctcggagtcatggtgcaggccgattctggctgcgttattaattggaaagggcgcgagctgaagtgtggatccggcatcttcgtgacaaacgaagtccacacctggacggagcaatataagtttcaggctgacagccctaaacggctgtccgccgcgattgggaaggcctgggaagagggcgtgtgcggaatcagatctgctacacgcctcgagaacatcatgtggaaacagattagcaatgaactgaaccatatccttctggagaatgacatgaagttcaccgttgtggtcggcgatgtggccgggattctcgctcagggcaagaagatgatccggccgcaacccatggaatacaaatattcctggaagtcttggggcaaggccaaaattatcggggccgacgtgcagaacaccacatttatcattgatggacctaatacccccgagtgtcctgacgatcagagagcttggaacatctgggaagtcgaggactacggcttcggcatttttacgacaaatatctggctgaagctgcgcgatagctatacccaggtttgcgaccaccggcttatgtccgcggccattaaagatagcaaggctgtgcacgccgacatggggtactggatcgagtctgagaaaaatgagacatggaagctcgccagagcttccttcatcgaagtgaagacctgtatttggcccaaaagccatacactgtggtctaatggagtcctggagtccgaaatgatcattccgaagatctatggcgggcctattagccaacacaactaccgccccggatacttcacccagacggccggcccttggcatctcgggaaactggagcttgattttgacctgtgcgagggaaccacagtggttgtggatgaacactgcggcaatcggggcccctctctcagaaccacaaccgtcacggggaagatcatccacgagtggtgttgccggagctgtacactgcctcccctgcgcttcagaggagaagacggctgctggtatgggatggagattcggccggtgaaagagaaggaagagaaccttgttaagtccatggtgagcgcgggatctggcgaagtcgactcctttagcctcgggctgctgtgtatctccattatgatcgaggaagtgatgagatctcgctggagccggaaaatgctcatgaccggaacactggctgttttctttcttctgattatgggccagctcacctggaatgatctgatcagactgtgcattatggtgggcgccaacgcctccgaccgcatggggatgggaaccacataccttgctctgatggccacgttcaagatgagacctatgtttgcggtcggcctcctgttccggcgcctcacctctagagaggtgctgcttctgacaatcgggctcagcctggtggcttccgtcgagctgcccaattctcttgaagaactgggagatggcctcgccatggggatcatgattctgaaactcctgaccgactttcaaagccatcagctttgggccacactgctctccctgaccttcatcaagacgacatttagcctgcactatgcttggaaaaccatggccatggttctttctattgtgtccctgttccccctctgtctgagcaccacatctcagaagaccacatggctccctgtgctgcttggatccctgggctgcaagccgctgacgatgtttctcatcgctgaaaacaaaatttggggccggcgcagctggcccctgaacgaggggatcatggccgtcggaatcgtgtctattcttctgtccagcctcctgaagaatgatgttcctctcgcgggccccctgatcgccgggggaatgcttattgcttgttacgtgatctccggcagctctgccgacctgagcctggaaaaagctgccgaggtctcctgggaggaagaggccgaacattctggggctagccacaacattctcgtggaggttcaggatgacggaaccatgaagatcaaagatgaagagagagacgatacactgaccatccttctgaaggcgacactcctggccgtgtccggcgtctatcctctctctattcccgctaccctgttcgtgtggtacttctggcagaaaaagaagcagcggagcggcgtcctttgggacacgcctagccctcccgaggtggggcgcgccgttctggatgacggaatctatagaattatgcagcggggcctgctcgggcgctctcaggtgggagtcggcgtgtttcaagaaaatgttttccataccatgtggcacgtgacaagaggggccgtcctgatgtaccagggaaaacggcttgagcccagctgggcttccgtgaagaaagacctgatcagctacggcggcgggtggagactccagggatcttggaacaccggcgaagaggtgcaggttattgccgtcgagcccgggaagaatcctaaaaacgtgcaaacagcgcccggaacctttaagacaccggaaggcgaggtgggggctatcgccctggatttcaagcctggaacgtccggcagccccattgtcaatcgcgaaggcaaaatcgtggggctctatggaaacggcgttgtgaccacatctgggacctacgtctccgccatcgctcaggccaaggcgagccaggagggacctctgcccgaaattgaggacgaggtgtttcggaaaagaaatcttaccatcatggatctgcaccccggctccgggaagacacgccggtatctgcctgctattgttagagaagccatcaaacgcaagctccggacgctgattcttgccccgaccagagtggtcgcttctgagatggccgaagctctgaagggcatgcccatccgctaccaaacaaccgccgtgaaaagcgagcatacaggaaaggaaatcgttgacctcatgtgccacgcgaccttcacgatgcggctgctgtcccctgtgagagtccccaactataatatgattatcatggatgaggcccattttacagaccctagctctattgctgcccggggctacatctccacccgcgtggggatgggagaggctgccgccattttcatgaccgctacaccccctggcagcgtggaagcgtttccgcagtctaacgccgtcatccaggatgaggaaagagacatccccgagcggagctggaactccgggtatgaatggattaccgatttccctggaaaaacagtttggtttgtgccctctatcaagagcggcaacgacattgctaattgtctccgcaaaaacgggaagagagtgatccagctttcccggaagaccttcgatacggagtaccagaaaaccaagaacaatgactgggactacgtcgtgaccacagatatttctgagatgggcgccaacttcagagccgaccgcgttatcgatcctcggagatgcctgaaacccgtgattctgaaggacggaccggaacgcgtcatcctcgctggccctatgcccgtgaccgttgccagcgcggctcagcggagagggcgcatcggacggaatcacaacaaagagggcgatcagtatatttacatggggcagcccctgaataacgacgaagatcatgcccactggacggaggccaagatgcttctggacaatatcaacacccctgagggaattatccccgctctctttgaacctgagagagaaaagtccgccgcgattgatggcgagtatcgcctgagaggggaagcccggaaaacattcgtggagctgatgcgcagaggcgacctcccggtctggcttagctacaaggtggcttctgagggatttcaatattccgatcggcgctggtgcttcgacggcgaaagaaataaccaggtcctggaggaaaatatggatgtggagatctggaccaaagaaggggagcggaagaaactgagaccccgctggctcgacgcccggacatacagcgaccctctggctcttagagagtttaaggagttcgccgctggacgccggtccgtttctggcgatctgatcctcgagattgggaaactgccccagcacctgacccagagagcccaaaacgcgctcgacaatcttgtgatgctgcataacagcgaacagggaggccgggcctatcgccacgctatggaggaactgcctgatacaatcgagaccctcatgctgcttgccctgattgctgtgctcacgggcggggtcacactgtttttcctgtccggaagaggcctcgggaagacctctatcggacttctgtgtgttatggccagctccgtgctgctctggatggccagcgtggagccccattggattgctgcgtctatcatcctggaatttttccttatggtcctgctcattccggagcctgaccggcagcgcacaccccaggataatcaactggcctacgtggttatcggcctgctctttatgattcttacagtggctgccaacgaaatggggctgctggagaccacaaagaaagacctcggaatcggccacgtcgccgtggagaaccaccatcacgctgccatgctggatgtcgaccttcatcctgcgtccgcctggacgctgtacgctgtggccaccacaattatcacccccatgatgagacacacaattgaaaataccacggctaacatcagcctcaccgccatcgcgaatcaggccgctattctgatgggcctggataaggggtggcctatctctaaaatggacattggagttcccctccttgccctgggctgctattcccaggtgaacccgctgacactcaccgctgccgtcctgatgcttgtggctcattacgccatcattgggcctggactgcaagcgaaggccacacgggaggctcagaaacgcaccgccgctggcatcatgaagaatcccacggttgatgggatcgtggccattgacctcgatcccgtcgtgtatgacgccaagttcgaaaaacagctgggacagatcatgctgctcattctttgtacaagccaaatcctgctgatgagaaccacatgggcgctctgcgagtctattaccctggctaccggccctcttacaacgctgtgggaaggcagcccggggaagttttggaacaccacaatcgccgtgtccatggctaatatcttccggggatcttacctcgccggcgccgggctggctttcagcctgatgaaatccctcggaggcgggcgcagaggaaccggcgcccagggcgagacacttggggagaagtggaaacggcagctgaaccagctgagcaagtccgaatttaatacctataagagatctggaattatggaggttgaccgcagcgaagcgaaagagggcctcaagagaggggaaacgacaaaacacgccgtctccagaggaaccgctaagctgcgctggttcgtggagcggaaccttgtgaaacccgagggcaaggtcatcgatctggggtgtggaagaggcggctggtcttactattgcgccgggctcaagaaagttaccgaagtgaagggatacacaaaaggcgggcctggacacgaggaacccattcctatggctacctacggctggaatctggtgaagctgcatagcgggaaagacgtctttttcattccccctgagaagtgtgatacactcctttgcgacattggagaatcctctccgaaccccacgatcgaggagggccgcaccctgcgggtgctgaaaatggttgaaccttggctcagaggcaatcaattttgtattaagatcctgaacccctatatgcctagcgtggtcgagacacttgaacagatgcagcgcaagcacgggggaatgctggtgcggaatcccctctccagaaacagcacccatgagatgtactgggtttcttgcggcacagggaatatcgtgtccgccgtcaacatgaccagccgcatgctgctgaaccggttcacgatggcgcacagaaaaccgacctatgagcgcgatgtggacctcggagccggcacaagacacgtggctgtcgaacctgaggttgccaatctggatattatcgggcagcggattgaaaacatcaagcatgagcacaaatctacctggcattacgacgaagataatccctataagacatgggcttaccacggatcctatgaggtgaaacccagcggctctgcctccagcatggtgaacggcgtcgtgaaacttctgaccaagccttgggacgttattcccatggtgacacaaatcgctatgaccgatacgacaccttttgggcagcagcgcgtcttcaaagagaaggtggacaccagaaccccgaaagccaagcggggaacagcgcaaatcatggaagttacggccaaatggctctggggctttctgtccagaaataagaagccccggatttgtacccgcgaggagttcacaagaaaagtgcggagcaacgctgccatcggggctgtctttgtggacgagaatcagtggaactctgccaaggaagccgttgaggatgagcgcttctgggaccttgtgcatagagaacgggagctgcacaaacagggaaagtgcgcgacctgcgtctacaatatgatgggcaaacgcgaaaagaagctcggggagtttggcaaagctaagggaagcagagccatttggtacatgtggctgggcgcccggttcctggagttcgaggctctcgggtttatgaacgaggatcactggttctcccgcgaaaattctctgagcggagtggagggcgaagggcttcataaactgggatatatcctcagagacatttccaacatccctggcgggaatatgtacgccgatgacacagctggctgggatacccggatcacagaggacgatctgcagaacgaggcccgcattaccgacatcatggaacccgagcacgcgcttctggccaagtctatttttaaactcacgtatcaaaataaggtcgtgagagttcagcggcctgctaaaaacggaaccgtgatggatgtcatcagccgcagagaccagcggggctccggacaggtgggaacatacggcctgaacaccttcacaaatatggaagcccaactgattagacagatggagtctgaagggatctttagcccctccgagctcgagaccccgaacctggctgaacgcgtgcttgattggctggagaagtatggagttgaacggctcaagagaatggccatcagcggcgacgactgtgtggtcaaacctattgatgaccgcttcgcgacggccctgacagctcttaatgatatggggaaggtgcggaaagacatcccccagtgggagccttctaagggctggaacgattggcagcaagttcccttttgctcccatcacttccaccagctgattatgaaagacggaagagaaatcgtggtcccttgtcgcaatcaggatgagctcgtgggccgggccagagtcagccagggggctggatggtctctgcgcgagaccgcctgcctgggcaagtcctacgctcaaatgtggcagctcatgtattttcatcggagagacctgcgccttgccgcgaacgccatttgtagcgctgtgcccgttgattggatcccgacatcccggaccacgtggtctattcacgcccatcaccagtggatgaccacagaagacatgctgagcgtgtggaatagagtctggatcgaggaaaacccttggatggaggataagacccatatctccagctggggagacgtgccctacctcggaaaacgggaagaccaatggtgcggctctctgattgggcttacagccagagctacctgggccacaaatatccaggttgcgattaaccaggtgcgccggctgatcggcaatgagaactacctcgattatatgacctccatgaagagattcaaaaatgagagcgaccccgaaggagctctgtggtga

SEQ ID NO: 19002 - RNA, 9879 nt, synthetic construct
  misc_feature 1..9879: note = derived and/or modified CDS sequence (opt5) from DENV-1__FJ898371__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaagtcccttctgtttaagacctctgccggcgttaatatgtgcacccttattgccatggacctgggggaactctgtgaagataccatgacatacaagtgcccgcgcatcaccgaggctgaacccgacgatgtggactgttggtgcaatgccacggatacctgggtgacatatggaacctgtagccagacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataagcccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttcctgacccaagatgaaaagggggttacacagaacggacggcttatcacggctaatcccattgtgaccgacaaagagaagcctgtcaacatcgaagccgagccgccctttggcgagtcctatattgtgatcggggccggagaaaaagctctcaagctgagctggttcaagaaaggctctagcattgggaagatgtttgaggccacagctagaggcgcccgccggatggcgatcctgggagataccgcctgggacttcggctccatcgggggagtgtttacatctgttggcaaactcgtccatcagattttcgggaccgcttacggagtgctgtttagcggcgtgtcctggacgatgaagatcgggattggcgtccttctgacctggctcggactgaatagcagatctacatccctgagcatgacctgtatcgccgtgggccttgttacactctacctgggggtgatggtccaggctgattctggatgcgtgattaactggaaaggccgcgaactgaagtgtgggtccggaatcttcgttaccaatgaggtgcacacatggaccgaacaatataagtttcaggccgacagccctaaacggctctccgcggccattggcaaggcttgggaggagggggtctgcggcatcagatctgccacgcgcctggaaaacatcatgtggaaacagattagcaacgagcttaatcatatcctgctcgaaaacgacatgaagttcacagtggttgtgggagatgtcgtgggcattctggctcaggggaaaaagatgatccggccgcaacccatggagcacaaatactcctggaagtcttggggaaaggccaaaattatcggcgccgacgtgcagaataccacctttatcattgatgggcctaacacacccgaatgtcctgacgatcagagagcttggaatatctgggaggtcgaggactatggattcggcatttttaccacgaacatctggctgaaacttcgcgatagccacacacaggtttgcgaccatcggctcatgtccgcggccattaaagatagcaaggctgtgcacgccgacatgggctactggatcgaatctgagaaaaatgaaacctggaagctggccagagcttccttcatcgaggtgaagacatgtatttggcccaaaagccataccctgtggtctaacggggtcctcgaatccgagatgatcattccgaagatctatggaggccctattagccaacacaattaccgccccgggtatttcacacagaccgccggaccttggcacctgggcaaacttgagctggattttgacctctgcgaagggacgaccgtggttgtggatgagcattgcggaaaccggggcccctctctgagaacaaccacagtcaccggcaagatcatccacgaatggtgttgccggagctgtacgctgcctccccttcgcttcaaaggggaggacggatgctggtacggcatggagattagaccggtgaaggaaaaggaggaaaatctcgttaaatccatggtgagcgcggggtctggagaggtcgactcctttagcctgggcctgctctgtatctccattatgatcgaagaggtgatgcggtctagatggagccgcaagatgctgatgacagggacccttgctgttttcctgctcctgattatgggacagctgacatggaacgatcttatccggctgtgcattatggtgggcgccaatgcctccgacagaatgggcatggggaccacctacctcgctctgatggccacatttaaaatgcgccctatgttcgcggtcggactcctgtttagacggcttacgtctcgcgaggtgctgctcctgaccatcggcctgagccttgtggcttccgtcgaactgcccaactctctcgaggaactgggggatggactcgccatgggcatcatgattctgaaacttctgacagacttccaaagccatcagctctgggccaccctgctgtcccttacatttatcaaaaccacgctgagcctccactatgcttggaagacaatggccatggttctgtctattgtgtccctcttccccctgtgtcttagcaccacctctcagaagacaacctggctgcctgtgctgctcgggtccctgggatgcaaaccgcttacaatgtttctgatcgctgagaataagatttggggcagaaaaagctggcccctcaacgaaggcatcatggccgtcggggtggtttctatcctgctctccagcctgcttaagaacgatgtgcctctggcgggacccctgattgccggcgggatgctcatcgcttgttacgtcatttccggaagctctgccgacctgagccttgagaaagctgccgaggtgtcctgggaagaggaagccgagcattctggcgctagccacaatatcctggttgaagtgcaggatgacgggacgatgaagattaaagatgaggagcgggacgataccctcacaatcctgctcaaggcgaccctgcttgccgtctccggagtgtatcctctgtctatccccgctacactgttcgtctggtacttttggcaaaagaaaaagcagcgcagcggcgtgctctgggacacccctagccctcccgaagttgagagagccgtgctggatgacggcatttatcggatcatgcagcgcgggcttctgggaagatctcaggtcggcgtgggggttttccaagaaaacgtgttccacacgatgtggcatgtcacccggggagccgtgctcatgtaccagggcaaacgcctggagcccagctgggcttccgtgaagaaagacctcattagctatgggggaggctggagactgcagggctcttggaatacaggggaggaagttcaggtcatcgccgtggagcccggaaagaaccctaagaatgtgcaaaccgcgcccggcacatttaaaaccccggaaggggaggtcggagctattgcccttgatttcaagcctggcacatccgggagccccatcgtgaaccgggaaggaaaaattgttggcctgtacggcaatggggtggtcacgacctctggaacatacgtgtccgccatcgctcaggccaaggcgagccaggagggccctctgcccgagatcgaagacgaggtttttagaaaacgcaacctcaccattatggatctgcaccccgggtccggaaagacccggagatatcttcctgctatcgtgcgcgaagccattaagcggaaactgagaacactcatcctggccccgacgcgcgtcgtggcttctgagatggccgaagctctgaagggcatgcccattcggtaccaaaccacagccgttaaaagcgagcataccgggaaggagatcgtggacctcatgtgccacgcgacattcaccatgagacttctgtcccctgtccgcgtgcccaattataacatgatcattatggatgaagcccattttacggaccctagctctatcgctgcccggggctacatttccacaagagtgggaatgggcgaggctgccgccatcttcatgaccgctacaccccctgggagcgtcgaagcgtttccgcagtctaatgccgttattcaggatgaggaacgggacatccccgagcgcagctggaactccggatatgagtggatcacagatttccctggcaaaaccgtgtggtttgtgccctctattaagagcgggaatgacatcgctaactgtctgagaaagaatggaaaacgggtcattcagctctcccgcaagacattcgataccgaataccagaagacgaagaacaacgactgggactatgtggttacaaccgatatctctgagatgggcgccaattttagagccgaccgggtgattgatcctagacgctgcctgaaacccgtcatccttaaggacgggccggaacgggtgattctggctggccctatgcccgttacagtggccagcgcggctcagagacgcggacggatcggcagaaaccacaataaggagggggatcagtacatctacatgggacagcccctcaacaatgacgaggatcacgcccattggaccgaagccaaaatgctgctggacaacattaatacgcctgagggcatcattcccgctctcttcgaacctgagcgcgaaaagtccgccgcgatcgatggggagtatcggcttagaggagaggcccgcaaaaccttcgtcgaactgatgagacggggcgacctgccggtgtggctcagctacaaggtcgcttctgaggggtttcaatattccgatcgcagatggtgcttcgacggcgaacggaacaatcaggtgctggaggaaaacatggatgttgagatttggacaaaagagggagaacgcaagaaacttagaccccggtggctggacgccagaacctacagcgaccctctcgctctgcgcgagtttaaggagttcgccgctggccggagatccgtgtctggggatctgatcctcgagatcggaaaacttccccagcacctgacacagcgcgcccaaaatgcgctggacaacctcgtgatgctgcataatagcgaacagggcgggcgggcctatagacacgctatggaggagcttcctgataccattgaaacactgatgctcctggccctgatcgctgtcctcaccggaggcgttacgctctttttcctgtccggccgggggctgggaaaaacatctattggcctcctgtgtgtgatggccagctccgtgcttctgtggatggccagcgtcgagccccactggatcgctgcgtctattatcctcgaatttttcctgatggtgctgctcatcccggagcctgaccgccagagaacaccccaggataaccaacttgcctacgttgtgattgggctgctgtttatgatcctcaccgtcgctgccaatgagatgggactgcttgaaacaaccaagaaagacctgggcattgggcatgtggccgtcgagaaccaccatcacgctacaatgctcgatgtggacctgcatcctgcctccgcgtggacgctgtatgccgttgctaccacaatcattacccccatgatgcggcacacaatcgaaaacaccacggccaatattagcctcaccgctatcgccaaccaggcggccatccttatgggactggataagggctggcctatttctaaaatggacatcggcgtgcccctgctcgctctggggtgctactcccaggtcaatccgcttacactgaccgccgctgtgctcatgctggttgcccactacgctattatcggacctggcctgcaagccaaggcgacacgcgaggcccagaagagaaccgctgccgggattatgaaaaaccccacggtggatggaatcgtcgctatcgacctcgatcccgtggtgtatgacgccaagttcgaaaaacagcttggccagattatgctgctgatcctctgtacaagccaaattctgcttatgcggaccacatgggccctgtgcgagtctatcaccctcgcgaccgggcctctgacaacgctgtgggagggaagcccgggcaagttttggaataccacaattgctgtttccatggccaacatcttccgcggctcttacctcgctggggccggacttgcctttagcctgatgaaatccctgggcgggggaagacggggcaccggggctcagggagaaacactcggcgagaagtggaagcgccagctgaatcagcttagcaaatccgagttcaacatctataagagatctggcattatggaggtcgaccggagcgaagccaaagaggggctgaagagaggagagaccacgcgccatgcggtgtcccggggcacagccaaactcagatggttcgtggaacgcaatctggtcaagcccgaggggaaggttatcgatctgggatgtggcagagggggatggtcttactattgcgctggcctcaaaaaggtgaccgaagtgaaaggctacaccaaagggggacctggccacgaggaacccattcctatggccacatatgggtggaaccttgtcaaactgcatagcggaaaggacgtgtttttcacaccccctgagaaatgtgataccctgctctgcgacatcggcgagtcctctccgaatcccacgattgaagaggggagaaccctgcgcgttcttaagatggtggaaccttggctgcggggaaaccaattttgtatcaagattctcaatccctacatgcctagcgtcgtggagacactggagcagatgcagagaaaacacggcggcatgctggttcgcaaccccctctcccggaatagcacccacgaaatgtactgggtgtcttgcgggacaggaaacatcgtctccgctgtgaatatgaccagcagaatgctgcttaaccgcttcacgatggcccatcggaagccgacctatgagagagatgtggacctgggcgcggggacacgccacgtcgccgttgaacctgaggtggctaacctcgatatcattggacagagaatcgaaaatattaaacatgagcacaagtctacctggcattacgacgaggataacccctataaaacatgggcctaccacggctcctatgaagtgaagcccagcgggtctgcttccagcatggtcaatggagtggttaagctgcttaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctgtgggggtttctctccagaaacaagaagccccggatctgtacccgcgaggagttcacaagaaaagtccggagcaatgccgctattggagccgtgtttgttgacgagaaccagtggaactctgctaaggaggccgtggaagatgagcgcttctgggacctggtccagaaagaaagagagctgcacaagcagggcaaatgcgcgacctgcgtgtacaacatgatggggaagcgggaaaagaaactcggagagtttggcaaggcgaaagggagccgcgctatctggtatatgtggctgggcgccagattccttgagtttgaagccctgggattcatgaatgaggatcattggttctcccgggaaaactctctcagcggcgtcgagggggagggactgcacaaacttggctacattctgcgcgacatctccaaaattcctgggggaaatatgtacgctgatgacacagccggctgggataccagaatcacagaagacgatctccaaaacgaggctaagatcaccgacattatggaacccgagcatgccctgctggcgacgtctatctttaaactcacctatcagaataaggtggttcgggtgcagcgccctgccaagaacgggacagtcatggatgtgattagcagacgggaccagcgcggctccggacaagtgggcacctacgggctgaatacattcaccaacatggaagctcagcttatcagacagatggagtctgagggaatttttctgcccagcgaactcgagacgcagaacctggccgaacgggttcttgattggctggagaaatatggcgtggaaagactcaagcgcatggctatctccggggacgactgtgtcgtgaaaccgatcgatgaccggttcgccacagcgctgaccgccctgaatgatatgggaaaggttagaaaagacattcctcaatgggagcccagcaagggctggaacgattggcaacaggtgcctttttgctctcaccacttccatcagctcatcatgaaggacgggcgcgagattgtcgtgccctgtcggaatcaagatgaactggtcggcagagctcgcgtgtcccagggagccggctggagccttcgggagacagcttgcctggggaaatcttacgcccagatgtggcaactcatgtattttcacagacgcgacctgcggcttgctgccaacgcgatctgttccgccgttcctgtggattgggtccccaccagcagaacgacctggtccattcatgctcaccatcagtggatgacaaccgaagacatgctgtctgtgtggaatcgcgtttggatcgaggaaaacccgtggatggagaataagacacacgtgagctcctggggagatgtcccttacctcggcaaacgggaggaccagtggtgcgggagcctgattggactgaccgccagagccacatgggcttctaacatccaggtggccatcaatcaagtgcggagactcattggcaacgaaaattatctggactacatgacctccatgaagcgcttcaaaaacgagggggatcccgaaggcgcgctttggtga

SEQ ID NO: 19003 - RNA, 9879 nt, synthetic construct
  misc_feature 1..9879: note = derived and/or modified CDS sequence (opt5) from DENV-1__FJ882545__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgccggtctgttagcggagatctcatcctggagatcggcaagctgccccagcacctcacacagagagcgcagaatgcccttgacaacctggtgatgctgcataattccgaacaagggggacgggcttatcgccacgccatggaggagctccctgataccattgaaacactgatgcttctggctctcatcgccgtgctgaccggcggcgtcacgctgttctttctctctgggagaggacttggcaagacaagcattgggctgctgtgtgttatggcctccagcgtgctcctgtggatggcttctgtggagccccattggatcgcggcctccattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgccagcgcttggacactctacgccgtggctacgaccatcattacacccatgatgagacacaccatcgaaaacacaaccgccaatatttctctgacggcgatcgccaaccaagctgccatcctgatgggcctcgataaaggctggcctatttccaagatggacatcggggttccccttctggctctgggatgctatagccaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgtacgtctcagattctgctcatgagaacaacctgggctctgtgcgagagcatcacacttgccaccggacctctgaccacactctgggagggctccccgggcaaattctggaatacgaccattgctgtgtctatggccaacatctttcgggggagctacctggccggagctggcctggccttctccctcatgaaaagccttgggggaggccgcagagggacaggagcgcaaggcgaaaccctgggcgagaaatggaagcggcagctgaatcagctctccaagtctgagttcaacacatataaaagaagcgggatcatggaggttgaccgctccgaagccaaggagggactgaaacggggcgagaccacgaagcacgctgtctctagagggacagccaaacttcgctggtttgtggaacggaatctggtgaagcccgagggaaaggtcattgatctcggctgtgggagaggaggctggagctactattgcgctggcctgaaaaaggttaccgaagtgaaagggtacaccaagggaggccctgggcacgaggaacccatccctatggccacatacggatggaacctggtgaaactccattccggcaaggacgtcttctttattccccctgagaaatgtgatacccttctgtgcgacatcggggagtctagcccgaatcccacaattgaagagggacgcacgctgcgggtgctcaagatggttgaaccttggctgagaggcaaccagttctgtatcaagattcttaatccctatatgccttccgtggtcgagaccctggagcaaatgcagcgcaaacacggcgggatgctcgtgcggaaccccctgagcagaaattctacacatgaaatgtactgggtttcctgcggaaccggcaacatcgtgagcgcggtcaatatgacatctcgcatgctgctcaaccggtttaccatggcccacagaaagccgacgtatgagcgcgatgtggacctggggaccggaacaagacacgtggctgtcgaacctgaggttgccaaccttgatatcattggccagcggatcgaaaatattaaacatgagcacaagtccacctggcattacgacgaggataacccctataaaacatgggcttaccacgggagctatgaagtgaagccctctggatccgccagctccatggtgaatggcgtcgtgaagctgctcaccaaaccttgggacgttatccccatggtgacacagattgctatgaccgatacgacacctttcggccaacagcgcgtctttaaggagaaagtggacaccagaaccccgaaggccaaacgggggacagcgcagatcatggaagttacggccagatggctgtggggattccttagccggaacaagaagccccgcatctgtaccagagaggaatttacacggaaagtgcgctctaatgctgccattggcgctgtcttcgtggacgagaaccaatggaatagcgccaaggaggccgttgaagatgagagattttgggacctggtgcatcgggaacgcgagctccacaaacaggggaagtgcgcgacctgcgtctacaacatgatgggaaaaagagaaaagaagctgggcgagttcgggaaagctaagggctcccgggccatctggtacatgtggctgggagcccgctttctcgagttcgaagctctgggcttcatgaatgaggatcactggttttctagagaaaacagcctttccggggtggagggagagggcctgcataaactcgggtatattctgcgggacatctctaagattcctggaggcaatatgtacgccgatgacacagctgggtgggatacccgcatcacagaagacgatcttcagaacgaggccaaaatcaccgacattatggaacccgagcacgcgctgctcgccaaggctatcttcaaactgacgtatcagaataaggtcgtgagagttcaacggcctgccaagaacggcaccgtgatggatgtcattagccgcagagaccagcggggatccggccaggtggggacatacggactgaatacctttacaaacatggaagctcagctcatcagacaaatggagtctgagggcattttcagcccctccgaactggagaccccgaaccttgccgaacgcgcgctggattggctcgggaaatatggagtggagcggctgaagagaatggccatcagcggcgacgactgtgttgtgaaacctatcgatgaccgctttgctacggcccttacagctctgaatgatatggggaaggtccggaaagacattccccagtgggaaccttctaagggctggaacgattggcaacaggtgcccttctgctcccatcactttcaccaactcatcatgaaggacggaagagagattgttgtgccttgtcgcaatcaggatgagctggtcggccgggccagagtgagccagggggctggatggtctctgcgcgaaaccgcctgcctcggcaaatcctacgcgcagatgtggcaactgatgtatttccatcggagagaccttcgcctggccgctaacgccatctgtagcgccgtccccgtggattgggttccgacatcccggaccacgtggtctattcacgctcatcaccagtggatgaccacagaggacatgctcagcgtgtggaatagagtctggatcgaagagaacccttggatggaagataagacccatatttccagctgggaggacgtgccctacctggggaaacgggaggaccagtggtgcggatctcttatcggcctgacagccagagcgacctgggctacaaatatccaagttgccattaaccaggtgcgccggctcatcgggaatgaaaactacctggattatatgacctccatgaagagatttaaaaatgagagcgaccccgaaggcgccctgtggtga

SEQ ID NO: 19004 - RNA, 9879 nt, synthetic construct
  misc_feature 1..9879: note = derived and/or modified CDS sequence (opt5) from DENV-1__FJ898372__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctcgcgataagcccacactggacatcgaactgctcaaaaccgaggtcacaaaccctgccgttctgagaaagctttgcattgaagcgaaaatctccaataccacgacagatagccggtgtccgacccaaggagaggccaccctggtggaagagcaggacgctaacttcgtgtgccgcagaacatttgtcgatcggggctggggcaatgggtgtggactcttcggcaaggggtctctgattacctgcgccaaatttaagtgcgtgacaaagcttgagggaaaaatcgttcagtacgaaaacctgaagtattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccgcaccggcctcgacttcaacgaaatggtgctgcttacgatgaaagagaagtcctggctggtccataaacagtggtttctcgatctgcctcttccctggacaagcggggcttccacctctcaagagacatggaatagacaggacctgctcgtgaccttcaagaccgcgcacgccaaaaagcaggaagtcgtggttctgggaagccaagagggcgctatgcacacagccctgacgggggccaccgaaattcagacatccggaaccacaaccatctttgctggccatctcaagtgccggctgaaaatggataagcttacgctgaaagggatgagctatgtgatgtgtacaggctctttcaagctcgagaaagaagtcgccgagacccagcacggaaccgtgctggttcagattaagtacgagggcacagacgcgccgtgcaagatccctttctccacccaagatgaaaaaggggtgacacagaacggaagactgatcacggctaatcccattgtcaccgacaaggagaaacctgtgaacatcgaagccgagcccccctttggcgagagctatattgtgatcggggccggagaaaaggctcttaaactctcttggttcaagaagggcagctccattgggaaaatgtttgaggccacagctcgcggcgcccggagaatggcgatcctgggagataccgcctgggacttcggctctatcgggggagtttttacaagcgtcggcaagctggtgcatcagattttcgggaccgcttacggagtgctcttttccggcgtcagctggacgatgaaaatcgggattggcgtgctgcttacctggctgggactcaattctcgctccacaagcctgtctatgacctgtatcgccgttggcctggtgacactttacctcggggtcatggtgcaggctgattccggatgcgttattaactggaagggccgggaactgaaatgtgggagcggaatcttcgtgaccaatgaggtccacacatggaccgaacaatataagtttcaggccgactcccctaagagactgtctgcggccattggcaaagcttgggaggagggggtgtgcggcatccgcagcgccacgcggctcgaaaacatcatgtggaagcagatttccaacgagctgaatcatatccttctggaaaacgacatgaaactcacagttgtggtcggagatgtggctggcattctggggcagggaaagaaaatgatcagaccgcaacccatggagtacaagtattcttggaaaagctggggcaaggccaagattatcggggccgacgctcagaataccaccttcatcattgatggacctaacacacccgaatgtcctgacgatcagcgcgcgtggaatatctgggaggtggaggactacggctttggcattttcaccacgaacatctggctgaaacttcgggattcctatacacaggtctgcgaccacagactcatgagcgccgctattaaggattctaaagccgttcacgccgacatggggtactggatcgaatccgagaagaatgaaacctggaaactggctcgcgccagctttatcgaggtgaagacatgtatttggcccaagtctcataccctgtggtccaacggagtgctcgaaagcgagatgatcattccgaaaatctatggcgggcctatttctcaacacaattaccggcccggatacttcacacagaccgcgggcccttggcatctggggaagcttgagctggatttcgacctctgcgaaggaacgaccgtcgtggttgatgagcactgcggcaacagaggccccagcctgcggacaaccacagtgaccgggaaaatcatccacgaatggtgttgccgctcctgtacgctgcctccccttagatttcggggagaggacggctgctggtatgggatggagattagaccggtcaaggaaaaagaggaaaatctcgtgaagagcatggtttctgctggatccggcgaggtggacagcttctccctggggctgctctgtatctctattatgatcgaagaggtcatgcgcagccggtggtccagaaagatgctgatgacaggaacccttgccgtgtttttcctgctcattatgggccagctgacatggaacgatctgatccgcctttgcattatggttggcgccaatgcttctgacagaatggggatgggaaccacctacctggccctcatggcgacatttaaaatgcggcctatgttcgctgtgggcctgctctttcgcagactgacgagccgggaggtccttctgctcaccatcgggctgtccctggtggcctctgtggaacttcccaacagcctggaggaactcggagatggcctggccatggggatcatgattctcaagctgcttacagacttccaatcccatcagctgtgggctaccctcctgagcctgacatttatcaaaaccacgttctctcttcactatgcctggaagacaatggctatggtcctgtccattgttagcctctttcccctgtgtctctctaccacctcccagaaaacaacctggctgcctgtgcttctgggaagcctgggctgcaagccgctcacaatgttcctgatcgccgagaataagatttggggccgcaaatcttggccccttaacgaagggatcatggcggtgggaatcgtctccattctgctcagctccctgctcaagaacgatgtgcctctggccggcccccttatcgctgggggaatgctgattgcctgttacgttatcagcggctctagcgctgacctgtccctcgagaaagccgccgaggtgtcttgggaagaggaagctgagcatagcggggcgtcccacaatattctggtcgaagtgcaggatgacggaacgatgaagatcaaagatgaggagagagacgatacccttacaatcctgctcaaggccaccctgctcgctgtttctggcgtgtatcctctgagcattcccgccacactttttgtctggtacttctggcaaaaaaagaagcagcggtccggcgtgctgtgggacaccccttctcccccggaagtcgagcgcgccgtgctggatgacgggatctatagaattatgcagcggggactcctgggccgcagccaggttggggtgggagtcttccaagaaaacgtgtttcatacgatgtggcacgttaccagaggcgctgtgcttatgtaccaggggaaacggctggagccttcctgggccagcgtcaagaaagacctcatctcttacggaggcggctggagactgcgcgggtcctggaatacaggagaggaagtgcaggtgattgcggttgagcccggcaagaaccctaaaaatgtccagaccgctcccgggacattcaagaccccggaaggagaggtgggcgccatcgccctcgattttaagcctgggacaagcggatctcccattgtgaaccgggaaggcaaaatcgtcggcctgtatgggaatggagtggttacgacctccggcacatacgtgagcgctatcgcccaagcgaaggcttcccaggaggggcctcttcccgagattgaagacgaggtcttcagaaaacgcaacctgaccatcatggatctgcaccccggatctggcaagacccggagatatctccctgccattgtgcgcgaagccatcaaacggaagctgagaacacttattctggctccgacgcgcgttgtggccagcgagatggctgaagccctcaaggggatgcccatccggtaccagaccacagcggtcaaatccgagcataccggcaaggagatcgtggacctgatgtgccacgccacatttaccatgagactgctcagccctgttcgggtgcccaattataacatgattatcatggatgaagctcatttcacggacccttcttccattgccgctcgcggatacatcagcacaagagtcggcatgggggaggccgccgctatttttatgaccgcgaccccccctggatctgtggaagccttcccgcaaagcaatgctgtgatccaggatgaggaacgggacatccccgagcgctcctggaactctggctatgagtggattacagattttcctgggaaaaccgtctggttcgttcccagcatcaagtccggaaatgacattgccaactgtcttagaaaaaatggcaagcgggtgatccagctgtctagaaagacatttgataccgaataccagaaaacgaagaacaacgactgggactacgtggtcacaaccgatattagcgagatgggggccaatttccgcgctgaccgggtgatcgatcctagacgctgcctgaaacccgttattctcaaggacggcccggaacgggtgatcctggccggacctatgcccgtcacagtggcgtccgctgcccaaagacgcggccggatcgggagaaaccacaataaagagggagatcagtatatttacatgggccagccccttaacaatgacgaggatcatgcccactggaccgaagctaagatgctgctcgacaacatcaatacgcctgaggggattatccccgccctgttcgaacctgagcgcgaaaagagcgcggccgttgatggagagtatagactgcggggcgaggctcgcaaaacctttgtggaactcatgagacggggggaccttccggtctggctgtcttacaaggtggcctccgagggcttccagtatagcgatcgcagatggtgctttgacggagaacggaacaatcaagtcctggaggaaaacatggatgtggagatttggacaaaagagggcgaaagaaagaaactccgcccccggtggctggacgctagaacctactccgaccctcttgccctgcgcgagttcaaggaatttgctgccgggcggagatctgttagcggagatctcatcctggagatcggcaaactgccccagcacctcacacagcgggcgcagaatgcccttgacaacctggtgatgctgcataattccgaacaagggggacgcgcttatagacacgccatggaggagctccctgataccattgaaacactgatgcttctggctctcatcgccgtgctgaccggcggcgtcacgctgttctttctctctgggcggggacttggcaagacaagcattgggctgctgtgtgttatggcctccagcgtgctcctgtggatggcttctgtggagccccattggatcgcggcctccattatccttgaattctttctgatggtcctcctgatcccggagcctgaccgccagagaaccccccaggataaccagctggcttacgtggttattggactccttttcatgatcctgaccgtggccgccaatgagatgggcctgctcgaaacaaccaagaaagacctggggattggacacgtcgctgtggagaaccaccatcacgccgcgatgcttgatgtcgacctgcatcctgccagcgcttggacactctacgccgtggctacgaccatcattacacccatgatgcggcacaccatcgaaaacacaaccgccaatatttctctgacggcgatcgccaaccaagctgccatcctgatgggcctcgataagggctggcctatttccaaaatggacatcggggttccccttctggctctgggatgctatagccaggtgaatccgctcaccctgacagccgctgtccttatgctggtggcccattacgcgattatcggccctgggctccaggccaaggctacccgcgaggcccaaaaaagaacagctgccggaattatgaagaaccccaccgttgatggcatcgtggccatcgacctggatcccgtcgtgtatgacgcgaagtttgaaaaacagctggggcagattatgctccttatcctgtgtacgtctcagattctgctcatgcggacaacctgggctctgtgcgagagcatcacacttgccaccggacctctgaccacactctgggagggctccccgggcaagttctggaatacgaccattgctgtgtctatggccaacatctttcgcgggagctacctggccggagctggcctggccttctccctcatgaaaagccttgggggaggcagacgggggacaggagcgcaaggcgaaaccctgggcgagaagtggaaaagacagctgaatcagctctccaagtctgaattcaacacatataagcgcagcgggatcatggaggttgaccggtccgaagccaaagagggactgaagagaggcgagaccacgaaacacgctgtctctcgcgggacagccaagcttcggtggtttgtggaaagaaatctggtgaaacccgagggaaaggtcattgatctcggctgtgggcgcggaggctggagctactattgcgctggcctgaagaaagttaccgaagtgaaggggtacaccaaaggaggccctgggcacgaggaacccatccctatggccacatacggatggaacctggtgaagctccattccggcaaagacgtcttctttattccccctgagaagtgtgatacccttctgtgcgacatcggggagtctagcccgaatcccacaattgaagagggacggacgctgagagtgctcaaaatggttgaaccttggctgcgcggcaaccagttctgtatcaagattcttaatccctatatgccttccgtggtcgagaccctggagcaaatgcagcggaagcacggcgggatgctcgtgagaaaccccctgagccgcaattctacacatgaaatgtactgggtttcctgcggaaccggcaacatcgtgagcgcggtcaatatgacatctcggatgctgctcaacagatttaccatggcccaccgcaaaccgacgtatgagagagatgtggacctggggaccggaacacggcacgtggctgtcgaacctgaggttgccaaccttgatatcattggccagcgcatcgaaaatattaagcatgagcacaaatccacctggcattacgacgaggataacccctataagacatgggcttaccacgggagctatgaagtgaaaccctctggatccgccagctccatggtgaatggcgtcgtgaagctgctcaccaagccttgggacgttatccccatggtgacacagattgctatgaccgatacgacacctttcggccaacagagagtctttaaagagaaggtggacacccggaccccgaaagccaagagagggacagcgcagatcatggaagttacggcccggtggctgtggggattccttagccgcaacaaaaagcccagaatctgtacccgggaggaatttacacgcaaggtgagatctaatgctgccattggcgctgtcttcgtggacgagaaccaatggaatagcgccaaagaggccgttgaagatgagcggttttgggacctggtgcatcgcgaaagagagctccacaagcaggggaaatgcgcgacctgcgtctacaacatgatgggaaagcgggaaaaaaagctgggcgagttcgggaaggctaaaggctcccgcgccatctggtacatgtggctgggagccagatttctcgagttcgaagctctgggcttcatgaatgaggatcactggttttctcgggaaaacagcctttccggggtggagggagagggcctgcataagctcgggtatattctgcgcgacatctctaaaattcctggaggcaatatgtacgccgatgacacagctgggtgggataccagaatcacagaagacgatcttcagaacgaggccaagatcaccgacattatggaacccgagcacgcgctgctcgccaaagctatcttcaagctgacgtatcagaataaagtcgtgcgggttcaacgccctgccaagaacggcaccgtgatggatgtcattagcagacgggaccagagaggatccggccaggtggggacatacggactgaatacctttacaaacatggaagctcagctcatccgccaaatggagtctgagggcattttcagcccctccgaactggagaccccgaaccttgccgaacgggcgctggattggctcgagaagtatggggtggaaagactgaaacgcatggccatcagcggagacgactgtgttgtgaagcctatcgatgaccggtttgctacggcccttacagctctgaatgatatgggcaaagtcagaaaggacattccccagtgggagccttctaaagggtggaacgattggcagcaggtgcccttctgctcccatcactttcaccaactcatcatgaaggacggccgcgagattgttgtgccttgtcggaatcaggatgaactggtcggaagagcccgcgtgagccagggcgctgggtggtctctgcgggagaccgcctgcctcggaaagtcctacgcgcagatgtggcaactgatgtatttccatagacgcgaccttcggctggccgctaacgccatctgtagcgccgtccccgtggattgggttccgacatccagaaccacgtggtctattcacgctcatcaccagtggatgaccacagaagacatgctcagcgtgtggaatcgggtctggatcgaggaaaacccttggatggaggataaaacccatatttccagctgggaggacgtgccctacctgggcaagagagaagaccagtggtgcgggtctcttatcggactgacagcccgcgcgacctgggctacaaatatccaagttgccattaaccaggtgcggagactcatcggcaatgagaactacctggattatatgacctccatgaaacgctttaagaatgaaagcgaccccgagggggccctgtggtga

SEQ ID NO: 19005 - RNA, 9879 nt, synthetic construct
  misc_feature 1..9879: note = derived and/or modified CDS sequence (opt5) from DENV-1__FJ898373__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaagtctctcctgtttaagaccagcgccggcgttaatatgtgcacccttatcgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccattgccacaatcacaccccaggctcctacgtctgagattcagctcaccgactacggcgccctgacactggattgttcccccagaaccggcctcgacttcaacgaaatggtcctgcttacaatgaaagaaaagagctggctggtgcataaacagtggtttctcgatctgcctcttccctggacctccggggcctctacgagccaagagacatggaatcggcaggacctgctcgtcaccttcaagacagctcacgcgaagaaacaggaagtggttgtgctgggatcccaagagggcgccatgcacaccgctctgaccggggccacagaaatccagacgaccggaacaaccacaatttttgccggccatctcaagtgccgcctgaaaatggataaacttaccctgaaagggatgagctatgtcatgtgtacgggctctttcaagctcgagaaggaagtggctgagacacagcacggaaccgttctggtgcagatcaaatacgagggcaccgacgccccgtgcaagatccctttctccacacaagatgaaaaaggggtcacccagaacggaagactgattacagcgaatcccatcgtgacggacaaggagaaacctgtgaacattgaagctgagccgccctttggcgagagctatatcgttattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtctttaccagcgtgggcaagctggtgcatcagatcttcgggacagcctacggagtcctcttttccggcgtgagctggaccatgaaaattgggatcggcgttctgcttacgtggctgggactcaattctcggtccaccagcctgtctatgacatgtattgctgtgggcctgatcaccctttacctcggggtcatggtgcaggccgattccggatgcgttattaactggaagggcagagaactgaagtgtgggagcggaatcttcgtgacaaatgaggtccacacctggacagaacaatataaatttcaggctgactcccctaagcgcctgtctgccgcggtgggcaaagcctgggaggagggggtttgcggcatccggagcgctaccagactcgaaaacattatgtggcgccagatctccaacgagctgaatcatattcttctggaaaacgacatgaagttcacggtggtcgtgggagatgtggtcggcatcctcgcccaggggaaaaagatggttcggccgcaacccatggagcacaaatactcttggaaaagctggggaaaggctaagattatcggcgccgacgtgcagaatacaacctttatcattgatgggcctaacacccccgaatgtcctgacgatcagagagcctggaatatctgggaggtggaggactatggattcggcatttttacaaccaacatctggctgaagctgcgcgattcctacacgcaggtctgcgaccaccggcttatgagcgctgcgattaaagattctaaggccgtgcatgctgacatgggctattggatcgaatccgagaaaaatgaaacatggaagctcgccagagccagcttcatcgaggttaagacctgtatttggcccaaatctcacacactgtggtccaacggggtgctggaaagcgagatgatcattccgaagatctacggaggccctatttctcaacataattatcgccccgggtacttcacccagacagctggaccttggcacctcggcaaactggagcttgattttgacctgtgcgaagggaccacggtcgtggttgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggtcaaggaaaaggaggaaaatcttgtgaaaagcatggtttctgccgggtccggagaggtggacagcttttccctcggcctgctgtgtatctctattatgatcgaagaggtcatgcggagcagatggtcccgcaagatgctcatgacggggacactggcggtgttctttcttctgattatgggacagctcacctggaacgatctgatccggtcttgcattatggtgggcgctaatgccagcgacagaatgggcatggggacaacctatctggcccttatggctaccttcaaaatgcgccctatgtttgccgtcggactcctgttcagacggctgacatcccgcgaggttctcctgcttacgatcggcctgtctctcgtggcgagcgtggaactgcccaactccctggaggaacttggggatggactggctatgggcatcatgattctcaagctgctcaccgactttcaaagctaccagctgtgggccacacttctgtctctcaccttcatcaaaacaaccttttccctgcactatgcctggaagacgatggctatggtcctgagcattgtgtctcttctgcccctctgtctgtccacaaccagccagaagaccacatggctccctgttctgcttgggtctctgggatgcaaaccgctgaccatgttcctcatcgccgagaataagatttggggcagaaaatcctggcccctgaacgaaggcatcatggctgtggggatcgtcagcattcttctgtccagcctcctgaagaacgatgtgcctctcgccggacccctgatcgcgggcgggatgcttattgcctgttacgttatctctggaagctccgctgacctgtctctggagaaagccgctgaggtgagctgggaagaggaagccgagcattccggcgcctctcacaatattctcgtcgaagtgcaggatgacgggacaatgaagatcaaagatgaggagcgggacgatacgctgaccatccttctgaaggctacactcctggcggtcagcggagtgtatcctctctccattcccgccaccctgtttgtttggtacttctggcaaaagaaaaagcagcgctctggcgtgctttgggacacacctagccctcccgaagtcgagagagctgtgctggatgacggcatctatcggattatgcagcgcgggctgctcggaagatcccaggttggcgtgggggtcttccaagaaaacgtgtttcataccatgtggcacgtgacgcggggagccgttctgatgtaccagggcaaacgccttgagcccagctgggcctctgtcaagaaagacctgatctcctacgggggaggctggagactccagggcagctggaataccggggaggaagtccaggtgattgctgtcgagcccggaaagaaccctaagaatgtgcaaacagcccccggcaccttcaaaacaccggaaggggaggttggagcgatcgctctggattttaagcctggcacctctgggtcccccattgtgaaccgggaaggaaaaatcgtcggcctctatggcaatggggtggttacaacgagcggaacctacgtgtccgccatcgcccaggctaaggcctctcaggagggccctctgcccgagattgaagacgaggtcttcagaaaacgcaaccttacaatcatggatctgcaccccgggagcggaaagacccggagatatctgcctgcgattgtgcgcgaagctatcaagcggaaactcagaaccctgattcttgccccgacacgcgttgtggcctccgagatggctgaagccctgaagggcatgcccatccggtaccaaacgaccgctgtcaaaagcgagcatacagggagagagatcgtggacctcatgtgccacgccacctttacaatgcgcctgctgtctcctgtgcgggtccccaattataacatgattatcatggatgaagcgcatttcaccgacccttccagcattgccgctagaggctacatctctacgcgggttggaatgggcgaggccgctgccatttttatgacagccacaccccctgggagcgtggaggctttcccgcagtccaatgcggtgatccaggatgaggaacgcgacatccccgagagatcttggaacagcggatatgagtggattaccgattttcctggcaagacagtctggttcgtgccctccatcaaatctgggaatgacattgccaactgtctccggaagaatggaaagcgcgttatccagcttagcagaaaaacctttgatacagaataccaaaagaccaaaaacaacgactgggactacgtggtcacgacagatatttccgagatgggcgctaatttccgggccgacagagtgatcgatcctcgccggtgcctgaagcccgttattctgaaagacgggccggaaagagtgatcctcgccggccctatgcccgtcaccgtggctagcgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatctgctgccattgatggggagtatagactgcgcggagaggcgagaaagacgtttgtcgaactgatgcggcgcggcgacctcccggtgtggctttcctacaaagttgccagcgaggggttccaatattccgatagacggtggtgctttgacggcgaacgcaacaatcaggtgctggaggaaaacatggatgtggagatctggaccaaggagggagaacgcaagaagctgcggcccagatggctcgacgctcgcacatactctgaccctctggcccttcgggagttcaaagaatttgctgccggcagacgcagcgtctccggggatctgatcctcgagattggaaagctgccccagcacctgacccagcgggctcaaaatgccctcgacaaccttgttatgctgcataattctgaacagggcgggagagcgtatcggcacgccatggaggagctgcctgatacaatcgaaaccctcatgctgcttgctctgattgccgtgctcacaggaggcgtgaccctgttctttctgagcggccgcgggctcggaaagacgtccatcggccttctgtgtgtcatggctagctctgccctgctctggatggcctccgtggagccccattggattgctgcgagcatcatcctggagttctttcttatggttctgctcattccggagcctgacagacagcggacaccccaggataaccaactggcctacgtggtcatcgggctcctgttcatgattcttaccgtggctgccaatgagatgggactgctggaaaccaccaagaaggacctcggcatcgggcacgtcgccgtggagaaccaccatcacgctaccatgctggatgttgaccttcatcctgcctctgcgtggacactgtacgccgtggctacgaccattatcacacccatgatgcgccacaccattgaaaacacaaccgccaatatctccctcacggctatcgccaaccaggcggccattctgatgggactggataaaggctggcctatcagcaagatggacattggcgtccccctccttgctctggggtgctattctcaggtgaatccgctgaccctcacagccgctgttctgatgcttgtggcccattacgctatcattggacctggcctgcaagccaaagcgaccagagaggcccagaagcggacagctgccgggatcatgaagaaccccaccgtcgatggaatcgtggctattgacctcgatcccgtggtttatgacgccaaatttgaaaagcagctgggccagatcatgctgctcattctttgtacgagccaaatcctgctgatgcgcacaacctgggccctctgcgagtccattacactggcgaccgggcctcttaccacactgtgggagggatctccgggcaaattctggaatacgaccatcgctgtcagcatggccaacatctttagaggctcctacctcgctggggccggactggccttcagcctgatgaagtccctcggcgggggacggcgcggcacaggggctcagggagaaacccttggcgagaaatggaagagacagctgaatcagctgtctaagagcgagttcaacacatataaacggtccggcattatggaggtggacagatctgaagccaaggaggggctccgccggggagagaccacgaaacacgcggtgagcagaggcacagccaagctgcgctggtttgtcgaacggaatcttgttaaacccgaggggaaggtgatcgatctgggatgtggcagagggggatggtcctactattgcgctggcctcaagaaagtgaccgaagtcaagggctacaccaaagggggacctggccacgaggaacccattcctatggccacatacgggtggaacctggtgaagctgcattctggaaaagacgttttctttattccccctgagaagtgtgataccctcctttgcgacattggcgagagctccccgaatcccacaatcgaagaggggcgcacgctgcgggtgctgaaaatggtcgaaccttggctcagaggaaaccaattctgtattaagatcctgaatccctatatgcctagcgtggttgagacccttgagcacatgcagcgcaagcatggcggcatgctggtgcggaaccccctctctagaaattccacacacgaaatgtactgggtcagctgcgggaccggaaacatcgtgtctgctgtgaatatgacatcccgcatgctgctgaaccggtttaccatggcccacagaaaaccgacgtatgagcgcgatgtcgacctcggcgcggggaccagacatgttgccgtggaacctgaggtggctaacctggatattatcggacagcggattgaaaatatcaagcacgagcataaaagcacatggcactacgacgaggataacccctataagacctgggcctaccatggctcttatgaagtcaaaccctccgggagcgcttccagcatggtgaatggagttgtgaaacttctgacaaagccttgggacgtcattcccatggtgacccagatcgccatgacagataccacgcctttcggccaacagcgcgtttttaaagagaaggtggacacaagaaccccgaaagctaagcggggcaccgcccagatcatggaagtcacagcgagatggctctgggggttcctgtctcggaacaaaaagccccgcatttgtacgagagaggaatttacccggaaggtgcgcagcaatgccgctatcggagccgttttcgtggacgagaaccaatggaactccgctaaagaggccgtcgaagatgagagattttgggaccttgtgcaccgggaacgcgagctgcacaagcagggcaaatgcgccacatgcgtctacaacatgatggggaagagagagaagaagctcggagagttcggcaaggcgaaagggtctcgggctatttggtacatgtggctgggcgcccgctttctggagttcgaagccctcggattcatgaatgaggatcattggtttagcagagaaaactccctgtctggcgtggagggggagggacttcacaagctgggctatatcctccgggacattagcaaaatccctgggggaaatatgtacgctgatgacaccgccggctgggatacacgcatcaccgaagacgatctgcagaacgaggctaagattacagacatcatggaacccgagcatgcccttctggcgacctccattttcaaactcacgtatcagaataaggttgtgagagtccaacggcctgccaaaaacgggaccgtgatggatgtgatctctcgcagagaccagcggggcagcggacaggttggcacatacgggctgaatacctttacaaacatggaagctcagctgattagacaaatggagtccgagggaatcttcagcccctctgaactcgagaccccgaacctggccgaacgcgtgcttgattggctggagaagtatggcgtcgaacggctcaagagaatggctatctccggggacgactgtgtggttaaacctattgatgaccgctttgccacggcgctgacagcccttaatgatatgggaaaggtgcggaaagacatcccccagtgggagcctagcaagggctggaacgattggcagcaggtccccttctgctctcaccactttcatcaactgattatgaaagacgggagagagatcgtggtcccttgtcgcaatcaggatgaactcgtgggccgggctagagtttcccagggagccggctggagcctgcgcgagaccgcttgcctggggaagtcctacgcccagatgtggcaactcatgtatttccaccggagagacctgcgccttgctgccaacgcgatttgttctgccgtgcccgtcgattgggtgccgacaagccggaccacgtggtccatccatgctcaccatcagtggatgaccacagaagacatgctgagcgtttggaatagagtgtggattgaggaaaacccttggatggaggataagacccacatctcttcctggggagacgtcccctacctcggcaaacgggaggaccagtggtgcgggagcctgatcggacttacagccagagccacctgggctacaaatattcaagtggccatcaaccaggtgcgccggctgattggcaatgaaaactacctcgattatatgacctctatgaagagatttaaaaatgagagcgaccccgaaggggcgctgtggtga

SEQ ID NO: 19006 - RNA, 9879 nt, synthetic construct
  misc_feature 1..9879: note = derived and/or modified CDS sequence (opt5) from DENV-1__FJ898374__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacccttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgttacccgcctcgaaaacattatgtggaaacagatctccaacgagctgaatcatattcttctggaaaacgacatgaagttcacggtggtcgtgggagatgtggtcggcatcctcgctcaggggaaaaagatgattcggccgcaacccatggagcacaaatactcttggaaaagctggggaaaggccaagatcatcggcgctgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacgcaggcctgcgaccaccggcttatgagcgctgcgatcaaagattctaaggccgtgcatgctgacatgggctattggatcgaatccgagaaaaatgaaacatggaagctcgccagagccagcttcattgaggtcaagacctgtatctggcccaaatctcacacactgtggtccaacggggtgctggaaagcgagatggttattccgaagatctacggaggccctatttctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcatccatgaatggtgttgccggtcctgtaccctgcctcccctgcgcttcaaaggggaggacggatgctggtacggcatggagattagaccggtgaaggaaaaggaggaaaatcttgtcaaaagcatggtgtctgccgggtccggagaggttgacagcttttccctcggcctgctgtgtatctctattatgatcgaagaggtgatgcggagcagatggtcccgcaagatgctcatgacggggacactggcggtcttccttctgctcattatgggacagctgacctggaacgatctgatccggctttgcattatggtgggcgctaatgcctctgacagaatgggcatggggacaacctatctggccctcatggctacctttaaaatgcgccctatgttcgccgtgggactgctctttagacggctgacaagccgcgaggtccttctgctcacgatcggcctgtccctggttgcgtctgtggaacttcccaacagcctggaggaactcggggatggactggctatgggcatcatgattctcaagctgcttaccgacttccaatcccaccagctgtgggccacactcctgagcctgacctttatcaaaacaaccctttctctgcattacgcctggaagacgatggctatggtgctctccattgtcagcctgttccccctctgtctgtctacaacctcccagaagaccacatggcttcctgtgctgctggggagcctcggatgcaaaccgctgaccatgtttcttatcgccgagaataagatttggggcagaaaatcttggcccctgaacgaaggcatcatggctgttggggtggtctccatcctcctgagctccctcctgaagaacgatgtgcctcttgccggacccctgattgcgggcgggatgctgatcgcctgttatgttattagcggatctagcgctgacctctccctggagaaagccgctgaggtgtcttgggaagaggaagccgagcacagcggcgcctcccataatatccttgtcgaagtgcaggatgacgggacaatgaagattaaagatgaggagcgggacgatacgctgaccatcctcctgaaggctacactcctggcggtctctggagtgtaccctcttagcatccccgccaccctgttcgtttggtatttttggcaaaagaaaaagcagcgctccggcgtgctgtgggacacaccttctcccccggaagtcgagagagctgtgctcgatgacggcatttaccggatcatgcagcgcgggctgcttggaagaagccaggttggcgtgggggtcttccaagaaaacgtgttccacaccatgtggcacgtgacgcggggagccgttctgatgtatcagggcaaacgcctcgagccttcctgggccagcgtcaagaaagacctgatttcttacgggggaggctggagactccagggctcctggaataccggggaggaagtccaggtgatcgctgtcgagcccggaaagaaccctaagaatgtgcaaacagcccccggcacctttaaaacaccggaaggggaggttggagcgattgctctggatttcaagcctggcaccagcgggtctcccatcgtgaaccgggaaggaaaaattgtcggcctttacggcaatggggtggttacaacgtccggaacctatgtgagcgccatcgcccaggctaaggcctcccaggagggccctctgcccgagatcgaagacgaggtctttagaaaacgcaacctgacaattatggatctccatcccgggtctggaaagacccggagatacctgcctgcgatcgtgcgcgaagctattaagcggaaacttagaaccctgatcctcgccccgacacgcgttgtggccagcgagatggctgaagccctgaagggcatgcccattcggtatcaaacgaccgctgtcaaatccgagcacacagggaaggagatcgtggacctgatgtgccatgccaccttcacaatgagactccttagccctgtgcgcgtccccaattacaacatgatcattatggatgaagcgcactttaccgacccttcttccatcgccgctcggggctatattagcacgagagttggaatgggcgaggccgctgccatcttcatgacagccacaccccctgggtctgtggaggcttttccgcagagcaatgcggtgattcaggatgaggaacgggacatccccgagcgctcctggaactctggatacgagtggatcaccgatttccctggcaaaacagtctggtttgtgcccagcattaagtccgggaatgacatcgccaactgtctgagaaagaatggaaaacgggttattcagctgtctcgcaagaccttcgatacagaatatcagaagaccaagaacaacgactgggactacgtggtcacgacagatatcagcgagatgggcgctaattttagagccgaccgggtgattgatcctagacgctgcctcaaacccgttatcctgaaggacgggccggaacgggtgattcttgccggccctatgcccgtcaccgtggcttccgccgcgcagagacgcggacggatcggcagaaaccataataaggagggggatcagtacatctatatgggacagcccctgaacaatgacgaggatcacgctcactggacagaagccaaaatgctcctggacaacattaatacccctgagggcatcattcccgccctgttcgaacctgagcgcgaaaagagcgctgccatcgatggggagtaccggctcagaggagaggcgcgcaaaacgttcgtcgaacttatgagacggggcgacctgccggtgtggctgtcttataaggttgcctccgaggggtttcaatacagcgatcgcagatggtgcttcgacggcgaacggaacaatcaggtgctcgaggaaaacatggatgtggagatttggaccaaagagggagaacgcaagaaactgagaccccggtggcttgacgctagaacatattccgaccctctggccctccgcgagtttaaggagttcgctgccggccggagatctgtcagcggggatctgatcctggagatcggaaagctcccccagcatcttacccagcgcgctcaaaatgccctggacaacctggttatgctccacaattccgaacagggcgggcgggcgtacagacatgccatggaggagctgcctgatacaattgaaacccttatgctgctcgctctgatcgccgtgctgacaggaggcgtgaccctctttttcctttctggccgggggctgggaaaaacgagcattggcctgctctgtgtcatggcttccagcgtgctgctttggatggcctctgttgagccccactggatcgccgcttccattatcctggaatttttcctcatggtgctgctgatcccggagcctgaccgccagagaacaccccaggataaccaactcgcgtatgtcgtgattgggcttctgtttatgatcctgaccgtcgccgctaatgagatgggactcctggaaaccacaaagaaagaccttggcattgggcacgtggccgttgagaaccatcaccatgccaccatgctggatgtggacctccaccctgctagcgcctggacactgtacgcggtcgccacgaccatcattacacccatgatgcggcataccatcgaaaacacaaccgctaatatttctctgacggccatcgctaaccaggccgcgatcctcatgggacttgataagggctggcctatttccaaaatggacatcggcgtgcccctgctggccctcgggtgctacagccaggttaatccgctgacccttacagctgccgtgctgatgctcgtcgctcactatgccattatcggacctggcctgcaagctaaggccacccgcgaggcgcagaagagaacagccgctgggattatgaaaaaccccaccgtggatggaatcgtggccatcgacctggatcccgttgtctacgacgctaagttcgaaaaacagctcggccagattatgcttctgatcctgtgtacgtctcaaattctcctgatgcggacaacctgggccctttgcgagagcatcacactggccaccgggcctctcaccacactgtgggagggatccccgggcaagttttggaatacgaccattgcggtgtctatggctaacatcttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcattatggaggtggaccggtccgaagctaaagaggggcttaagagaggagagacaacccgccacgccgtctctcggggcacggcgaaactgagatggttcgttgaacgcaatctcgtgaagcccgaggggaaggtgatcgatctgggatgtggcagagggggatggagctattactgcgccggcctgaaaaaggtcacagaagtgaaaggctataccaaagggggacctggccatgaggaacccattcctatggctacctacgggtggaacctcgttaaacttcactccggaaaggacgtgtttttcacaccccctgagaaatgtgataccctgctgtgcgacatcggcgagtctagcccgaatcccacaattgaagaggggagaacgctccgcgtcctgaagatggtggaaccttggcttcggggaaaccaattttgtatcaagattctgaatccctacatgccttccgttgtggagaccctcgagcagatgcagagaaaacatggcggcatgctggtccgcaaccccctgagcagaaattctacacacgaaatgtattgggtgtcctgcgggaccggaaacatcgtgagcgccgtcaatatgacatctagaatgctcctgaaccgcttcaccatggctcaccggaagccgacgtacgagagagatgttgaccttggcgccgggacccgccatgtggcggtggaacctgaggtcgccaacctggatatcattggacagagaatcgaaaatattaaacacgagcataagtccacatggcactatgacgaggataacccctacaaaacctgggcttatcatggcagctacgaagtgaagccctctgggtccgccagctccatggttaatggagtggtcaagctcctgacaaaaccttgggacgtgatccccatggttacccaaattgctatgacagataccacgccttttggccagcagcgggtgttcaaggagaaagtcgacacacgcaccccgaaggccaaaagaggcaccgctcaaatcatggaagtgacagcccggtggctttgggggtttctgagcagaaacaagaagccccggatctgtacgcgcgaggagttcaccagaaaagttcggtctaatgcggccattggagctgtgtttgtcgacgagaaccagtggaatagcgccaaggaggctgtggaagatgagcgcttctgggacctcgtccagaaagaaagagagctgcacaagcagggcaaatgcgccacatgcgtgtataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgttgagggggagggactccataagctgggctacattcttcgcgacatctctaaaattcctgggggaaatatgtatgccgatgacaccgctggctgggatacaagaatcaccgaagacgatctgcaaaacgaggccaagatcacagacattatggaacccgagcacgctctcctggccaccagcatctttaaactgacgtaccagaataaggtggtccgggtgcagcgccctgcgaagaacgggaccgtgatggatgttatttccagacgggaccagcgcggctctggacaagtgggcacatatgggctcaataccttcacaaacatggaagcccagctgatcagacagatggagagcgagggaatttttcttccctccgaactggagaccccgaacctcgctgaacgggtcctggattggcttgagaaacatggcgtggaaagactgaagcgcatggccatcagcggggacgactgtgttgtgaaacctatcgatgaccggttcgctacggccctcacagcgctgaatgatatgggaaaggtcagaaaagacattccccagtgggagccttctaagggctggaacgattggcaacaggtgcccttttgctcccaccacttccatcagctgatcatgaaggacgggcgcgagattgtcgtgccttgtcggaatcaggatgaactcgttggcagagcccgcgtgagccaaggagctggctggtctctgcgggagaccgcctgccttgggaaatcctacgctcagatgtggcagctgatgtattttcacagacgcgacctccggctggccgctaacgccatctgtagcgcggtccccgtggattgggttccgacatccagaaccacgtggtctattcatgcccaccatcaatggatgaccacagaagacatgcttagcgtgtggaatcgcgtctggatcgaggaaaacccttggatggaggataagacccacgtgtccagctggggagacgtgccctacctgggcaaacgggaggaccagtggtgcgggtctctcattggactgacagctagagccacctgggcctccaatatccaggttgctatcaaccaggtccggagactgattggcaatgaaaactatctcgattacatgacaagcatgaagcgcttcaaaaatgagggggaccccgaaggcgccctgtggtga

SEQ ID NO: 19007 - RNA, 9879 nt, synthetic construct
  misc_feature 1..9879: note = derived and/or modified CDS sequence (opt5) from DENV-1__FJ898375__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacaagcgccggcgttaacatgtgcacccttatcgcgatggacctgggggagttctgtgaagatacaatgacctacaaatgcccgagaatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatggccctgttccttgcgcatgccatcgggacatctattacccagaagggaatcatctttattctgctcatgctggtcacccctagcatggctatgagatgcgtgggcatcgggtcccgggatttcgttgagggacttagcggcgccacatgggtggacgtcgtgctggagcacgggtcttgtgtgacgaccatggctaaggataaacccacactcgacattgaactgctgaagaccgaggtcacaaaccctgccgttctccgcaaactgtgcatcgaagcgaagatttccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgattgtcaccgtgcacacaggcgaccagcatcaagttgggaatgagagcaccgaacacggaacaaccgctacgatcacaccccaggccccttctacagagatccagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaattcaaacaagcggaaccacaaccatcttcgctggccatctgaagtgcagactcaaaatggataagctgacgcttaaagggatgtcttatgtgatgtgtacaggctccttcaagctggagaaggaagtcgccgagacccagcacggaaccgtgctcgttcagattaaatacgagggcacagacgcgccgtgcaagatcccttttagcacccaggatgaaaaaggggtgacacaaaacggacggctgattacggctaatcccatcgtcaccgacaaggagaaacctgtgaacatcgaagccgagccgcccttcggcgagtcttatattgtgatcggggccggagaaaaggctctgaaacttagctggtttaaaaagggctcctctattgggaaaatgttcgaggccacagctagaggcgcccgccggatggcgatcctcggagataccgcctgggactttggcagcattgggggagttttcacatccgtcggcaagctggtgcatcagatctttgggaccgcttacggagtgctgttcagcggcgtctcttggacgatgaaaatcgggattggcgtgctcctgacctggcttggactcaattccagaagcacatctctctccatgacctgtatcgccgttggcctggtgacactgtaccttggggtcatggtgcaggctgatagcggatgcgttattaactggaagggccgcgaactcaagtgtgggtccggaatctttgtgaccaatgaggtccacacatggaccgaacagtataaattccaagccgactctcctaagcggctgagcgcggccattggcaaggcttgggaggagggggtgtgcggcatcagatccgccacgcgcctggaaaacattatgtggaagcagatctctaacgagctcaatcatatcctgcttgaaaacgacatgaaatttacagttgtggtcggagatgtggctggcattctggcccaggggaagaaaatgatccggccgcagcccatggagtacaagtatagctggaagtcctggggaaaagccaagattatcggcgctgacgtgcaaaataccaccttcattatcgatgggcctaacacacccgaatgtcctgacgatcagagagcgtggaatatctgggaggtcgaggactacggatttggcattttcaccacgaacatctggctcaaactgcgcgatagctatacacaggtttgcgaccaccggctgatgtctgccgctattaaggattccaaagccgtgcacgccgacatgggctactggatcgaaagcgagaagaatgaaacctggaaacttgctagagcctctttcattgaggtgaagacatgtatctggcccaagtcccataccctctggagcaacggggtcctggaatctgagatgatcattccgaaaatctatggaggccctattagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaatcattcacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacagggaccctcgccgtctttttcctgcttattatgggacagctgacatggaacgatctcatccggctgtgcattatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccatcggcctgtctctcgtggccagcgtcgaactgcccaactccctggaggaacttggggatggactggccatgggcattatgatcctcaaactgctcacagacttccagagccatcaactgtgggctacccttctgtctctcacatttatcaagaccacgttctccctgcactatgcctggaagacaatggctatggttctgagcattgtgtctctttttcccctgtgtctctccaccaccagccagaaaacaacctggctgcctgtgctcctggggtctcttggatgcaagccgctgacaatgttcctgatcgccgagaataaaatttggggcagaaagtcctggcccctcaacgaaggcatcatggcggtcgggattgtgagcatcctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggacgatgaaaatcaaggatgaggagcgggacgataccctcacaattctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatctatcggattatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatctcctacgggggaggctggagactgcagggcagctggaatacaggggaggaagtgcaggttattgcggtcgagcccggaaagaaccctaaaaatgtgcagaccgctcccggcacattcaagacctctgaaggggaggtgggagccatcgccctcgattttaaaccgggcacatccgggagccctattgtcaaccgggaaggaaagatcgtgggcctgtatggcaatggggttgtgacgacctccggaacatacgtctctgctattgcccaagcgaaagctagccaggagggccccctccctgagatcgaagacgaggtgttcagaaagcgcaacctgaccatcatggatcttcaccccgggtccggaaagacccggagatatctgcccgccattgttcgcgaagccatcaaacggaagctgagaacactcattctggctcctacgcgcgtggtcgccagcgagatggctgaagcccttaaaggcatgccgatccggtaccagaccacagcggtgaagtctgagcataccgggaaagagattgttgacctgatgtgccacgccacatttaccatgagactcctgtcccccgtgcgcgtccctaattataacatgatcatcatggatgaagctcatttcacggaccccagctctattgccgctcggggctacatcagcacaagagtgggaatgggcgaggccgccgctatttttatgaccgcgacccctcccgggtccgtggaagccttccctcaatctaatgctgtcatccaggatgaggaacgggacattccggagcgcagctggaactccggatatgagtggatcacagattttcccggcaagaccgtttggttcgtgccttctatcaagagcgggaatgacattgccaactgtctgcgcaaaaatggaaagcgggtgatccagctctcccgcaaaacattcgataccgaataccagaagacgaaaaacaacgactgggactacgtcgtgacaaccgatattagcgagatgggcgccaattttagagctgaccgggttatcgatcccagacgctgccttaagcctgtgattctgaaggacgggcccgaacgggtcatcctggccggcccgatgcctgtgacagttgcgtctgctgcccaaagacgcggacggattggcagaaaccacaataaagagggggatcagtatatctacatgggacagcccctcaacaatgacgaggatcatgcccactggaccgaagctaagatgctgcttgacaacatcaatacgcccgagggcattatccctgccctgttcgaacccgagcgcgaaaaatccgcggccattgatggggagtatcggctcagaggagaggctcgcaagacctttgtggaactgatgagacggggcgacctgcctgtctggctcagccacaaagtggcctccgaggggttccagtactctgatcgcagatggtgctttgacggcgaacggaacaatcaagtccttgaggaaaacatggatgtggagatctggacaaaggagggagaacgcaaaaagctgagaccgcggtggctggacgctagaacctatagcgaccccctcgccctgcgcgagttcaaggaatttgctgccggccggagatccgtttctggggatcttattctggagatcggaaaactccctcagcatctgacacagcgcgcgcagaatgccctggacaacctcgtgatgcttcacaatagcgaacaaggcgggcgggcttacagacatgccatggaggagctgcccgataccatcgaaacactgatgctcctggctcttattgccgtgctgaccggaggcgtcacgctgttctttctgtccggccgggggctgggaaagacaagcatcggcctcctttgtgttatggcctcttccgtgctgctgtggatggctagcgtggagcctcactggattgcggcctctatcattctcgagttctttctgatggtccttctgatccccgagccggaccgccagagaacccctcaggataaccagctcgcttatgtggttatcgggctgctgttcatgattctcaccgtggccgccaatgagatgggacttctggaaacaaccaaaaaggacctgggcatcgggcacgtcgctgtggagaaacatcaccatgccgcgatgctcgatgtcgacctgcaccccgcctccgcttggacactttacgccgtggctacgaccattatcacacctatgatgcggcataccattgaaaacacaaccgccaacatcagcctgacggcgattgccaatcaagctgccatcctcatgggactggataagggctggcccatctctaagatggacattggcgttcctctgctcgctcttgggtgctacagccaggtgaaccccctgaccctgacagccgctgtcctcatgctggtggcccactatgcgatcattggaccgggccttcaggccaaagctacccgcgaggcccaaaagagaacagctgccgggatcatgaaaaatcctaccgttgatggaattgtggccatcgacctggatcccgtcgtgtacgacgcgaagtttgaaaaacagctcggccagatcatgctgctgattctctgtacgtcccagatccttctgatgcggacaacctgggctctgtgcgagtctattacactcgccaccgggcccctgaccacactttgggagggaagccctggcaagttctggaacacgaccatcgctgtgtccatggccaatattttccgcggcagctatctggccggggctggactcgccttttccctgatgaagtctctgggcgggggaagacggggcacaggggcgcaaggagaaaccctcggcgagaaatggaagcgccagcttaaccagctgagcaaatccgagttcaatacatacaagagatctggcatcatggaggttgaccggagcgaagccaaagaggggctgaagagaggagagaccacgaagcacgctgtctcccgcggcacagccaaactccggtggtttgtggaaagaaacctggtgaagccggaggggaaagtcatcgatcttggatgtggccgcgggggatggtcttattactgcgctggcctgaagaaagttaccgaagtgaagggctataccaaagggggacccggccatgaggaacctattcccatggccacatacgggtggaatctcgtgaagctgcacagcggaaaggacgtcttctttatccctcccgagaaatgtgataccctgctctgcgacattggcgagtccagccctaacccgacaatcgaagaggggcggacgcttagagtgctgaagatggttgaaccctggctgcgcggaaatcagttctgtattaaaatcctcaacccttacatgccctctgtggtcgagaccctggagcaaatgcagcggaagcatggcggcatgcttgtgagaaatcctctgtcccgcaacagcacacacgaaatgtattgggtttcttgcgggaccggaaatattgtgtccgcggtcaacatgacaagccggatgctcctgaatagatttaccatggcccaccgcaaacccacgtacgagcgggatgtggacctgggcgctgggaccagacatgtggccgtcgaaccggaggttgctaacctcgatatcatcggacagcgcattgaaaacatcaagcacgagcataagtctacatggcactatgacgaggataatccttacaaaacctgggcctatcatggctcctacgaagtgaagcccagcgggtccgctagctctatggtgaacggagtcgtgaaactgcttacaaagccctgggacgttattcctatggtgacccagatcgccatgacagataccacgcccttcggccaacagagagtctttaaagagaaggtggacacacggacccctaaggcgaaacgcggcaccgcccagattatggaagttacagctaagtggctgtgggggttcctcagcagaaataaaaagccgcggatctgtacgagagaggaatttacccggaaagtgcgctccaacgccgctatcggagccgtcttcgtggacgagaatcaatggaactctgccaaggaggcggttgaagatgagagattttgggacctggtgcaccgggaacgcgagcttcacaagcagggcaaatgcgctacatgcgtctataatatgatggggaagagagagaaaaagctgggagagttcggcaaagccaaggggagccgggccatttggtacatgtggctcggcgctcgcttcctggagtttgaagccctgggattcatgaacgaggatcattggttttccagagaaaattctctcagcggcgtggagggggagggactgcacaaacttggctacatcctgcgggacatttccaagatccccgggggaaacatgtatgctgatgacaccgccggctgggatacacgcattaccgaagacgatctccagaatgaggcgaagatcacagacatcatggaacctgagcatgccctgcttgctaaatctattttcaagctgacctaccagaacaaagtcgtgagagttcaacggcccgccaagaatgggacggtgatggatgtcatcagccgcagagaccagcggggctccggacaggtgggcacctatgggctcaacacatttaccaatatggaagctcagctgattcgccaaatggagagcgagggaatcttctctccttccgaactggagacacccaacctcgccggcagagtgctggattggcttgaaaaacacggggttgagcggctgaagagaatggcgattagcggagacgactgtgtggtcaagccgatcgatgaccgctttgccaccgctctcacggccctgaacgatatgggcaaagtgcggaaggacatccctcagtgggaaccctctaaagggtggaatgattggcagcaggttcctttctgctcccaccattttcaccaacttattatgaaggacggcagagagatcgtggtcccctgtcgcaaccaggatgagctggtgggacgggctagagtcagccagggcgccgggtggtccctccgcgaaacagcttgcctgggaaaatcttacgcccagatgtggcaactgatgtatttccatcggagagacctccgcctggcggccaatgctatttgtagcgccgtgcctgttgattgggtgcccacctcccggacaacctggagcatccacgcccatcaccagtggatgacgaccgaggacatgctttctgtctggaacagagtgtggattgaagagaatccgtggatggaagataagacacacatctccagctggggcgacgttccttacctggggaagcgcgaggaccagtggtgcggatctctcattggcctgaccgctcgggccacatgggcgaccaacatccaagtggctatcaatcaggtcagacggcttattgggaacgagaattatctggattacatgacaagcatgaaaagatttaagaacgaatccgaccccgagggcgccctctggtga

SEQ ID NO: 19008 - RNA, 9879 nt, synthetic construct
  misc_feature 1..9879: note = derived and/or modified CDS sequence (opt5) from DENV-1__FJ898376__SS-prME
  source 1..9879: mol_type = other RNA
agcgtgaccatgctgctcatgctgatgcccaccgcccttgctttccacctgacgacccggggcggggaacctcatatgatcgtcacaaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgtcattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataaacccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggattggcgtgctgcttacctggctgggactcaattctagatccacaagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgattggcaaggcctgggaggagggggtgtgcggcatcagaagcgctacgcgcctcgaaaacatcatgtggaaacagatttccaacgagctgaatcatatccttctggaaaacgacatgaagttcacagttgtggtcggagatgtggtgggcattctcgcccaggggaaaaagatgatccggccgcaacccatggagcacaaatactcttggaaaagctggggaaaggctaagattatcggcgccgacgtccagaataccacctttatcattgatgggcctaacacacccgaatgtcctgacgatcagagagcctggaatatctgggaggttgaggactatggattcggcatttttaccacgaacatctggctgaagctgcgcgattcccacacacaggtgtgcgaccatcggcttatgagcgctgcgattaaagattctaaggccgtgcacgctgacatgggctactggatcgaatccgagaaaaatgaaacctggaagctcgccagagccagcttcatcgaggtcaagacatgtatttggcccaaatctcataccctgtggtccaacggggtgctggaaagcgagatgatcattccgaagatctatggaggccctatttctcaacacaattaccgccccgggtatttcacacagaccgctggaccttggcacctcggcaaactggagcttgattttgacctgtgcgaagggacgaccgttgtggtcgatgagcattgcggaaaccggggccccagcctcagaacaaccacagtgaccggcaagatcatccacgaatggtgttgccggtcctgtacgctgcctcccctgcgcttcaaaggggaggacggatgctggtacggcatggagattagaccggttaaggaaaaggaggaaaatcttgtgaaaagcatggtctctgccgggtccggagaggtggacagcttttccctcggcctgctgtgtatctctattatgatcgaagaggttatgcggagcagatggtcccgcaagatgctcatgacagggaccctggcggtgttccttctgctcattatgggacagctgacatggaacgatctgatccggctttgcattatggtcggcgctaatgcctctgacagaatgggcatggggaccacctacctggccctcatggctacatttaaaatgcgccctatgttcgccgtgggactgctctttagacggctgacgagccgcgaggtgcttctgctcaccatcggcctgtccctggtcgcgtctgttgaacttcccaacagcctggaggaactcggggatggactggctatgggcatcatgattctcaagctgcttacagacttccaatcccatcagctgtgggccaccctcctgagcctgacatttatcaaaaccacgctttctctgcactatgcctggaagacaatggctatggtgctctccattgtgagcctgttccccctctgtctgtctaccacctcccagaagacaacctggcttcctgtcctgctggggagcctcggatgcaaaccgctggccatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttacgtgattagcggatctagcgccgacctctccctggagaaagctgccgaggtttcttgggaagaggaagccgagcatagcggcgcttcccacaatatccttgtggaagtccaggatgacgggacaatgaagattaaagatgaggagcgggacgatacgctgaccatcctcctgaaggcgacactcctggccgtgtctggagtctatcctcttagcatccccgctaccctgttcgtgtggtacttttggcaaaagaaaaagcagcgctccggcgttctgtgggacacaccttctcccccggaagtggagagagccgtcctcgatgacggcatttatcggatcatgcagcgcgggctgcttggaagaagccaggtgggcgttggggtgttccaagaaaacgtcttccacaccatgtggcatgtgacgcggggagccgtgctgatgtaccagggcaaacgcctcgagccttcctgggctagcgttaagaaagacctgatttcttatgggggaggctggagactccagggctcctggaataccggggaggaagtccaggtgatcgccgtggagcccggaaagaaccctaagaatgtccaaacagcgcccggcacctttaaaacaccggaaggggaggtgggagctattgccctggatttcaagcctggcaccagcgggtctcccatcgttaaccgggaaggaaaaattgtgggcctttacggcaatggggtcgtgacaacgtccggaacctacgttagcgccatcgctcaggccaaggcgtcccaggagggccctctgcccgagatcgaagacgaggtgtttagaaaacgcaacctgacaattatggatctccaccccgggtctggaaagacccggagatatctgcctgctatcgtccgcgaagccattaagcggaaacttagaaccctgatcctcgccccgacacgcgtggttgctagcgagatggccgaagctctgaagggcatgcccattcggtaccaaacgaccgccgtgaaatccgagcatacagggaaggagatcgtcgacctgatgtgccacgcgaccttcacaatgagactccttagccctgtgcgcgtgcccaattataacatgatcattatggatgaagcccattttaccgacccttcttccatcgctgcccggggctacattagcacgagagtcggaatgggcgaggctgccgccatcttcatgacagctacaccccctgggtctgttgaagcgtttccgcagagcaatgccgtgattcaggatgaggaacgggacatccccgagcgctcctggaactctggatatgagtggatcaccgatttccctggcaaaacagtgtggtttgtccccagcattaagtccgggaatgacatcgctaactgtctgagaaagaatggaaaacgggtgattcagctgtctcgcaagaccttcgatacagaataccagaagaccaagaacaacgactgggactatgttgtgacgacagatatcagcgagatgggcgccaattttagagccgaccgggtcattgatcctagacgctgcctcaaacccgtgatcctgaaggacgggccggaacgggttattcttgctggccctatgcccgtgaccgtcgcctccgcggctcagagacgcggacggatcggcagaaaccacaataaggagggggatcagtacatctacatgggacagcccctgaacaatgacgaggatcacgcccattggacagaagccaaaatgctcctggacaacattaatacccctgagggcatcattcccgctctgttcgaacctgagcgcgaaaagagcgccgcgatcgatggggagtatcggctcagaggagaggcccgcaaaacgttcgtggaacttatgagacggggcgacctgccggtctggctgtcttacaaggtggcttccgaggggtttcaatatagcgatcgcagatggtgcttcgacggcgaacggaacaatcaggttctcgaggaaaacatggatgtggagatttggaccaaagagggagaacgcaagaaactgagaccccggtggcttgacgccagaacatactccgaccctctggctctccgcgagtttaaggagttcgccgctggccggagatctgtgagcggggatctgatcctggagatcggaaagctcccccagcaccttacccagcgcgcccaaaatgcgctggacaacctggtcatgctccataattccgaacagggcgggcgggcctatagacacgctatggaggagctgcctgatacaattgaaacccttatgctgctcgccctgatcgctgttctgacaggaggcgtgaccctctttttcctttctggccgggggctgggaaaaacgagcattggcctgctctgtgtgatggcctccagcgtcctgctttggatggcctctgtggagccccactggatcgctgcgtccattatcctggaatttttcctcatggttctgctgatcccggagcctgaccgccagagaacaccccaggataaccaactcgcctacgtggtcattgggcttctgtttatgatcctgaccgtggctgccaatgagatgggactcctggaaaccacaaagaaagaccttggcattgggcatgtcgccgtggagaaccaccatcacgctaccatgctggatgttgacctccatcctgccagcgcgtggacactgtatgccgtggctacgaccatcattacacccatgatgcggcacaccatcgaaaacacaaccgccaatatttctctgacggctatcgccaaccaggcggccatcctcatgggacttgataagggctggcctatttccaaaatggacatcggcgtccccctgctggctctcgggtgctacagccaggtgaatccgctgacccttacagccgctgttctgatgctcgtggcccactacgctattatcggacctggcctgcaagccaaggcgacccgcgaggcccagaagagaacagctgccgggattatgaaaaaccccaccgtcgatggaatcgtggctatcgacctggatcccgtggtttatgacgccaagttcgaaaaacagctcggccagattatgcttctgatcctgtgtacgtctcaaattctcctgatgcggacaacctgggccctttgcgagagcatcacactggcgaccgggcctctcaccacactgtgggagggatccccgggcaagttttggaatacgaccattgctgtctctatggccaacatcttccgcggcagctacctggctggggccggactcgccttttcccttatgaaaagcctgggcgggggaagacggggcacaggggctcagggagaaaccctgggcgagaagtggaagcgccagctcaatcagctgtccaaatctgagttcaacatctataagagaagcggcattatggaggtggaccggtccgaagccaaagaggggcttaagagaggagagacaacccgccatgcggtgtctcggggcacggccaaactgagatggttcgtcgaacgcaatctcgttaagcccgaggggaaggtgatcgatctgggatgtggcagagggggatggagctactattgcgctggcctgaaaaaggtgacagaagtcaaaggctacaccaaagggggacctggccacgaggaacccattcctatggccacctatgggtggaacctcgtgaaacttcattccggaaaggacgtctttttcacaccccctgagaaatgtgataccctgctgtgcgacatcggcgagtctagcccgaatcccacaattgaagaggggagaacgctccgcgtgctgaagatggtcgaaccttggcttcggggaaaccaattttgtatcaagattctgaatccctacatgccttccgtggttgagaccctcgagcagatgcagagaaaacacggcggcatgctggtgcgcaaccccctgagcagaaattctacacacgaaatgtactgggtctcctgcgggaccggaaacatcgtgagcgctgtgaatatgacatctagaatgctcctgaaccgcttcaccatggcccatcggaagccgacgtatgagagagatgtcgaccttggcgcggggacccgccacgttgccgtggaacctgaggtggctaacctggatatcattggacagagaatcgaaaatattaaacatgagcacaagtccacatggcattacgacgaggataacccctataaaacctgggcctaccacggcagctatgaagtcaagccctctgggtccgctagctccatggtgaatggagttgtgaagctcctgacaaaaccttgggacgtcatccccatggtgacccaaattgccatgacagataccacgccttttggccagcagcgggttttcaaggagaaagtggacacacgcaccccgaaggctaaaagaggcaccgcccaaatcatggaagtcacagcgcggtggctttgggggtttctgagcagaaacaagaagccccggatctgtacgcgcgaggagttcaccagaaaagtgcggtctaatgccgctattggagccgtttttgtggacgagaaccagtggaatagcgctaaggaggccgtcgaagatgagcgcttctgggacctcgtgcagaaagaaagagagctgcacaagcagggcaaatgcgccacatgcgtctacaacatgatggggaagcgggaaaagaaactgggagagtttggcaaggcgaaagggtcccgcgctatctggtatatgtggctcggcgccagattcctggagtttgaagcccttggattcatgaatgaggatcattggttctctcgggaaaacagcctgtccggcgtggagggggagggactccacaagctgggctacattcttcgcgacatctctaaaattcctgggggaaatatgtacgctgatgacaccgccggctgggatacaagaatcaccgaagacgatctgcaaaacgaggctaagatcacagacattatggaacccgagcatgccctcctggcgaccagcatctttaaactgacgtatcagaataaggttgtgcgggtccagcgccctgccaagaacgggaccgtgatggatgtgatttccagacgggaccagcgcggctctggacaagttggcacatacgggctcaataccttcacaaacatggaagctcagctgatcagacagatggagagcgagggaatttttcttccctccgaactggagacccagaacctcgccgaacgggtgctggattggcttgagaaatatggcgtcgaaagactgaagcgcatggctatcagcggggacgactgtgtggttaaaccgatcgatgaccggttcgccacggcgctcacagccctgaatgatatgggaaaggtgagaaaagacattcctcaatgggagccctctaagggctggaacgattggcagcaggtccctttttgctcccaccacttccatcagctgatcatgaaggacgggcgcgagattgtggtcccctgtcggaatcaagatgaactcgtgggcagagctcgcgttagccagggagccggctggtctctgcgggagaccgcttgccttgggaaatcctacgcccagatgtggcaactgatgtattttcacagacgcgacctccggctggctgccaacgcgaattgtagcgccgtgcctgtcgattgggtgcccacatccagaaccacgtggtctatccatgctcaccatcagtggatgaccacagaagacatgcttagcgtttggaaccgcgtgtggattgaggaaaatccgtggatggaggataagacccacgtctccagctggggagacgtgccttacctgggcaaacgggaggaccagtggtgcgggtctctcatcggactgacagccagagccacctgggcttccaacattcaggtggccatcaatcaagttcggagactgatcggcaacgaaaattatctcgattacatgacaagcatgaagcgcttcaaaaacgagggggaccccgaaggcgcgctgtggtga

SEQ ID NO: 19009 - RNA, 9879 nt, synthetic construct
  misc_feature 1..9879: note = derived and/or modified CDS sequence (opt5) from DENV-1__FJ898379__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttattgccatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaagacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggctctttcaaactcgagaaggaagtggccgagacccagcacggaacagttctggtgcagattaagtacgagggcaccgacgctccgtgcaaaatccctttctccacacaagatgaaaagggggtcacgcagaacggacggctgatcaccgccaatcccattgtgacagacaaagagaagcctgtgaacatcgaagcggagccgccctttggcgagagctatattatcattggggctggagaaaaagcccttaagctctcttggttcaagaaaggcagctccatcgggaagatgtttgaggccaccgctagaggcgcccgccggatggctatcctgggagatacagcctgggacttcggctctattgggggagtttttaccagcgtcggcaaactggtgcatcagatcttcgggacggcgtacggagtgctcttttccggcgtcagctggaccatgaagattgggatcggcgtgctgcttacatggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacaaatgaggtccacacctggacggaacaatataagtttcaggccgactcccctaaacggctgtctgctgccatcggcaaggcgtgggaggagggggtgtgcggcatcagaagcgccacacgcctcgaaaacattatgtggaaacagatctccaacgagctgaatcatattcttctggaaaacgacatgaagttcaccgttgtggtcggagatgtggctggcatcctcgcccaggggaaaaagatgattcggccgcaacccatggagtacaaatattcttggaaaagctggggaaaggctaagatcatcggcgccgacgtgcagaataccacatttattatcgatgggcctaacacccccgaatgtcctgacgatcagagagcctggaatatttgggaggtcgaggactacggattcggcatctttacgacaaacatttggctgaagctgcgcgattcctatacccaggtttgcgaccaccggcttatgagcgctgcgatcaaagattctaaggccgtgcacgctgacatgggctactggatcgaatccgagaaaaatgaaacatggaagctcgccagagccagcttcattgaggtgaagacctgtatctggcccaaatctcatacactgtggtccaacggggtcctggaaagcgagatgattatcccgaagatttatggaggccctatctctcaacacaattaccgccccgggtacttcacccagacggctggaccttggcatctcggcaaactggagcttgattttgacctgtgcgaagggaccacagtggttgtggatgagcactgcggaaaccggggccccagcctcagaaccacaaccgtcacgggcaagatcattcacgaatggtgttgccggtcctgtacactgcctcccctgcgcttcagaggggaggacggatgctggtatggcatggagatccggccggtgaaagaaaaggaggaaaatcttgttaagagcatggtgtctgccgggtccggagaggtcgacagcttttccctcggcctgctgtgtatttctatcatgattgaagaggtgatgagaagccgctggtcccggaaaatgctcatgaccgggacactggcggttttctttcttctgatcatgggacagctcacctggaacgatctgattagactgtgcatcatggtgggcgctaatgcctctgaccgcatgggcatggggaccacataccttgccctgatggctacgttcaagatgagacctatgtttgccgtcggactcctgttccggcgcctcaccagcagagaggtgctgcttctgacaatcggcctctccctggtggcgtctgtcgaactgcccaacagccttgaggaactgggggatggactcgctatgggcattatgatcctgaaactcctgaccgactttcaatcccatcagctttgggccacactgctcagcctgaccttcattaagacgacattttctctgcactatgcctggaaaaccatggctatggttctttccatcgtgagcctgttccccctctgtctgtctaccacatcccagaagaccacatggctccctgtgctgcttgggagcctgggatgcaagccgctgacgatgtttctcattgccgagaataaaatctggggccggcgctcttggcccctgaacgaaggcatcatggctgtcgggattgtgtccatccttctgagctccctcctgaagaacgatgttcctctcgccggacccctgattgcgggcgggatgcttatcgcctgttacgtgattagcggatctagcgctgacctgtccctggagaaagccgctgaggtctcttgggaagaggaagccgagcatagcggcgcctcccacaatatcctcgtggaagttcaggatgacgggaccatgaagatcaaagatgaggagagagacgatacactgaccattcttctgaaggctacactcctggcggtgtctggagtctatcctctcagcatccccgccaccctgttcgtgtggtacttctggcagaagaagaagcagcggtccggcgtcctttgggacacgccttctcccccggaagtggagcgcgctgttctggatgacggcatttatagaatcatgcagcgggggctgctcggacgcagccaggtgggcgtcggggtgtttcaagaaaacgttttccataccatgtggcacgtgacaagaggagccgtcctgatgtaccagggcaaacggcttgagccttcctgggccagcgtgaagaaagacctgatttcttacgggggaggctggagactccagggctcctggaataccggggaggaagtgcaggttatcgctgtcgagcccggaaagaaccctaaaaatgtgcaaacagcccccggcacctttaagacaccggaaggggaggtgggagcgattgctctggatttcaagcctggcacgagcgggtctcccatcgtcaaccgcgaaggaaaaatcgtgggcctctatggcaatggggttgtgaccacatccggaacctacgtcagcgccattgcccaggctaaggcctcccaggagggccctctgcccgagatcgaagacgaggtgtttcggaaaagaaaccttaccattatggatctgcaccccgggtctggaaagacacgccggtatctgcctgcgatcgttagagaagctattaaacgcaagctccggacgctgatccttgccccgaccagagtggtcgccagcgagatggctgaagccctgaagggcatgcccatccgctaccaaacaaccgctgtgaaatccgagcatacagggaaggagattgttgacctcatgtgccacgccaccttcacgatgcggctgctgagccctgtgagagtccccaattataacatgatcattatggatgaagcgcattttacagacccttcttccatcgccgctcggggctacattagcacccgcgtgggaatgggcgaggccgctgccatcttcatgaccgccacaccccctgggtctgtggaggcttttccgcagagcaatgcggtcatccaggatgaggaaagagacattcccgagcggtcctggaactctggatatgagtggatcaccgatttccctggcaaaacagtttggtttgtgcccagcattaagtccgggaatgacatcgccaactgtctccgcaaaaatggaaagagagtgattcagctttctcggaagaccttcgatacggaataccagaaaaccaagaacaacgactgggactacgtcgtgaccacagatatcagcgagatgggcgctaatttcagagccgaccgcgttattgatcctcggagatgcctgaaacccgtgatcctgaaggacgggccggaacgcgtcatcctcgccggccctatgcccgtgaccgttgcttccgccgcgcagcggagaggacgcattggccggaaccacaataaagagggggatcagtatatctacatgggacagcccctgaacaatgacgaggatcatgctcactggacggaagccaagatgcttctggacaacattaatacccctgagggcatcattcccgccctctttgaacctgagagagaaaagagcgctgccatcgatggggagtatcgcctgagaggagaggcgcggaaaacattcgtggaactgatgcgcagaggcgacctcccggtctggctttcttacaaggtggcctccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgctcggacatactccgaccctctggcccttagagagtttaaggagttcgctgccggccgccggtctgttagcggggatctgattctcgagatcggaaaactgccccagcacctgacccagagagctcaaaatgccctcgacaaccttgtgatgctgcataattccgaacagggcgggcgggcgtatcgccacgccatggaggagctgcctgatacaattgaaaccctcatgctgcttgctctgatcgccgtgctcacgggaggcgtcacactgtttttcctgtctggcagagggctcggaaagaccagcattggccttctgtgtgttatggcttccagcgtgctgctctggatggcctctgtggagccccattggatcgccgcttccatcattctggaatttttccttatggtcctgctcatcccggagcctgaccggcagcgcacaccccaggataaccaactggcgtacgtggttattgggctgctctttatgatccttacagtggccgctaatgagatgggactgctggaaaccacaaagaaagacctcggcattgggcacgtcgccgtggagaaccaccatcacgccgctatgctggatgtcgaccttcatcctgccagcgcgtggacgctgtacgccgtggctaccacaatcattacccccatgatgagacacacaatcgaaaacaccacggccaatatctctctcaccgctattgccaaccaggcggccatcctgatgggactggataagggctggcctatttccaaaatggacatcggcgttcccctccttgctctggggtgctatagccaggtgaatccgctgacactcaccgccgctgtcctgatgcttgtggcccattacgctattatcggacctggcctgcaagccaaggcgacacgggaggcccagaaacgcaccgctgccgggatcatgaagaaccccacggttgatggaattgtggctatcgacctcgatcccgtcgtgtatgacgccaagttcgaaaaacagctgggccagattatgctgctcatcctttgtacatctcaaattctgctgatgagaaccacatgggccctctgcgagagcatcaccctggcgaccgggcctcttacaacgctgtgggagggatccccgggcaagttttggaataccacaatcgctgtgtctatggccaacattttccggggcagctacctcgctggggccggactggccttctccctgatgaaaagcctcggcgggggacgcagaggcaccggggctcagggagaaacacttggcgagaagtggaaacggcagctgaatcagctgtccaagtctgaatttaacacctataagagaagcggcatcatggaggttgaccgctccgaagccaaagaggggctcaagcggggagagacgacaaaacacgcggtctctagaggcaccgccaagctgcgctggttcgtggaacggaatcttgtgaaacccgaggggaaggtcattgatctgggatgtggcagagggggatggagctactattgcgctggcctcaagaaagttaccgaagtgaagggctacacaaaagggggacctggccacgaggaacccatccctatggccacctacgggtggaacctggtgaagctgcattccggaaaagacgtctttttcattccccctgagaagtgtgatacactcctttgcgacatcggcgagtctagcccgaatcccacgattgaagaggggcgcaccctgcgggtgctgaaaatggttgaaccttggctcagaggaaaccaattttgtatcaagatcctgaatccctatatgccttccgtggtcgagacacttgagcagatgcagcgcaagcacggcggcatgctggtgcggaaccccctcagcagaaattctacccatgaaatgtactgggtttcctgcgggacaggaaacattgtgagcgctgtcaatatgacctctcgcatgctgctgaaccggttcacgatggcccacagaaaaccgacctatgagcgcgatgtggacctcggcgcggggacaagacacgtggccgtcgaacctgaggttgctaacctggatatcattggacagcggatcgaaaatattaagcatgagcacaaatccacctggcattacgacgaggataacccctataagacatgggcctaccacggcagctatgaagtgaaaccctctgggtccgctagctccatggtgaatggagtcgtgaaacttctgaccaagccttgggacgttatccccatggtgacacaaatcgccatgaccgatacgacaccttttggccagcagcgcgtcttcaaagagaaggtggacaccagaaccccgaaagctaagcggggcacagcccaaattatggaagttacggcgaaatggctctgggggtttctgagcagaaacaagaagccccggatctgtacccgcgaggagttcacaagaaaagtgcggtctaatgccgctattggagccgtctttgtggacgagaaccagtggaatagcgctaaggaggccgttgaagatgagcgcttctgggaccttgtgcatagagaacgggagctgcacaaacagggcaagtgcgcgacctgcgtctacaacatgatggggaaacgcgaaaagaagctcggagagtttggcaaagcgaaggggtccagagctatctggtacatgtggctgggcgcccggttcctggagttcgaagccctcggatttatgaatgaggatcactggttctctcgcgaaaacagcctgtccggcgtggagggggagggacttcataaactgggctatattctcagagacatctctaagatccctgggggaaatatgtacgctgatgacacagccggctgggatacccggattacagaagacgatctgcagaacgaggctcgcatcaccgacattatggaacccgagcacgcccttctggcgaaaagcatctttaagctcacgtatcaaaataaagtcgtgagagttcagcggcctgccaagaacgggaccgtgatggatgtcatttcccgcagagaccagcggggctctggacaggtgggcacatacgggctgaataccttcacaaacatggaagctcaactgatcagacagatggagagcgagggaatcttttcccccagcgaactcgagaccccgaacctggccgaacgcgtgcttgattggctggagaagtatggcgttgaacggctcaaaagaatggctatttctggggacgactgtgtggtcaagcctatcgatgaccgcttcgccacggcgctgacagcccttaatgatatgggaaaagtgcggaaggacattccccagtgggagccttccaaaggctggaacgattggcagcaagttcccttttgcagccatcacttccaccagctgatcatgaaggacgggagagagattgtggtcccttgtcgcaatcaggatgaactcgtgggccgggctagagtctctcagggagccggctggtccctgcgcgagaccgcttgcctgggaaagagctacgcccaaatgtggcagctcatgtattttcatcggagagacctgcgccttgctgccaacgcgatctgttccgccgtgcccgttgattggattccgacatctcggaccacgtggagcatccacgctcatcaccagtggatgaccacagaagacatgctgtccgtgtggaatagagtctggatcgaggaaaacccttggatggaggataaaacccatattagctcttggggagacgtgccctacctcggcaagcgggaggaccaatggtgcgggtccctgatcggacttacagccagagccacctgggctacaaatattcaggttgccatcaaccaggtgcgccggctgattggcaatgaaaactacctcgattatatgaccagcatgaaaagattcaagaatgagtctgaccccgaaggggcgctgtggtga

SEQ ID NO: 19010 - RNA, 9879 nt, synthetic construct
  misc_feature 1..9879: note = derived and/or modified CDS sequence (opt5) from DENV-1__GQ199773__SS-prME
  source 1..9879: mol_type = other RNA
agcgtgacaatgctgctgatgctgatgcccacagcccttgctttccacctgacgacaagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgaccgtcacagtgcacaccggcgaccagcatcaagttgggaatgagagcacagaacacggaaccacggctaccatcacaccccaggccccttctaccgagatccagctgacagactacggcgccctcaccctggattgtagcccccggacgggcctggactttaacgaaatggtgctcctgacaatgaaggagaaaagctggcttgtccataagcagtggttcctggatctccctctgccctggacctccggggcttctacaagccaagagacctggaatcgcaaagaccttctggtgacctttaagacagcgcacgccaagaaacaggaagtcgtggttctcggatcccaggagggcgctatgcacacggccctgaccggggccacagaaattcaaaccagcggaacaaccacgatcttcgctggccatctgaagtgcagactcaaaatggataagctgacacttaaagggatgtcttatgtgatgtgtaccggctccttcaagctggagaaggaagtcgccgagacccagcacggaacagtgctcgttcagattaaatacgagggcaccgacgcgccgtgcaagatcccttttagcacacaggatgaaaaaggggtgacgcaaaacggacggctgattaccgctaatcccatcgtcacagacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcattgggggagttttcacctccgtcggcaagctggtgcatcagatctttgggacggcttacggagtgctgttcagcggcgtctcttggaccatgaaaatcgggattggcgtgctcctgacatggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacggaacagtataaattccaagccgactctcctaagcggctgagcgcggccattggcaaggcttgggaggagggggtgtgcggcatcagatccgccacacgcctggaaaacattatgtggaagcagatctctaacgagctcaatcatatcctgcttgaaaacgacatgaaatttaccgttgtggtcggagatgtggctggcattctggcccaggggaagaaaatgatccggccgcagcccatggagtacaagtatagctggaagtcctggggaaaagccaagattatcggcgctgacgtgcaaaataccacattcattatcgatgggcctaacacccccgaatgtcctgacgatcagagagcgtggaatatctgggaggtcgaggactacggatttggcattttcacgacaaacatctggctcaaactgcgcgatagctatacccaggtttgcgaccaccggctgatgtctgccgctattaaggattccaaagccgtgcacgccgacatgggctactggatcgaaagcgagaagaatgaaacatggaaacttgctagagcctctttcattgaggtgaaaacctgtatctggcccaagtcccatacactctggagcaacggggtcctggaatctgagatgatcattccgaaaatctatggaggccctattagccagcacaattaccgccccgggtactttacccaaacggcgggaccttggcatctgggcaagctcgagctggatttcgacctttgcgaagggaccacagtggttgtggatgagcactgcggaaaccggggcccctccctgagaaccacaaccgtcacgggcaaaatcattcacgaatggtgttgccggagctgtacactccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgaccgggacactcgccgtctttttcctgcttattatgggacagctgacctggaacgatctcatccggctgtgcattatggtgggcgccaatgctagcgacagaatgggcatggggaccacatacctggcccttatggcgacgtttaagatgcgccctatgttcgctgtcggactgctctttagacggctgacctcccgcgaggtgctcctgcttacaatcggcctgtctctcgtggccagcgtcgaactgcccaactccctggaggaacttggggatggactggccatgggcattatgatcctcaaactgctcaccgacttccagagccatcaactgtgggctacacttctgtctctcacctttatcaagacgacattctccctgcactatgcctggaagaccatggctatggttctgagcattgtgtctctttttcccctgtgtctctccaccacaagccagaaaaccacatggctgcctgtgctcctggggtctcttggatgcaagccgctgacgatgttcctgatcgccgagaataaaatttggggcagaaagtcctggcccctcaacgaaggcatcatggcggtcgggattgtgagcatcctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggaccatgaaaatcaaggatgaggagcgggacgatacactcaccattctgcttaaggccacactgctcgctgtgagcggagtctatcctctgtccatccccgccaccctcttcgtgtggtacttttggcagaaaaagaaacaacgctctggcgtcctgtgggacacgccttcccctcccgaagtggagagagccgttcttgatgacggcatctatcggattatgcagcgcgggctgctgggaagatcccaggtgggcgtcggggtgttccaggaaaacgtttttcataccatgtggcacgtgacacggggagctgtcctcatgtaccaaggcaagcgcctggagcccagctgggcctctgtgaaaaaggaccttatctcctacgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacgtccgggagccctattgtcaaccgggaaggaaagatcgtgggcctgtatggcaatggggttgtgaccacatccggaacctacgtctctgctattgcccaagcgaaagctagccaggagggccccctccctgagatcgaagacgaggtgttcagaaagcgcaacctgaccatcatggatcttcaccccgggtccggaaagacacggagatatctgcccgccattgttcgcgaagccatcaaacggaagctgagaacgctcattctggctcctacccgcgtggtcgccagcgagatggctgaagcccttaaaggcatgccgatccggtaccagacaaccgcggtgaagtctgagcatacagggaaagagattgttgacctgatgtgccacgccacctttacgatgagactcctgtcccccgtgcgcgtccctaattataacatgatcatcatggatgaagctcatttcacagaccccagctctattgccgctcggggctacatcagcaccagagtgggaatgggcgaggccgccgctatttttatgaccgcgacacctcccgggtccgtggaagccttccctcaatctaatgctgtcatccaggatgaggaacgggacattccggagcgcagctggaactccggatatgagtggatcaccgattttcccggcaagacagtttggttcgtgccttctatcaagagcgggaatgacattgccaactgtctgcgcaagaatggaaagcgggtgatccagctctcccgcaaaaccttcgatacggaataccagaagaccaagaataacgactgggactacgtcgtgaccacagatattagcgagatgggcgccaattttagagctgaccgggttatcgatcccagacgctgccttaagcctgtgattctgaaggacgggcccgaacgggtcatcctggccggcccgatgcctgtgaccgttgcgtctgctgcccaaagacgcggacggattggcagaaaccacaataaagagggggatcagtatatctacatgggacagcccctcaacaatgacgaggatcatgcccactggacggaagctaagatgctgcttgacaacatcaatacccccgagggcattatccctgccctgttcgaacccgagcgcgaaaaatccgcggccattgatggggagtatcggctcagaggagaggctcgcaagacatttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatctggaccaaggagggagaacgcaaaaagctgagaccgcggtggctggacgctagaacatacagcgaccccctcgccctgcgcgagttcaaggaatttgctgccggccggagatccgtttctggggatcttattctggagatcggaaaactccctcagcacctgacccagcgcgcgcagaatgccctggacaacctcgtgatgcttcataatagcgaacaaggcgggcgggcttatagacacgccatggaggagctgcccgatacaatcgaaaccctgatgctcctggctcttattgccgtgctgacgggaggcgtcacactcttctttctgtccggccgggggctgggaaagaccagcatcggcctcctttgtgttatggcctcttccgtgctgctgtggatggctagcgtggagcctcattggattgcggcctctatcattctcgagttctttctgatggtccttctgatccccgagccggaccgccagagaacccctcaggataaccagctcgcttacgtggttatcgggctgctgttcatgattctcacagtggccgccaatgagatgggacttctggaaaccaccaagaaggacctgggcatcgggcacgtcgctgtggagaaccaccatcacgccgcgatgctcgatgtcgacctgcatcccgcctccgcttggacgctttacgccgtggctaccacaattatcacccctatgatgcggcacacaattgaaaacaccacggccaatatcagcctgaccgcgattgccaaccaagctgccatcctcatgggactggataaaggctggcccatctctaagatggacattggcgttcctctgctcgctcttgggtgctatagccaggtgaatcccctgacactgaccgccgctgtcctcatgctggtggcccattacgcgatcattggaccgggccttcaggccaaggctacacgcgaggcccagaaaagaaccgctgccgggatcatgaagaaccctacggttgatggaattgtggccatcgacctggatcccgtcgtgtatgacgcgaaatttgaaaagcagctcggccagatcatgctgctgattctctgtacatcccagatccttctgatgcggaccacatgggctctgtgcgagtctattaccctcgccaccgggcccctgacaacgctttgggagggaagccctggcaaattctggaataccacaatcgctgtgtccatggccaacattttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcatcatggaggttgaccggagcgaagccaaggaggggctgaaaagaggagagacgacaaagcacgctgtctcccgcggcaccgccaagctccggtggtttgtggaaagaaatctggtgaaaccggaggggaaggtcatcgatcttggatgtggccgcgggggatggtcttactattgcgctggcctgaaaaaggttaccgaagtgaaaggctacacaaaagggggacccggccacgaggaacctattcccatggccacctacgggtggaacctcgtgaaactgcatagcggaaaggacgtcttctttatccctcccgagaagtgtgatacactgctctgcgacattggcgagtccagccctaatccgacgatcgaagaggggcggacccttagagtgctgaaaatggttgaaccctggctgcgcggaaaccagttctgtattaagatcctcaatccttatatgccctctgtggtcgagacactggagcaaatgcagcggaaacacggcggcatgcttgtgagaaaccctctgtcccgcaatagcacccatgaaatgtactgggtttcttgcgggacaggaaacattgtgtccgcggtcaatatgaccagccggatgctcctgaacagatttacgatggcccaccgcaagcccacctatgagcgggatgtggacctgggcgctgggacaagacacgtggccgtcgaaccggaggttgctaacctcgatatcatcggacagcgcattgaaaatatcaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttattcctatggtgacacagatcgccatgaccgatacgacacccttcggccaacagagagtctttaaggagaaagtggacacccggacccctaaggcgaagcgcggcacagcccagattatggaagttacggctaaatggctgtgggggttcctcagcagaaacaagaaaccgcggatctgtaccagagaggaatttacacggaaggtgcgctccaatgccgctatcggagccgtcttcgtggacgagaaccaatggaactctgccaaagaggcggttgaagatgagagattttggaacctggtgcatcgggaacgcgagcttcacaagcagggcaagtgcgctacctgcgtctacaatatgatggggaaaagagaaaagaaactgggagagttcggcaaggccaaagggagccgggccatttggtacatgtggctcggcgctcgcttcctggagtttgaagccctgggattcatgaacgaggaccactggttttccagagaaaattctctcagcggcgtggagggggagggactgcataaacttggctatatcctgcgggatatttccaaaatccccgggggaaacatgtacgctgacgatacagccggctgggacacccgcattacagaagatgacctccagaatgaggcgaagatcaccgatatcatggaacctgagcacgccctgcttgctaagtctattttcaaactgacgtatcagaacaaggtcgtgagagttcaacggcccgccaaaaatgggaccgtgatggacgtcatcagccgcagagatcagcggggctccggacaggtgggcacatacgggctcaacacctttacaaacatggaagctcagctgattcgccaaatggagagcgagggaatcttctctccttccgaactggagacccccaatctcgccggcagagtgctggactggcttgaaaagcatggggttgagcggctgaaaagaatggcgattagcggagatgactgtgtggtcaagccgatcgacgatcgctttgccacggctctcacagccctgaacgacatgggcaaggtgcggaaagatatccctcagtgggaaccctctaaggggtggaatgactggcagcaggttcctttctgctcccaccactttcatcaacttattatgaaagatggcagagagatcgtggtcccctgtcgcaaccaggacgagctggtgggacgggctagagtcagccagggcgccgggtggtccctccgcgaaaccgcttgcctgggaaagtcttatgcccagatgtggcaactgatgtacttccaccggagagatctccgcctggcggccaatgctatttgtagcgccgtgcctgttgactgggtgcccacatcccggaccacgtggagcatccatgcccaccatcagtggatgaccacagaggatatgctttctgtctggaacagagtgtggattgaagagaatccgtggatggaagacaaaacccacatctccagctggggcgatgttccttatctggggaagcgcgaggaccagtggtgcggatctctcattggcctgacagctcgggccacctgggcgacaaacatccaagtggctatcaatcaggtcagacggcttattgggaacgagaattacctggactacatgaccagcatgaagagatttaaaaacgaatccgatcccgagggcgccctctggtga

SEQ ID NO: 19011 - RNA, 9879 nt, synthetic construct
  misc_feature 1..9879: note = derived and/or modified CDS sequence (opt5) from DENV-1__JF937596__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcccatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgtccagaatacaacctttattatcgatgggcctaacacccccgaatgtcctgacgatcagagagcctggaatatttgggaggttgaggactatggattcggcatctttacaaccaacatttggctgaagctgcgcgattcctacacgcaggcttgcgaccaccggcttatgagcgcggccatcaaagattctaaggctgtgcatgccgacatgggctattggatcgaatccgagaaaaatgaaacatggaagctcgccagagctagcttcattgaggtgaagacctgtatctggcccaaatctcacacactgtggtccaacggggtcctggaaagcgagatggtgattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttatgtgattagcggatctagcgccgacctctccctggagaaagctgccgaggtttcttgggaagaggaagccgagcacagcggcgcttcccataatatccttgtggaagtccaggatgacgggacaatgaagattaaagatgaggagcgggacgatacgctgaccatcctcctgaaggcgacactcctggccgtgtctggagtctaccctcttagcatccccgctaccctgttcgtgtggtatttttggcaaaagaaaaagcagcgctccggcgttctgtgggacacaccttctcccccggaagtggagagagccgtcctcgatgacggcatttaccggatcatgcagcgcgggctgcttggaagaagccaggtgggcgttggggtgttccaagaaaacgtcttccacaccatgtggcacgtgacgcggggagccgtgctgatgtatcagggcaaacgcctcgagccttcctgggctagcgttaagaaagacctgatttcttacgggggaggctggagactccagggctcctggaataccggggaggaagtccaggtgatcgccgtggagcccggaaagaaccctaagaatgtccaaacagcgcccggcacctttaaaacaccggaaggggaggtgggagctattgccctggatttcaagcctggcaccagcgggtctcccatcgttaaccgggaaggaaaaattgtgggcctttacggcaatggggtcgtgacaacgtccggaacctatgttagcgccatcgctcagacaaaggcctcccaggagggccctctgcccgagatcgaagacgaggtgtttagaaaacgcaacctgaccattatggatctccatcccgggtctggaaagacccggagatacctgcctgcgatcgtccgcgaagctattaagcggaaacttagaacactgatcctcgccccgacgcgcgtggttgccagcgagatggctgaagccctgaagggcatgcccattcggtatcaaaccacagctgtgaaatccgagcacaccgggaaggagatcgtcgacctgatgtgccatgccacattcaccatgagactccttagccctgtgcgcgtgcccaattacaacatgatcattatggatgaagcgcactttacggacccttcttccatcgccgctcggggctatattagcacaagagtcggaatgggcgaggccgctgccatcttcatgaccgccacaccccctgggtctgttgaggcttttccgcagagcaatgcggtgattcaggatgaggaacgggacatccccgagcgctcctggaactctggacatgagtggatcacagatttccctggcaaaaccgtgtggtttgtccccagcattaagtccgggaatgacatcgccaactgtctgagaaagaatggaaaacgggtgattcagctgtctcgcaagacattcgataccgaataccagaagacgaagaacaacgactgggactatgttgtgacaaccgatatcagcgagatgggcgctaattttagagccgaccgggtcattgatcctagacgctgcctcaaacccgtgatcctgaaggacgggccggaacgggttattcttgccggccctatgcccgtgacagtcgcttccgccgcgcagagacgcggacggatcggcagaaaccacaataaggagggggatcagtacatctacatgggacagcccctgaacaatgacgaggatcacgctcattggaccgaagccaaaatgctcctggacaacattaatacgcctgagggcatcattcccgccctgttcgaacctgagcgcgaaaagagcgctgccatcgatggggagtatcggctcagaggagaggcgcgcaaaaccttcgtggaacttatgagacggggcgacctgccggtctggctgtcttacaaggtggcctccgaggggtttcaatatagcgatcgcagatggtgcttcgacggcgaacggaacaatcaggttctcgaggaaaacatggatgtggagatttggacaaaagagggagaacgcaagaaactgagaccccggtggcttgacgctagaacctactccgaccctctggccctccgcgagtttaaggagttcgctgccggccggagatctgtgagcggggatctgatcctggagatcggaaagctcccccagcaccttacacagcgcgctcaaaatgccctggacaacctggtcatgctccataattccgaacagggcgggcgggcgtatagacacgccatggaggagctgcctgataccattgaaacacttatgctgctcgctctgatcgccgttctgaccggaggcgtgacgctctttttcctttctggccgggggctgggaaaaacaagcattggcctgctctgtgtgatggcttccagcgtcctgctttggatggcctctgtggagccccactggatcgccgcttccattatcctggaatttttcctcatggttctgctgatcccggagcctgaccgccagagaacaccccaggataaccaactcgcgtacgtggtcattgggcttctgtttatgatcctgaccgtggccgctaatgagatgggactcctggaaacaaccaagaaagaccttggcattgggcatgtcgccgtggagaaccaccatcacgccacaatgctggatgttgacctccatcctgctagcgcctggacgctgtatgcggtggccaccacaatcattacccccatgatgcggcacacaatcgaaaacaccacggctaatatttctctgaccgccatcgctaaccaggccgcgatcctcatgggacttgataagggctggcctatttccaaaatggacatcggcgtccccctgctggccctcgggtgctacagccaggtgaatccgctgacacttaccgctgccgttctgatgctcgtggctcactacgccattatcggacctggcctgcaagctaaggccacacgcgaggcgcagaagagaaccgccgctgggattatgaaaaaccccacggtcgatggaatcgtggccatcgacctggatcccgtggtttatgacgctaagttcgaaaaacagctcggccagattatgcttctgatcctgtgtacatctcaaattctcctgatgcggaccacatgggccctttgcgagagcatcaccctggccaccgggcctctcacaacgctgtgggagggatccccgggcaagttttggaataccacaattgcggtctctatggctaacatcttccgcggcagctacctggccggggctggactcgccttttcccttatgaaaagcctgggcgggggaagacggggcaccggggcccagggagaaacactgggcgagaagtggaagcgccagctcaatcagctgtccaaatctgagttcaacatctataagagaagcggcattatggaggtggaccggtccgaagctaaagaggggcttaagagaggagagaccacgcgccatgccgtgtctcggggcacagcgaaactgagatggttcgtcgaacgcaatctcgttaagcccgaggggaaggtgatcgatctgggatgtggcagagggggatggagctactattgcgccggcctgaaaaaggtgaccgaagtcaaaggctacaccaaagggggacctggccacgaggaacccattcctatggctacatatgggtggaacctcgtgaaacttcattccggaaaggacgtctttttcgcgccccctgagaaatgtgataccctgctgtgcgacatcggcgagtctagcccgaatcccacaattgaagaggggagaacgctccgcgtgctgaagatggtcgaaccttggcttcggggaaaccaattttgtatcaagattctgaatccctacatgccttccgtggttgagaccctcgagcagatgcagagaaaacacggcggcatgctggtgcgcaaccccctgagcagaaattctacacacgaaatgtactgggtctcctgcgggaccggaaacatcgtgagcgctgtgaatatgacatctagaatgctcctgaaccgcttcaccatggcccatcggaagccgacgtatgagagagatgtcgaccttggcgcggggacccgccacgttgccgtggaacctgaggtggctaacctggatatcattggacagagaatcgaaaatattaaacatgagcacaagtccacatggcattacgacgaggataacccctataaaacctgggcctaccacggcagctatgaagtcaagccctctgggtccgctagctccatggtgaatggagttgtgaagctcctgacaaaaccttgggacgtcatccccatggtgacccaaattgccatgacagataccacgccttttggccagcagcgggttttcaaggagaaagtggacacacgcaccccgaaggctaaaagaggcaccgcccaaatcatggaagtcacagcgcggtggctttgggggtttctgagcagaaacaagaagccccggatctgtacgcgcgaggagttcaccagaaaagtgcggtctaatgccgctattggagccgtttttgtggacgagaaccagtggaatagcgctaaggaggccgtcgaagatgagcgcttctgggacctcgtgcagaaagaaagagagctgcacaagcagggcaaatgcgccacatgcgtctacaacatgatggggaagcgggaaaagaaactgggagagtttggcaaggcgaaagggtcccgcgctatctggtatatgtggctcggcgccagattcctggagtttgaagcccttggattcatgaatgaggatcattggttctctcgggaaaacagcctgtccggcgtggagggggagggactccacaagctgggctacattcttcgcgacatctctaaaattcctgggggaaatatgtacgctgatgacaccgccggctgggatacaagaatcaccgaagacgatctgcaaaacgaggctaagatcacagacattatggaacccgagcatgccctcctggcgaccagcatctttaaactgacgtatcagaataaggttgtgcgggtccagcgccctgccaagaacgggaccgtgatggatgtgatttccagacgggaccagcgcggctctggacaagttggcacatacgggctcaataccttcacaaacatggaagctcagctgatcagacagatggagagcgagggaatttttcttccctccgaactggagaccccgaacctcgccgaacgggtgctggattggcttgagaaacacggcgtcgaaagactgaagcgcatggctatcagcggggacgactgtgtggttaaacctatcgatgaccggttcgccacggcgctcacagccctgaatgatatgggaaaggtgagaaaagacattccccagtgggagccttctaagggctggaacgattggcaacaggtccccttttgctcccaccatttccaccagctgatcatgaaggacgggcgcgagattgtggtcccttgtcggaatcaggatgaactcgtgggcagagctcgcgttagccaaggagccggctggtctctgcgggagaccgcttgccttgggaaatcctatgcccagatgtggcagctgatgtactttcatagacgcgacctccggctggctgccaacgcgatctgtagcgccgtgcccgtcgattgggtgccgacatccagaaccacgtggtctattcacgctcatcaccaatggatgaccacagaagacatgcttagcgtttggaatcgcgtgtggatcgaggaaaacccttggatggaggataagacccacgtctccagctggggagacgtgccctatctgggcaaacgggaggaccagtggtgcgggtctctcattggactgacagccagagccacctgggcttccaatatccaggtggccatcaaccaggttcggagactgattggcaatgaaaactacctcgattatatgacaagcatgaagcgcttcaaaaatgagggggaccccgaaggcgcgctgtggtga

SEQ ID NO: 19012 - RNA, 9879 nt, synthetic construct
  misc_feature 1..9879: note = derived and/or modified CDS sequence (opt5) from DENV-1__FJ898380__SS-prME
  source 1..9879: mol_type = other RNA
agcgtgaccatgctgctcatgctgatgcccaccgcccttgctttccacctgacgaccagaggcggggaacctcatatgatcgtctccaagcaggaacgggggaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcaaaggggaggacggatgctggtatggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgccggatgctcatgacagggaccctggccgttttctttcttctgattatgggacagctcacatggaacgatctgatcagactgtgcattatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcatcatgattctgaaactcctgacagactttcaatcccatcagctttgggctaccctgctcagcctgacattcatcaagaccacgttttctctgcactatgcctggaaaacaatggctatggttctttccattgtgagcctgttccccctctgtctgtctaccacctcccagaagacaacctggctccctgtgctgcttgggagcctgggatgcaagccgctgacaatgtttctcatcgccgagaataaaatttggggccggcgctcttggcccctgaacgaaggcatcatggcggtcgggatcgtgtccattcttctgagctccctcctgaagaacgatgttcctctcgccggacccctgatcgctggcgggatgcttattgcctgttacgtgatcagcggatctagcgctgacctgtccctggagaaagccgccgaggtctcttgggaagaggaagctgagcatagcggcgcgtcccacaatattctcgtggaagttcaggatgacgggacgatgaagatcaaagatgaggagagagacgataccctgacaatccttctgaaggccaccctcctggctgtgtctggagtctatcctctcagcattcccgccacactgttcgtgtggtacttctggcagaagaagaagcagcggtccggcgtcctttgggacaccccttctcccccggaagtggagcgcgccgttctggatgacggcatctatagaattatgcagcgggggctgctcggacgcagccaggtgggcgtcggggtgtttcaagaaaacgttttccatacgatgtggcacgtgaccagaggagctgtcctgatgtaccagggcaaacggcttgagccttcctgggccagcgtgaagaaagacctgatctcttacgggggaggctggagactccagggctcctggaatacaggggaggaagtgcaggttattgcggtcgagcccggaaagaaccctaaaaatgtgcaaaccgctcccggcacatttaagaccccggaaggggaggtgggagccatcgccctggatttcaagcctggcacaagcgggtctcccattgtcaaccgcgaaggaaaaatcgtgggcctctatggcaatggggttgtgacgacctccggaacatacgtcagcgctatcgcccaggcgaaggcttcccaggagggccctctgcccgagattgaagacgaggtgtttcggaaaagaaaccttaccatcatggatctgcaccccgggtctggaaagacccgccggtatctgcctgccattgttagagaagccatcaaacgcaagctccggacactgattcttgctccgacgagagtggtcgccagcgagatggctgaagccctgaagggcatgcccatccgctaccaaaccacagcggtgaaatccgagcataccgggaaggagatcgttgacctcatgtgccacgccacattcaccatgcggctgctgagccctgtgagagtccccaattataacatgattatcatggatgaagctcattttacggacccttcttccattgccgctcggggctacatcagcacacgcgtgggaatgggcgaggccgccgctattttcatgaccgcgacaccccctgggtctgtggaagcctttccgcagagcaatgctgtcatccaggatgaggaaagagacatccccgagcggtcctggaactctggatatgagtggattacagatttccctggcaaaaccgtttggtttgtgcccagcatcaagtccgggaatgacattgccaactgtctccgcaaaaatggaaagagagtgatccagctttctcggaagacattcgataccgaataccagaaaacgaagaacaacgactgggactacgtcgtgacaaccgatattagcgagatgggcgccaatttcagagctgaccgcgttatcgatcctcggagatgcctgaaacccgtgattctgaaggacgggccggaacgcgtcatcctcgccggccctatgcccgtgacagttgcgtccgctgcccagcggagaggacgcatcggccggaaccacaataaagagggggatcagtatatttacatgggacagcccctgaacaatgacgaggatcatgcccactggaccgaagctaagatgcttctggacaacatcaatacgcctgagggcattatccccgccctctttgaacctgagagagaaaagagcgcggccattgatggggagtatcgcctgagaggagaggctcggaaaaccttcgtggaactgatgcgcagaggcgacctcccggtctggctttcttacaaggtggcctccgaggggtttcaatatagcgatcggcgctggtgcttcgacggcgaaagaaacaatcaggtcctggaggaaaacatggatgtggagatctggacaaaagagggagaacggaagaaactgagaccccgctggctcgacgctcggacctactccgaccctctggcccttagagagtttaaggagttcgctgccggccgccggtctgttagcggggatctgatcctcgagattggaaaactgccccagcacctgacacagagagcgcaaaatgccctcgacaaccttgtgatgctgcataattccgaacagggcgggcgggcttatcgccacgccatggaggagctgcctgataccatcgaaacactcatgctgcttgctctgattgccgtgctcaccggaggcgtcacgctgtttttcctgtctggcagagggctcggaaagacaagcatcggccttctgtgtgttatggcctccagcgtgctgctctggatggcttctgtggagccccattggattgcggcctccatcatcctggaatttttccttatggtcctgctcattccggagcctgaccggcagcgcacaccccaggataaccaactggcttacgtggttatcgggctgctctttatgattcttaccgtggccgccaatgagatgggactgctggaaacaaccaagaaagacctcggcatcgggcacgtcgctgtggagaaccaccatcacgccgcgatgctggatgtcgaccttcatcctgccagcgcttggacactgtacgccgtggctacgaccattatcacacccatgatgagacacaccattgaaaacacaaccgccaatatctctctcacggcgatcgccaaccaggctgccattctgatgggactggataagggctggcctatctccaaaatggacattggcgttcccctccttgctctggggtgctatagccaggtgaatccgctgaccctcacagccgctgtcctgatgcttgtggcccattacgcgatcattggacctggcctgcaagccaaggctacccgggaggcccagaaacgcacagctgccgggatcatgaagaaccccaccgttgatggaatcgtggccattgacctcgatcccgtcgtgtatgacgcgaagttcgaaaaacagctgggccagatcatgctgctcattctttgtacgtctcaaatcctgctgatgagaacaacctgggctctctgcgagagcattacactggccaccgggcctcttaccacactgtgggagggatccccgggcaagttttggaatacgaccatcgctgtgtctatggccaacatcttccggggcagctacctcgccggggctggactggccttctccctgatgaaaagcctcggcgggggacgcagaggcacaggggcgcagggagaaacccttggcgagaagtggaaacggcagctgaatcagctgtccaagtctgaatttaacacatataagagaagcggcattatggaggttgaccgctccgaagccaaagaggggctcaagcggggagagaccacgaaacacgctgtctctagaggcacagccaagctgcgctggttcgtggaacggaatcttgtgaaacccgaggggaaggtcatcgatctgggatgtggcagagggggatggagctactattgcgctggcctcaagaaagttaccgaagtgaagggctacaccaaagggggacctggccacgaggaacccattcctatggccacatacgggtggaacctggtgaagctgcattccggaaaagacgtctttttcattccccctgagaagtgtgataccctcctttgcgacattggcgagtctagcccgaatcccacaatcgaagaggggcgcacgctgcgggtgctgaaaatggttgaaccttggctcagaggaaaccaattttgtattaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacatcgtgagcgcggtcaatatgacatctcgcatgctgctgaaccggttcaccatggcccacagaaaaccgacgtatgagcgcgatgtggacctcggcgctgggaccagacacgtggccgtcgaacctgaggttgctaacctggatattatcggacagcggattgaaaatatcaagcatgagcacaaatccacatggcattacgacgaggataacccctataagacctgggcctaccacggcagctatgaagtgaaaccctctgggtccgctagctccatggtgaatggagtcgtgaaacttctgacaaagccttgggacgttattcccatggtgacccaaatcgccatgacagataccacgccttttggccagcagcgcgtcttcaaagagaaggtggacacaagaaccccgaaagcgaagcggggcaccgcccaaatcatggaagttacagctaaatggctctgggggtttctgagcagaaacaagaagccccggatttgtacgcgcgaggagttcaccagaaaagtgcggtctaatgccgctatcggagccgtctttgtggacgagaaccagtggaatagcgccaaggaggcggttgaagatgagcgcttctgggaccttgtgcatagagaacgggagctgcacaaacagggcaagtgcgctacatgcgtctacaacatgatggggaaacgcgaaaagaagctcggagagtttggcaaagccaaggggtccagagccatttggtacatgtggctgggcgctcggttcctggagttcgaagccctcggatttatgaatgaggatcactggttctctcgcgaaaacagcctgtccggcgtggagggggagggacttcataaactgggctatatcctcagagacatttctaagatccctgggggaaatatgtacgctgatgacaccgccggctgggatacacggatcaccgaagacgatctgcagaacgaggcgcgcattacagacatcatggaacccgagcacgcccttctggctaaaagcatttttaagctcacctatcaaaataaagtcgtgagagttcagcggcctgccaagaacgggacggtgatggatgtcatctcccgcagagaccagcggggctctggacaggtgggcacctacgggctgaatacattcaccaacatggaagctcaactgattagacagatggagagcgagggaatcttttcccccagcgaactcgagacaccgaacctggccgaacgcgtgcttgattggctggagaagtatggcgttgaacggctcaaaagaatggcgatctctggggacgactgtgtggtcaagcctattgatgaccgcttcgccaccgctctgacggcccttaatgatatgggaaaagtgcggaaggacatcccccagtgggagccttccaaaggctggaacgattggcagcaagttcccttttgcagccatcacttccaccagctgattatgaaggacgggagagagatcgtggtcccttgtcgcaatcaggatgaactcgtgggccgggctagagtctctcagggagccggctggtccctgcgcgagacagcttgcctgggaaagagctacgcccaaatgtggcagctcatgtattttcatcggagagacctgcgccttgcggccaacgctatttgttccgccgtgcccgttgattggatcccgacctctcggacaacctggagcattcacgcccatcaccagtggatgacgaccgaagacatgctgtccgtgtggaatagagtctggatcgaggaaaacccttggatggaggataaaacacatatcagctcttggggagacgtgccctacctcggcaagcgggaggaccaatggtgcgggtccctgattggacttaccgctagagccacatgggcgaccaatatccaggttgctattaaccaggtgcgccggctgatcggcaatgaaaactacctcgattatatgacaagcatgaaaagattcaagaatgagtctgaccccgaaggggccctgtggtga

SEQ ID NO: 19013 - RNA, 9879 nt, synthetic construct
  misc_feature 1..9879: note = derived and/or modified CDS sequence (opt5) from DENV-1__FJ898382__SS-prME
  source 1..9879: mol_type = other RNA
agcgtgaccatgctgctcatgctgatgcccaccgcccttgctttccacctgacgaccagaggaggggaacctcatatgatcgtctccaagcaggaacgggggaaatctctcctgtttaagaccagcgccggcgttaacatgtgcacccttatcgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaaaattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggaccctttctctattgccgctcgcggctacatctccacaagagtgggaatgggcgaggccgccgctatttttatgaccgcgacaccccctgggagcgtggaagccttcccgcagtctaatgctgtcatccaggatgaggaacgggacatccccgagcgcagctggaactccggatatgagtggattacagattttcctggcaagaccgtttggttcgtgccctctatcaaaagcgggaatgacattgccaactgtctcagaaagaatggaaaacgggtgatccagctttccagaaagacattcgataccgaataccaaaagacgaaaaacaacgactgggactacgtcgtgacaaccgatatttctgagatgggcgccaattttcgcgctgaccgggttatcgatcctagacgctgcctgaagcccgtgattctgaaagacgggccggaacgggtcatcctcgccggccctatgcccgtgacagttgcgagcgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctcttcgaacctgagcgcgaaaagtccgcggccattgatggggagtatagactgcggggagaggctcgcaagacctttgtggaactgatgagacggggcgacctcccggtctggcttagctacaaagtggcctctgaggggttccaatattccgatcgcagatggtgctttgacggcgaacggaacaatcaggtcctggaggaaaacatggatgtggagatctggacaaaggagggagaacgcaagaaactgcgcccccggtggctcgacgctagaacctacagcgaccctctggcccttcgcgagttcaaagaatttgctgccggccggagatccgtttctagcgatctgatcctcgagattgggaagctgccccagcacctgacacagcgggcgcaaaatgccctcgacaaccttgtgatgctgcataattccgaacagggaggccgcgcttatagacacgccatggaggagctgcctgataccatcgaaacactcatgctgcttgctctgattgccgtgctcaccgggggagtcacgctgttctttctgtctggccggggcctcgggaaaacaagcatcggacttctgtgtgttatggcctccagcgtgctgctctggatggcttctgtggagccccattggattgcggcctccatcatcctggagttctttcttatggtcctgctcattccggagcctgaccgccagagaacaccccaggataaccaactggcttacgtggttatcggcctcctgttcatgattcttaccgtggccgccaatgagatggggctgctggaaacaaccaagaaggacctcggaatcggccacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatggggctggataaaggatggcctatctccaagatggacattggcgttcccctccttgctctgggctgctatagccaggtgaatccgctgaccctcacagccgctgtcctgatgcttgtggcccattacgcgatcattgggcctggactgcaagccaaagctacccgcgaggcccagaagagaacagctgccggcatcatgaaaaaccccaccgttgatgggatcgtggccattgacctcgatcccgtcgtgtatgacgcgaagtttgaaaagcagctgggacagatcatgctgctcattctttgtacgtctcaaatcctgctgatgcggacaacctgggctctctgcgagagcattacactggccaccggccctcttaccacactgtgggaggggtccccgggaaaattctggaatacgaccatcgctgtgtctatggccaacatcttccgcggcagctacctcgccggcgctgggctggccttttccctgatgaaaagcctcggaggcgggagacggggaacaggcgcgcagggggaaacccttggagagaaatggaagagacagctgaatcagctgtccaaatctgagttcaacacatataagcgcagcggcattatggaggttgaccggtccgaagccaaggagggcctcaaaagaggggagaccacgaagcacgctgtctctcgcggaacagccaaactgcggtggtttgtggaaagaaatcttgtgaagcccgagggcaaagtcatcgatctggggtgtggacgcggcgggtggagctactattgcgctggactcaagaaggttaccgaagtgaaaggctacaccaagggcgggcctggacacgaggaacccattcctatggccacatacggctggaacctggtgaaactgcattccgggaaggacgtcttctttattccccctgagaaatgtgataccctcctttgcgacattggagagtctagcccgaatcccacaatcgaagagggccggacgctgagagtgctgaagatggttgaaccttggctccgcgggaaccaattctgtattaaaatcctgaatccctatatgccttccgtggtcgagacccttgagcagatgcagcggaagcacggaggcatgctggtgagaaaccccctcagccgcaattctacacatgaaatgtactgggtttcctgcggcaccgggaacatcgtgagcgcggtcaatatgacatctcggatgctgctgaacagatttaccatggcccaccgcaagccgacgtatgagagagatgtggacctcggagctggcacccggcacgtggccgtcgaacctgaggttgctaacctggatattatcgggcagcgcattgaaaatatcaaacatgagcacaagtccacatggcattacgacgaggataacccctataaaacctgggcctaccacggaagctatgaagtgaagccctctggctccgctagctccatggtgaatggggtcgtgaaacttctgacaaagccttgggacgttattcccatggtgacccaaatcgccatgacagataccacgcctttcggacagcagagagtctttaaggagaaagtggacacacggaccccgaaggcgaaaagaggcaccgcccaaatcatggaagttacagctaagtggctctggggcttcctgagccggaacaaaaagccccgcatttgtacgagagaggaatttacccggaaggtgcgctctaatgccgctatcggggccgtcttcgtggacgagaaccagtggaatagcgccaaagaggcggttgaagatgagagattttgggaccttgtgcatcgggaacgcgagctgcacaagcagggaaaatgcgctacatgcgtctacaacatgatgggcaagagagagaaaaagctcggggagttcggaaaggccaaaggctcccgggccatttggtacatgtggctgggggctcgcttcctggagtttgaagccctcggcttcatgaatgaggatcactggttttctagagaaaacagcctgtccggagtggagggcgaggggcttcataagctgggatatatcctccgggacatttctaaaatccctggcgggaatatgtacgctgatgacaccgccggatgggatacacgcatcaccgaagacgatctgcagaacgaggcgagaattacagacatcatggaacccgagcacgcccttctggctaagagcattttcaaactcacctatcaaaataaggtcgtgcgggttcagcgccctgccaaaaacggcacggtgatggatgtcatctccagacgggaccagagagggtctggccaggtgggaacctacggcctgaatacatttaccaacatggaagctcaactgattcgccagatggagagcgaggggatcttctcccccagcgaactcgagacaccgaacctggccgaacgggtgcttgattggctggagaagtatggagttgaaagactcaagcgcatggcgatctctggcgacgactgtgtggtcaaacctattgatgaccggtttgccaccgctctgacggcccttaatgatatggggaaggtgagaaaagacatcccccagtgggagccttccaagggatggaacgattggcagcaagttcccttctgcagccatcactttcaccagctgattatgaaagacggccgcgagatcgtggtcccttgtcggaatcaggatgaactcgtggggagagctcgcgtctctcagggcgccggatggtccctgcgggagacagcttgcctgggcaagagctacgcccaaatgtggcagctcatgtatttccatagacgcgacctgcggcttgcggccaacgctatttgttccgccgtgcccgttgattggatcccgacctctagaacaacctggagcattcacgcccatcaccagtggatgacgaccgaagacatgctgtccgtgtggaatcgggtctggatcgaggaaaacccttggatggaggataagacacatatcagctcttggggagacgtgccctacctcggaaaaagagaggaccaatggtgcggctccctgattgggcttaccgctcgcgccacatgggcgaccaatatccaggttgctattaaccaggtgcggagactgatcggaaatgaaaactacctcgattatatgacaagcatgaagcgctttaaaaatgagtctgaccccgaaggcgccctgtggtga

SEQ ID NO: 19014 - RNA, 9879 nt, synthetic construct
  misc_feature 1..9879: note = derived and/or modified CDS sequence (opt5) from DENV-1__FJ898383__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaacatgtgcacccttattgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctatcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccaggccgcgggaccttggcatctcggcaaactggagcttgattttgacctgtgcgaagggacgaccgtcgtggttgatgagcactgcggaaaccggggccccagcctcagaacaaccacagtgaccggcaagatcattcacgaatggtgttgccggtcctgtacgctgcctcccctgcgcttcagaggggaggacggatgctggtatggcatggagatccggccggtcaaagaaaaggaggaaaatcttgtgaaaagcatggtttctgctgggtccggagaggtggacagcttttccctcggcctgctgtgtatttctatcatgattgaagaggtcatgagaagccgctggtcccggagaatgctcatgacagggaccctggccgtgttctttcttctgatcatgggacagctcacatggaacgatctgattcgcctgtgcatcatggttggcgccaatgcttctgacagaatgggcatggggaccacctaccttgccctgatggcgacattcaaaatgcggcctatgtttgctgtgggactcctgttccgcagactcacgagccgggaggtcctgcttctgaccatcggcctctccctggtggcctctgtggaactgcccaacagccttgaggaactgggggatggactcgccatgggcattatgatcctgaagctcctgacagactttcaatcccatcagctttgggctaccctgctcagcctgacattcattaaaaccacgttttctctgcactatgcctggaagacaatggctatggtcctttccatcgttagcctgttccccctctgtctgtctaccacctcccagaaaacaacctggctccctgtgctgcttgggagcctgggatgcaagccgctgacaatgtttctcattgccgagaataagatctggggccgcagatcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacgatgaaaatcaaggatgaggagcgggacgataccctgacaattcttctgaaagccaccctcctggctgtttctggagtgtatcctctcagcatccccgccacactgttcgtctggtacttctggcaaaagaaaaagcagcgctccggcgtgctttgggacaccccttctcccccggaagtcgagagagccgtgctggatgacggcatttatcggatcatgcagcgcgggctgctcggaagaagccaggttggcgtgggggtctttcaagaaaacgtgttccatacgatgtggcacgttacccggggagctgtgctgatgtaccagggcaagagacttgagccttcctgggccagcgtcaaaaaggacctgatttcttacgggggaggctggcgcctccagggctcctggaatacaggggaggaagtccaggtgatcgcggttgagcccggcaagaaccctaagaatgtccaaaccgctcccggcacatttaaaaccccggaaggggaggtgggagccattgccctggatttcaagcctggcacaagcgggtctcccatcgtgaaccgggaaggaaagatcgtcggcctctatggcaatggggtggttacgacctccggaacatacgtgagcgctattgcccaggcgaaggcttcccaggagggccctctgcccgagatcgaagacgaggtctttagaaagcgcaaccttaccattatggatctgcaccccgggtctggaaaaacccggagatatctgcctgccatcgtgcgcgaagccattaagcggaaactcagaacactgatccttgctccgacgcgcgttgtggccagcgagatggctgaagccctgaagggcatgcccatccggtaccaaaccacagcggtcaagtccgagcataccgggaaagagattgtggacctcatgtgccacgccacattcaccatgagactgctgagccctgttcgggtgcccaattataacatgatcattatggatgaagctcattttacggacccttcttccatcgccgctcgcggctacattagcacaagagtcggaatgggcgaggccgccgctatcttcatgaccgcgacaccccctgggtctgtggaagcctttccgcagagcaatgctgtgatccaggatgaggaacgggacattcccgagcgctcctggaactctggatatgagtggatcacagatttccctggcaagaccgtctggtttgttcccagcattaaatccgggaatgacatcgccaactgtctcagaaagaatggaaaacgggtgattcagctttctagaaagacattcgataccgaataccaaaagacgaaaaacaacgactgggactacgtggtcacaaccgatatcagcgagatgggcgccaatttccgcgctgaccgggtgattgatcctagacgctgcctgaagcccgttatcctgaaagacgggccggaacgggtgatcctcgccggccctatgcccgtcacagtggcgtccgctgcccagagacgcggacggattggcagaaaccacaataaggagggggatcagtatatctacatgggacagcccctgaacaatgacgaggatcatgcccactggaccgaagctaaaatgcttctggacaacattaatacgcctgagggcatcattcccgccctctttgaacctgagcgcgaaaagagcgcggccatcgatggggagtatagactgcggggagaggctcgcaagaccttcgttgaactgatgagacggggcgacctcccggtgtggctttcttacaaagtcgcctccgaggggtttcaatatagcgatcgcagatggtgcttcgacggcgaacggaacaatcaggtgctggaggaaaacatggatgtcgagatctggacaaaggagggagaacgcaagaagctgcgcccccggtggctcgacgctagaacctactccgaccctctggcccttcgcgagtttaaagagttcgctgccggccggagatctgtgagcggggatctgattctcgagatcggaaagctgccccagcacctgacacagcgggcgcaaaatgccctcgacaaccttgttatgctgcataattccgaacagggcgggcgcgcttatagacacgccatggaggagctgcctgataccattgaaacactcatgctgcttgctctgatcgccgtgctcaccggaggcgtgacgctgtttttcctgtctggccgggggctcggaaaaacaagcattggccttctgtgtgtcatggcctccagcgttctgctctggatggcttctgtggagccccattggatcgcggcctccatcattctggaatttttccttatggtgctgctcatcccggagcctgaccgccagagaacaccccaggataaccaactggcttacgtcgtgattgggctgctctttatgatccttaccgttgccgccaatgagatgggactgctggaaacaaccaagaaggacctcggcattgggcacgtggctgtcgagaaccaccatcacgccgcgatgctggatgtggaccttcatcctgccagcgcttggacactgtacgccgtcgctacgaccatcattacacccatgatgcggcacaccatcgaaaacacaaccgccaatatctctctcacggcgattgccaaccaggctgccatcctgatgggactggataaaggctggcctatttccaagatggacatcggcgtgcccctccttgctctggggtgctatagccaggttaatccgctgaccctcacagccgctgtgctgatgcttgtcgcccattacgcgattatcggacctggcctgcaagccaaagctacccgcgaggcccagaagagaacagctgccgggatcatgaaaaaccccaccgtggatggaattgttgccatcgacctcgatcccgtggtctatgacgcgaagttcgaaaagcagctgggccagattatgctgctcatcctttgtacgtctcaaattctgctgatgcggacaacctgggctctctgcgagagcatcacactggccaccgggcctcttaccacactgtgggagggatccccgggcaaattttggaatacgaccatcgctgtgtctatggccaacattttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcatcatggaggtggaccggtccgaagccaaggaggggctcaaaagaggagagaccacgaagcacgctgtttctcgcggcacagccaaactgcggtggttcgtcgaaagaaatcttgtgaagcccgaggggaaagtgattgatctgggatgtggccgcgggggatggagctactattgcgctggcctcaagaaggtcaccgaagttaaaggctacaccaaaggcgggcctgggcacgaggaacccatccctatggccacatacgggtggaacctggtgaaactgcattccggaaaggacgtgtttttcattccccctgagaaatgtgataccctcctttgcgacatcggcgagtctagcccgaatcccacaattgaagaggggcggacgctgagagtcctgaagatggtggaaccttggctccgcggaaaccaattttgtatcaaaatcctgaatccctatatgccttccgttgtggagacccttgagcagatgcagcggaagcacggcggcatgctggtcagaaaccccctcagccgcaattctacacatgaaatgtactgggtgtcctgcgggaccggaaacattgttagcgcggtgaatatgacatctcggatgctgctgaacagattcaccatggcccaccgcaagccgacgtatgagagagatgtcgacctcggcgctgggacccggcacgtggccgtggaacctgaggtcgctaacctggatatcattggacagcgcatcgaaaatattaaacatgagcacaagtccacatggcattacgacgaggataacccctataaaacctgggcctaccacggcagctatgaagttaagccctctgggtccgctagctccatggtgaatggagtggtcaaacttctgacaaagccttgggacgtgatccccatggttacccaaatcgccatgacagataccacgccttttggccagcagagagtgttcaaggagaaagtcgacacacggaccccgaaggcgaaaagaggcaccgcccaaattatggaagtgacagctaagtggctctgggggtttctgagccggaacaaaaagccccgcatctgtacgagagaggagttcacccggaaggttcgctctaatgccgctattggagccgtgtttgtcgacgagaaccagtggaatagcgccaaagaggcggtggaagatgagagattctgggaccttgttcatcgggaacgcgagctgcacaagcagggcaaatgcgctacatgcgtgtacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtcgagggggagggacttcataagctgggctatattctccgggacatctctaaaatccctgggggaaatatgtacgctgatgacaccgccggctgggatacacgcattaccgaagacgatctgcagaacgaggcgagaatcacagacattatggaacccgagcacgcccttctggctaagagcatctttaaactcacctatcaaaataaggtggtccgggtgcagcgccctgccaaaaacgggacggttatggatgtgatttccagacgggaccagagaggctctggacaggtcggcacctacgggctgaatacattcaccaacatggaagctcaactgatccgccagatggagagcgagggaatcttttcccccagcgaactcgagacaccgaacctggccgaacgggtgcttgattggctggagaagtatggcgtggaaagactcaagcgcatggcgatttctggggacgactgtgttgtgaaacctatcgatgaccggttcgccaccgctctgacggcccttaatgatatgggaaaggtcagaaaagacattccccagtgggagccttccaagggctggaacgattggcagcaagtgcccttttgcagccatcacttccaccagctgatcatgaaagacgggcgcgagattgttgtgccttgtcggaatcaggatgaactcgtcggcagagctcgcgtgtctcagggagccggctggtccctgcgggagacagcttgcctgggaaagagctacgcccaaatgtggcagctcatgtattttcatagacgcgacctgcggcttgcggccaacgctatctgttccgccgtccccgtggattggattccgacctctagaacaacctggagcatccacgcccatcaccagtggatgacgaccgaagacatgctgtccgtttggaatcgggtgtggatcgaggaaaacccttggatggaggataagacacatattagctcttggggagacgtcccctacctcggcaaaagagaggaccaatggtgcgggtccctgatcggacttaccgctcgcgccacatgggcgaccaatattcaggtggctatcaaccaggttcggagactgattggcaatgaaaactacctcgattatatgacaagcatgaagcgcttcaaaaatgagtctgaccccgaaggggccctgtggtga

SEQ ID NO: 19015 - RNA, 9879 nt, synthetic construct
  misc_feature 1..9879: note = derived and/or modified CDS sequence (opt5) from DENV-1__FJ898384__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagacaagcgccggcgttaacatgtgcacccttatcgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccattttcctggcgcatgccatcgggacatctatcacccagaagggaattatctttattcttctgatgctcgtcacccctagcatggctatgagatgcgtgggcatcgggtcccgggatttcgttgagggactgagcggcgccacatgggtggacgtcgtgcttgagcacgggtcttgtgtgacgaccatggctaaggataaacccacactggacattgaactcctgaagaccgaggtcacaaaccctgccgttctgcgcaaactctgcatcgaagcgaagatttccaataccacgacagatagcagatgtccgacccaaggagaggccaccctggtggaagaacaagacgctaactttgtgtgccggcgcacattcgtcgatagaggctggggcaatgggtgtggactttttggcaaagggtctctgattacctgcgccaagttcaagtgcgtgacaaaactcgagggaaagatcgttcagtacgaaaacctgaaatattccgtgattgtcacggtgcacaccggcgaccagcatcaagttgggaatgagagcacagaacacggaaccacagctaccatcacgccccaggccccttctaccgagattcagcttacagactacggcgccctgaccctcgattgtagcccccggacaggcctggactttaacgaaatggtgctgctcaccatgaaggagaaaagctggctggtccataagcagtggttccttgatctgcctctcccctggacgtccggggcttctacaagccaagagacctggaatcgccaggacctgcttgtgacatttaaaaccgcgcacgccaagaagcaggaagtcgtggttctgggatcccaagagggcgctatgcacaccgccctcacaggggccacggaaatccagaccagcggaacaaccacaattttcgctggccatctgaaatgcagactgaagatggataaactcaccctgaaggggatgtcttatgtgatgtgtacgggctccttcaaacttgagaaggaagtcgccgagacacagcacggaaccgtgctggttcagatcaagtacgagggcaccgacgcgccgtgcaaaatcccttttagcacacaagatgaaaagggggtgacccagaacggacggctcattacagctaatcccatcgtcacggacaaagagaagcctgtgaacattgaagccgagccgcccttcggcgagtcttatatcgtgattggggccggagaaaaagctctgaagctgagctggtttaagaaaggctcctctatcgggaagatgttcgaggccaccgctagaggcgcccgccggatggcgatccttggagatacagcctgggactttggcagcattgggggagttttcacctccgtcggcaaactcgtgcatcagatctttgggacagcttacggagtgctgttcagcggcgtctcttggaccatgaagattgggatcggcgtgctgctcacgtggctgggacttaattccagaagcacctctctgtccatgacatgtattgccgttggcctcgtgaccctgtacctgggggtcatggtgcaggctgatagcggatgcgttatcaactggaaaggccgcgaacttaagtgtgggtccggaatttttgtgacaaatgaggtccacacctggacagaacaatataagttccaggccgactctcctaaacggctcagcgcggccatcggcaaggcttgggaggagggggtgtgcggcatcagatccgccacccgcctggaaaacattatgtggaaacagatctctaacgagctgaatcatattctcctggaaaacgacatgaaacttacggttgtggtcggagatgtggctggcatcctggcccaggggaaaaagatgattcggccgcaacccatggagtacaaatatagctggaagtcctggggaaaggccaaaatcatcggcgctgacgtgcagaatacaacctttattatcgatgggcctaacacccccgaatgtcctgacgatcagagagcgtggaatatttgggaggtcgaggactacggattcggcatctttacaaccaacatttggctcaagctgcgcgatagctatacgcaggtttgcgaccaccggctgatgtctgccgctatcaaagattccaaggccgtgcacgccgacatgggctactggatcgaaagcgagaaaaatgaaacatggaaacttgctagagcctctttcattgaggtgaagacctgtatctggcccaagtcccatacactctggagcaacggggtcctggaatctgagatgattatcccgaagatttatggaggccctatcagccaacacaattaccgccccgggtacttcacccagacagcgggaccttggcatctgggcaaactcgagctggattttgacctttgcgaagggaccacggtggttgtggatgagcactgcggaaaccggggcccctccctgagaaccacaaccgtcacaggcaagatcattcacgaatggtgttgccggagctgtaccctccctcccctgcgcttcaaaggggaggacggatgctggtatggcatggagatcagaccggtgaaggaaaaggaggaaaatctggttaaatctatggtgtccgctgggagcggagaggtcgactccttttctcttggcctcctgtgtattagcatcatgattgaagaggtgatgcggtccagatggtctcgcaagatgctgatgacggggacactcgccgttttctttctgcttatcatgggacagctgacctggaacgatctcattcggctgtgcatcatggtgggcgccaatgctagcgacagaatgggcatggggacaacctacctggcccttatggcgaccttcaaaatgcgccctatgtttgctgtcggactcctgttcagacggctgacatcccgcgaggtgctcctgcttacgatcggcctgtctctcgtggccagcgtcgaactgcccaactccctggaggaacttggggatggactggccatgggcattatgatcctcaagctgctcaccgactttcaaagccatcagctgtgggctacacttctgtctctcaccttcattagaacaaccttttccctgcactatgcctggaaaacgatggctatggttctgagcatcgtgtctcttttccccctgtgtctctccacaaccagccagaagaccacatggctgcctgtgctcctggggtctcttggatgcaagccgctgaccatgtttctgattgccgagaataaaatctggggccggaagtcctggcccctcaacgaaggcatcatggcggtcgggattgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacaatgaaaatcaaggatgaggagcgcgacgatacgctcaccattctgcttaaagccacactgctcgctgtgagcggagtctatcctctgtccatccccgccaccctcttcgtgtggtacttctggcaaaagaagaaacagagatctggcgtcctgtgggacacaccttcccctcccgaagtggagcgggccgttcttgatgacggcatttatcgcatcatgcagagagggctgctgggacggtcccaggtgggcgtcggggtgtttcaagaaaacgttttccataccatgtggcacgtgacgcgcggagctgtcctcatgtaccagggcaagagactggagcccagctgggcctctgtgaaaaaggaccttatttcctacgggggaggctggcggctgcagggcagctggaataccggggaggaagtgcaggttatcgcggtcgagcccggcaagaatcctaagaatgtgcaaacagctcccggcacctttaagacatctgaaggggaggtgggagccattgccctcgatttcaaaccgggcacctccgggagccctatcgtcaacagagaaggaaagatcgtgggcctgtatggcaatggggttgtgacaacgtccggaacctacgtctctgctattgcccaggcgaaagctagccaggagggccccctccctgagatcgaagacgaggtgtttcgcaagcggaacctgacaattatggatcttcaccccgggtccggaaaaaccagacgctatctgcccgccatcgttcgggaagccattaagagacgcctgcggaccctcatcctggctcctacaagagtggtcgccagcgagatggctgaagcccttaagggcatgccgatccgctaccaaacgaccgcggtgaaatctgagcatacagggaaggagattgttgacctgatgtgccacgccaccttcacaatgcggctcctgtcccccgtgagagtccctaattataacatgatcattatggatgaagctcattttaccgaccccagctctatcgccgctcggggctacattagcacgcgcgtgggaatgggcgaggccgccgctatcttcatgacagcgacccctcccgggtccgtggaagcctttcctcagtctaatgctgtcatccaggatgaggaaagagacattccggagcggagctggaactccggatatgagtggatcaccgatttccccggcaaaacagtttggtttgtgccttctattaagagcgggaatgacatcgccaactgtctgcgcaaaaatggaaagagagtgattcagctctcccggaagaccttcgatacagaataccagaaaaccaagaacaacgactgggactacgtcgtgacgacagatatcagcgagatgggcgccaatttcagagctgaccgcgttattgatccccggagatgccttaaacctgtgatcctgaaggacgggcccgaacgcgtcatcctggccggcccgatgcctgtgaccgttgcgtctgctgcccagcggagaggacgcattggccggaaccacaataaagagggggatcagtatatctacatgggacagcccctcaacaatgacgaggatcatgcccactggacagaagctaagatgctgcttgacaacattaatacccccgagggcatcattcctgccctgtttgaacccgagagagaaaagtccgcggccatcgatggggagtatcgcctcagaggagaggctcggaaaacgttcgtggaactgatgcgcagaggcgacctgcctgtctggctcagctacaaggtggcctccgaggggtttcaatattctgatcggcgctggtgcttcgacggcgaaagaaacaatcaggtccttgaggaaaacatggatgtggagatctggaccaaagagggagaacggaagaaactgagaccgcgctggctggacgctcggacatacagcgaccccctcgccctgagagagtttaaggagttcgctgccggccgccggtccgtttctggggatcttattctggagatcggaaaactccctcagcacctgacccagagagcgcaaaatgccctggacaacctcgtgatgcttcataatagcgaacagggcgggcgggcttatcgccacgccatggaggagctgcccgatacaattgaaaccctgatgctcctggctcttatcgccgtgctgacaggaggcgtcaccctctttttcctgtccggcagagggctgggaaagacgagcattggcctcctttgtgttatggcctcttccgtgctgctgtggatggctagcgtggagcctcattggatcgcggcctctatcattctcgaatttttcctgatggtccttctgatccccgagccggaccggcagcgcacacctcaggataaccaactcgcttacgtggttattgggctgctgtttatgatcctcaccgtggccgccaatgagatgggacttctggaaaccacaaagaaagacctgggcattgggcacgtcgctgtggagaaccaccatcacgccgcgatgctcgatgtcgacctgcatcccgcctccgcttggaccctttacgccgtggctacaacgatcattacccctatgatgagacacacaatcgaaaacaccacagccaatatcagcctgaccgcgattgccaaccaggctgccatcctcatgggactggataagggctggcccatttctaaaatggacatcggcgttcctctgctcgctcttgggtgctatagccaggtgaatcccctgacgctgaccgccgctgtcctcatgctggtggcccattacgcgattatcggaccgggccttcaagccaaggctacacgggaggcccagaaacgcaccgctgccgggatcatgaagaaccctacagttgatggaattgtggccatcgacctggatcccgtcgtgtatgacgcgaagttcgaaaaacagctcggccagattatgctgctgatcctctgtacctcccaaattcttctgatgagaacgacatgggctctgtgcgagtctatcaccctcgccacagggcccctgaccaccctttgggagggaagccctggcaagttttggaatacaacgatcgctgtgtccatggccaacattttccggggcagctacctggccggggctggactcgccttctccctgatgaaatctctgggcgggggacgcagaggcaccggggcgcagggagaaacactcggcgagaagtggaaacggcagcttaatcagctgagcaagtccgaatttaacacctataagagatctggcatcatggaggttgaccgcagcgaagccaaagaggggctgaagcggggagagacaaccaaacacgctgtctccagaggcacggccaagctccgctggttcgtggaacggaatctggtgaaaccggaggggaaggtcattgatcttggatgtggcagagggggatggtcttactattgcgctggcctgaagaaagttacagaagtgaagggctacaccaaagggggacccggccacgaggaacctatccccatggccacctacgggtggaacctcgtgaagctgcatagcggaaaagacgtctttttcattcctcccgagaagtgtgatacactgctctgcgacatcggcgagtccagccctaatccgaccattgaagaggggcgcacacttcgggtgctgaaaatggttgaaccctggctgagaggaaaccaattttgtatcaagatcctcaatccttatatgccctctgtggtcgagacgctggagcagatgcagcgcaagcacggcggcatgcttgtgcggaaccctctgtccagaaatagcacccatgaaatgtactgggtttcttgcgggacaggaaacattgtgtccgcggtcaatatgaccagccgcatgctcctgaaccggttcacaatggcccacagaaaacccacctatgagcgcgatgtggacctgggcgctgggacgagacacgtggccgtcgaaccggaggttgctaacctcgatatcattggacagcggatcgaaaatattaagcatgagcacaaatctacctggcattacgacgaggataacccttataagacatgggcctaccacggctcctatgaagtgaaacccagcgggtccgctagctctatggtgaatggagtcgtgaagctgcttaccaagccctgggacgttatccctatggtgacacaaatcgccatgaccgatacaaccccctttggccagcagcgcgtcttcaaagagaaggtggacacgagaacacctaaagcgaagcggggcaccgcccaaattatggaagttaccgctaaatggctgtgggggtttctcagcagaaacaagaagccgcggatctgtacacgcgaggagttcacgagaaaagtgcggtccaatgccgctattggagccgtctttgtggacgagaaccagtggaactctgccaaggaggcggttgaagatgagcgcttctgggacctggtgcatagagaacgggagcttcacaaacagggcaagtgcgctacctgcgtctacaacatgatggggaaacgcgaaaagaagctgggagagtttggcaaagccaaggggagcagagccatctggtacatgtggctcggcgctcggttcctggagttcgaagccctgggatttatgaatgaggatcactggttctcccgcgaaaactctctcagcggcgtggagggggagggactgcataaacttggctatattctgagagacatctccaagatccccgggggaaatatgtacgctgatgacacagccggctgggatacccggattacagaagacgatctccagaacgaggcgaaaatcaccgacattatggaacctgagcacgccctgcttgctaagtctatctttaaactgacatatcaaaataaggtcgtgcgcgttcagagacccgccaagaacgggaccgtgatggatgtcattagccggcgcgaccagagaggctccggacaggtgggcacgtacgggctcaataccttcacaaacatggaagctcaactgatccggcagatggagagcgagggaatcttttctccttccgaactggagacccccaacctcgccggcagagtgctggattggcttgaaaaacatggggttgagcgcctgaagcggatggcgattagcggagacgactgtgtggtcaaaccgatcgatgacagattcgccacagctctcaccgccctgaatgatatgggcaaggtgcgcaaagacattcctcagtgggaaccctctaaggggtggaacgattggcagcaagttcctttttgctcccaccacttccatcagcttatcatgaaggacggccgggagattgtggtcccctgtagaaatcaggatgagctggtgggacgcgctcgggtcagccagggcgccgggtggtccctcagagaaacggcttgcctgggaaaatcttatgcccaaatgtggcagctgatgtactttcaccgccgggacctcagactggcggccaacgctatctgtagcgccgtgcctgttgattgggtgcccacatcccgcaccacatggagcattcatgcccaccatcagtggatgaccacggaggacatgctttctgtctggaatcgggtgtggatcgaagagaacccgtggatggaagataagacccacgtttccagctggggcgacgtgccttatctggggaaaagagaggaccaatggtgcggatctctcatcggcctgacagctcgggccacctgggcgacaaatattcaggtcgctatcaaccaggtgagacgccttctggggaatgagaactacctcgattacatgaccagcatgaagcggttcaaaaatgaatccgaccccgagggcgccctgtggtga

SEQ ID NO: 19016 - RNA, 9879 nt, synthetic construct
  misc_feature 1..9879: note = derived and/or modified CDS sequence (opt5) from DENV-1__FJ898385__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggaggcgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtatctctattatgatcgaagaggtgatgcggagcagatggtcccgcaagatgctcatgacaggaaccctggctgttttccttctgctcattatgggccagctgacatggaacgacctgatccggctttgcattatggtgggcgccaatgcctctgatagaatggggatgggaaccacctatctggctctcatggccacatttaaaatgcgccctatgttcgcggtcggcctgctctttagacggctgacgagccgcgaggtgcttctgctcaccatcgggctgtccctggtggcttctgtcgaacttcccaacagcctggaggaactcggagacggcctggccatggggatcatgattctcaagctgcttacagatttccaatcccaccagctgtgggccaccctcctgagcctgacatttatcaaaaccacgctttctctgcattacgcttggaagacaatggccatgattctctccatcgttagcctgttccccctctgtctgtctaccacctcccagaagacaacctggcttcctgtgctgctgggaagcctcggctgcaaaccgctgacaatgtttcttattgctgagaataagatctggggcagaaaatcttggcccctgaacgaagggatcatggccgtgggagtcgtgtccattctcctgagctccctcctgaagaacgacgttcctcttgcgggccccctgatcgccgggggaatgctgattgcttgttatgtgatcagcggctctagcgccgatctctccctggagaaagctgccgaggtctcttgggaagaggaagccgagcacagcggggcttcccataatattcttgtggaagttcaggacgatggaacgatgaagatcaaagacgaggagcgggatgacaccctgacaatcctcctgaaggcgaccctcctggccgtgtctggcgtctaccctcttagcattcccgctacactgttcgtgtggtatttttggcaaaagaaaaagcagcgctccggcgtcctgtgggataccccttctcccccggaagtggagagagccgttctcgacgatgggatctaccggattatgcagcgcggactgcttggcagaagccaggtgggggtcggagtgttccaagaaaacgttttccacacgatgtggcacgtgacccggggcgccgtcctgatgtatcaggggaaacgcctcgagccttcctgggctagcgtgaagaaagacctgatctcttacggaggcggctggagactccaggggtcctggaatatgggagaggaagtgcaggttattgccgtcgagcccggcaagaaccctaagaatgtgcaaacagcgcccgggacctttaaaacaccggaaggagaggtgggcgctatcgccctggacttcaagcctgggaccagcggatctcccattgtcaaccgggaaggcaaaatcgtgggcctttacgggaatggagttgtgacaacgtccggcacctatgtcagcgccatcgctcaggccaaggcgtcccaggaggggcctctgcccgagattgaagatgaggtgtttagaaaacgcaacctgacaatcatggacctccatcccggatctggcaagacccggagatacctgcctgctattgttcgcgaagccatcaagcggaaacttagaaccctgattctcgccccgacacgcgtggtcgctagcgagatggccgaagctctgaaggggatgcccatccggtatcaaacgaccgccgtgaaatccgagcacacaggcaaggagatcgttgatctgatgtgccatgcgaccttcacaatgagactccttagccctgtgcgcgtccccaattacaacatgattatcatggacgaagcccactttaccgatccttcttccattgctgcccggggatatatcagcacgagagtgggcatgggggaggctgccgccattttcatgacagctacaccccctggatctgtggaagcgtttccgcagagcaatgccgtcatccaggacgaggaacgggatatccccgagcgctcctggaactctggctacgagtggattaccgacttccctgggaaaacagtttggtttgtgcccagcatcaagtccggaaatgatattgctaactgtctgagaaagaatggcaaacgggtgatccagctgtctcgcaagaccttcgacacagaatatcagaaaaccaagaacaacgattgggactacgtcgtgacgacagacattagcgagatgggggccaattttagagccgatcgggttatcgaccctagacgctgcctcaaacccgtgattctgaaggatggcccggaacgggtcatccttgctggacctatgcccgtgaccgttgcctccgcggctcagagacgcggccggatcgggagaaaccataataaggagggagaccagtacatttatatgggccagcccctgaacaatgatgaggaccacgcccactggacagaagccaaaatgctcctggataacatcaatacccctgaggggattatccccgctctgttcgaacctgagcgcgaaaagagcgccgcgattgacggagagtaccggctcagaggcgaggcccgcaaaacgttcgtggaacttatgagaagaggggatctgccggtctggctgtcttataaggtggcttccgagggctttcaatacagcgaccgcagatggtgcttcgatggagaacggaacaatcaggtcctcgaggaaaacatggacgtggagatctggaccaaagagggcgaacgcaagaaactgagaccccggtggcttgatgccagaacatattccgaccctctggctctccgcgagtttaaggagttcgccgctgggcggagatctgttagcggagacctgatcctggagattggcaagctcccccagcatcttacccagcgcgcccaaaatgcgctggataacctggtgatgctccacaattccgaacaagggggacgggcctacagacatgctatggaggagctgcctgacacaatcgaaacccttatgctgctcgccctgattgctgtgctgacaggcggcgtcaccctctttttcctttctgggcggggactgggcaaaacgagcatcgggctgctctgtgttatggcctccagcgtgctgctttggatggcctctgtggagccccactggattgctgcgtccatcatcctggaatttttcctcatggtcctgctgattccggagcctgatcgccagagaacaccccaggacaaccaactcgcctatgtggttatcggacttctgtttatgattctgaccgtggctgccaatgagatgggcctcctggaaaccacaaagaaagatcttgggatcggacacgtcgccgtggagaaccatcaccatgctaccatgctggacgtcgatctccaccctgccagcgcgtggacactgtacgccgtggctacgaccattatcacacccatgatgcggcataccattgaaaacacaaccgccaatatctctctgacggctatcgccaaccaggcggccattctcatgggccttgacaagggctggcctatctccaaaatggatattggggttcccctgctggctctcggatgctacagccaggtgaatccgctgacccttacagccgctgtcctgatgctcgtggcccactatgctatcattggccctgggctgcaagccaaggcgacccgcgaggcccagaagagaacagctgccggaatcatgaaaaaccccaccgttgacggcatcgtggctattgatctggaccccgtcgtgtacgatgccaagttcgaaaaacagctcgggcagatcatgcttctgattctgtgtacgtctcaaatcctcctgatgcggacaacctgggccctttgcgagagcattacactggcgaccggacctctcaccacactgtgggagggctccccgggcaagttttggaatacgaccatcgctgtgtctatggccaacatcttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatttacaagagaagcgggatcatggaggttgaccggtccgaagccaaagagggacttaagagaggcgagacaacccgccacgcggtctctcgggggacggccaaactgagatggttcgtggaacgcaatctcgtgaagcccgagggaaaggtcattgacctgggctgtgggcggggaggctggagctattactgcgctggcctgaaaaaggttacagaagtgaaagggtataccaagggaggccctgggcatgaggaacccatccctatggccacctacggatggaacctcgtgaaacttcactccggcaaggatgtctttttcacaccccctgagaaatgtgacaccctgctgtgcgatattggggagtctagcccgaatcccacaatcgaagagggaagaacgctccgcgtgctgaagatggttgaaccttggcttcggggcaaccaattttgtattaagatcctgaatccctacatgccttccgtggtcgagaccctcgagcagatgcagagaaaacatggcgggatgctggtgcgcaaccccctgagcagaaattctacacacgaaatgtattgggtttcctgcggaaccggcaacatcgtgagcgctgtcaatatgacatctagaatgctcctgaaccgcttcaccatggcccaccggaagccgacgtacgagagagacgtggatcttggggcgggaacccgccatgtggccgtcgaacctgaggttgctaacctggacattatcggccagagaattgaaaatatcaaacacgagcataagtccacatggcactatgatgaggacaacccctacaaaacctgggcctatcatgggagctacgaagtgaagccctctggatccgctagctccatggtgaatggcgtcgtgaagctcctgacaaaaccttgggatgttattcccatggtgacccaaatcgccatgacagacaccacgccttttggccagcagcgggtcttcaaggagaaagtggatacacgcaccccgaaggctaaaagagggaccgcccaaatcatggaagttacagcgcggtggctttggggatttctgagcagaaacaagaagccccggatttgtacgcgcgaggagttcaccagaaaagtgcggtctaatgccgctatcggcgccgtctttgtggacgagaaccagtggaatagcgctaaggaggccgttgaagacgagcgcttctgggatctcgtgcagaaagaaagagagctgcacaagcaggggaaatgcgccacatgcgtctataacatgatgggaaagcgggaaaagaaactgggcgagtttgggaaggcgaaaggctcccgcgctatttggtacatgtggctcggagccagattcctggagtttgaagcccttggcttcatgaatgaggaccactggttctctcgggaaaacagcctgtccggggtggagggagagggcctccataagctggggtacatccttcgcgatatttctaaaatccctggaggcaatatgtatgctgacgataccgccgggtgggacacaagaatcaccgaagatgacctgcaaaacgaggctaagattacagatatcatggaacccgagcacgccctcctggcgaccagcatttttaaactgacgtaccagaataaggtcgtgcgggttcagcgccctgccaagaacggcaccgtgatggacgtcatctccagacgggatcagcgcggatctggccaagtggggacatatggactcaataccttcacaaacatggaagctcagctgattagacagatggagagcgagggcatcttttcccccagcgaacttgagatcccgaacctggccgaacgggtgctcgactggctggagaaatacggggttgaaagacttaagcgcatggctatttctggagatgactgtgtggtcaaacctatcgacgatcggttcgccaccgcgctgacggccctcaatgacatgggcaaggtgagaaaagatgttccccagtgggagccttccaaggggtggaacgactggcaacaggtgcccttttgcagccatcacttccaccagctgattatgaaggatggccgcgagatcgtcgtgccttgtcggaatcaggacgaactggtcggacgggctcgcgtgtctcaaggcgccgggtggtccctccgggagacagcttgcctgggaaaaagctatgcccagatgtggcagcttatgtactttcatagacgcgatctgcggctcgctgccaacgcgatttgttccgccgttcccgtggactgggtcccgacctctagaacaacctggagcatccacgctcatcaccaatggatgacgaccgaagatatgctgtccgtgtggaatcgcgtttggattgaggaaaacccttggatggaggacaagacacatgtgagctcttggggcgatgtcccctatcttgggaaacgggaggaccagtggtgcggatccctgatcggcctcaccgccagagccacatgggctagcaatatccaggtggccattaaccaggtgcggagactgatcgggaatgaaaactacctggactacatgacctctatgaagcgcttcaaaaatgagggcgatcccgaaggagcgctctggtga

SEQ ID NO: 19017 - RNA, 9879 nt, synthetic construct
  misc_feature 1..9879: note = derived and/or modified CDS sequence (opt5) from DENV-1__GQ868608__SS-prME
  source 1..9879: mol_type = other RNA
tccgtgaccatgctgctgatgctgatgcccaccgcccttgctttccacctgacgaccagaggaggggagcctcatatgatcgtctccaagcaggaacggggaaaatctctcctgtttaagacaagcgccggcgttaacatgtgcacccttattgccatggacctgggggagttctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttaaagggatgagctatgtgatgtgtacaggctctttcaagctggagaaggaagtcgcggagacccagcacggaaccgtgctcgttcagatcaaatacgagggcacagacgctccgtgcaagattcctttttccacccaggatgaaaaaggggtgacacaaaacggacggctgatcacggccaatcccatcgtcaccgacaaggagaaacctgtgaacattgaagccgagccgcccttcggcgagagctatatcgtgattggggctggagaaaaggccctgaaactttcttggtttaaaaagggcagctccatcgggaaaatgttcgaggctacagccagaggcgcgcgccggatggccattctcggagataccgcttgggactttggctctatcgggggagttttcacaagcgtcggcaagctggtgcatcagatctttgggaccgcctacggagtgctgttctccggcgtcagctggacgatgaaaattgggatcggcgtgctcctgacctggcttggactcaattctagatccacaagcctctctatgacctgtattgctgttggcctggtgacactgtaccttggggtcatggtgcaggccgattccggatgcgttatcaactggaagggccgcgaactcaagtgtgggagcggaatttttgtgaccaatgaggtccacacatggaccgaacagtataaattccaagcggactcccctaagcggctgtctgccgctatcggcaaagcctggaaggagggggtgtgcggcattagaagcgctacgcgcctggagaacatcatgtggaaacagatctccaacgaactcaatcatattctgcttgagaacgacatgaagtttacagttgtggtcggagatgtggccggcatcctggcccaggggaaaaagatgattcggccgcagcccatggaatacaagtattcttggaaaagctggggaaaggctaaaatcattggcgcggacgtgcaaaatgccaccttcatcatcgatgggcctaacacccccgagtgtcctgacgatcagagagcttggaatatttgggaagtcgaggactacggatttggcatcttcacaaccaacatttggctcaagctgcgcgattcctatacgcaggtttgcgaccaccggctgatgagcgccgccatcaaagattctaaggctgtgcacgccgacatgggctactggattgagtccgaaaagaatgagacatggaaacttgcgagagctagcttcatcgaagtgaagacctgtatctggcccaaatctcatacactctggtccaacggggtcctggagagcgaaatgattatcccgaagatttatggaggccctatctctcagcacaattaccgccccgggtactttacccaaacagccggaccttggcatctgggcaaactcgagctggatttcgacctttgcgaggggaccacggtggttgtggatgaacactgcggaaaccggggccccagcctgagaaccacaaccgtcacaggcaagattatccacgagtggtgttgccggtcctgtaccctccctcccctgcgctttaagggggaagacggatgctggtatggcatggagatcagaccggtgaaagagaaggaagagaatctggttaaaagcatggtgtctgccgggtccggagaagtcgacagcttctcccttggcctcctgtgtatttctatcatgattgaggaagtgatgcggagcagatggtcccgcaagatgctgatgacggggacactcgctgtctttttcctgcttatcatgggacagctgacctggaacgatctcattcggctgtgcatcatggtgggcgccaatgcgtctgacagaatgggcatggggacaacctacctggctcttatggccacctttaaaatgcgccctatgttcgccgtcggactgctctttagacggctgacaagccgcgaggtgctcctgcttacgattggcctgtccctcgtggcttctgtcgagctgcccaacagcctggaggaacttggggatggactggccatgggcatcatgatcctcaagctgctcaccgacttccagtcccatcaactgtgggctacacttctgagcctcacctttattaagacaaccttctctctgcactatgcctggaaaacgatggcgatggttctgtccatcgtgagcctttttcccctgtgtctctctacaacctcccagaagaccacatggctgcctgtgctcctggggagccttggatgcaaaccgctgaccatgttcctgattgccgaaaataagatctggggcagaaaatcttggcccctcaacgagggcattatggctgtcgggatcgtgtccatcctgcttagctccctgctcaagaacgatgttcctctggccggacccctcattgctggcgggatgctgatcgcctgttacgtgattagcggatctagcgccgacctttccctggaaaaagctgcggaggtctcttgggaggaagaggccgaacatagcggcgcttcccacaatatcctggtggaggttcaggatgacgggacaatgaagattaaggatgaagaacgggacgatatgctcacgatcctgcttaaagccaccctgctcgccgtgtctggagtctatcctctgagcatccccgctacactcttcgtgtggtacttttggcagaagaaaaagcaacgctccggcgtcctgtgggacaccccttctcccccggaggtggaaagagccgttcttgatgacggcatttatcggatcatgcagcgcgggctgctgggaagaagccaggtgggcgtcggggtgttccaggagaacgtttttcatacaatgtggcacgtgacccggggagcggtcctcatgtaccaaggcaaacgcctggaaccttcctgggctagcgtgaagaaggaccttatttcttacgggggaggctggagactgcagggctcctggaatacgggggaggaggtgcaggttatcgccgtcgaacccggcaaaaatcctaagaatgtgcagaccgcccccggcacattcaaaaccagcgagggggaagtgggagctattgccctcgattttaagccgggcacatctgggtcccctatcgtcaaccgggagggaaaaattgtgggcctgtatggcaatggggttgtgaccacaagcggaacgtacgtctccgcgatcgctcaagccaaggcctctcaggaaggccccctccctgagatcgaggacgaagtgttcagaaagcgcaacctgaccattatggatcttcaccccgggagcggaaaaacacggagatatctgcccgctatcgttcgcgaggccattaagcggaaactgagaaccctcatcctggctcctacccgcgtggtcgcctccgaaatggcggaggcccttaagggcatgccgattcggtaccagacaacggctgtgaaaagcgaacataccgggaaggagatcgttgacctgatgtgccacgccacatttaccatgagactcctgtctcccgtgcgcgtccctaattataacatgatcattatggatgaggctcatttcacagacccctccagcatcgccgcccggggctacatttctaccagagtgggaatgggcgaagctgcggccatctttatgacggctacacctcccgggagcgtggaggccttccctcaatccaatgccgtcattcaggatgaggaacgggacatcccggaacgctcttggaacagcggatatgagtggatcaccgattttcccggcaagaccgtttggttcgtgccttccattaaatctgggaatgacatcgctaactgtctgagaaagaatggaaaacgggtgattcagctcagccgcaagacattcgataccgagtaccagaaaacaaagaacaacgactgggactacgtcgtgaccacggatatctccgaaatgggcgccaattttagagcggaccgggttattgatcccagacgctgccttaagcctgtgatcctgaaagacgggcccgagcgggtcattctggctggcccgatgcctgtgacagttgccagcgccgctcaaagacgcggacggatcggcagaaaccacaataaggaaggggatcagtatatctacatgggacagcccctcaacaatgacgaggatcatgcccactggaccgaggcgaaaatgctgcttgacaacattaatacacccgaaggcatcattcctgccctgttcgagcccgaacgcgagaagtctgctgccatcgatggggaatatcggctcagaggagaggctcgcaaaacctttgtggagctgatgagacggggcgacctgcctgtctggctctcctacaaggtggccagcgaagggttccagtattccgatcgcagatggtgctttgacggcgagcggaacaatcaagtccttgaagagaacatggatgtggaaatttggacgaaagagggagagcgcaagaagctgagaccgcggtggctggacgctagaacctactctgaccccctcgccctgcgcgagttcaaagagtttgcggccggccggagaagcgtttccggggatcttatcctggaaatcggaaagctccctcagcacctgacacagcgcgctcagaatgccctggacaacctcgtgatgcttcataattctgagcaaggcgggcgggcttatagacacgccatggaggaactgcccgataccattgagacactgatgctcctggcccttatcgctgtgctgaccggaggcgtcacactcttctttctgagcggccgggggctgggaaaaacctccattggcctcctttgtgttatggcgagctctgtgctgctgtggatggcctccgtggaacctcattggatcgctgccagcattatcctcgagttctttctgatggtccttctgatccccgaaccggaccgccagagaacgcctcaggataaccagctcgcctacgtggttattgggctgctgttcatgatcctcacagtggctgccaatgagatgggacttctggagaccaccaagaaagacctgggcattgggcacgtcgcggtggaaaaccaccatcacgccgctatgctcgatgtcgacctgcatcccgcctctgcttggacactttacgccgtggcgaccacaatcattacgcctatgatgcggcacaccatcgagaacacaaccgccaatatttccctgacagctatcgccaaccaagctgccatcctcatgggactggataagggctggcccattagcaagatggacatcggcgttcctctgctcgctcttgggtgctattctcaggtgaatcccctgaccctgacggccgcggtcctcatgctggtggcccattacgctattatcggaccgggccttcaggccaaagctacccgcgaagcccaaaagagaacagccgcggggattatgaaaaaccctaccgttgatggaatcgtggctatcgacctggatcccgtcgtgtatgacacaaagtttgagaaacagctcggccagattatgctgctgatcctctgtaccagccagattcttctgatgcggacgacatgggccctgtgcgaatccatcaccctcgctacagggcccctgaccaccctttgggagggatctcctggcaagttctggaatacaacgattgccgtgagcatggccaacatcttccgcggctcctacctggctggggccggactcgcgtttagcctgatgaagtccctgggcgggggaagacggggcaccggggcccaaggagagacactcggcgaaaaatggaagcgccagcttaatcagctgtctaaaagcgagttcaacacctataagagatccggcatcatggaagttgaccggtctgaggctaaagaagggctgaagagaggagagacaaccaagcacgccgtcagccgcggcacggctaaactccggtggtttgtggagagaaatctggtgaagccggaagggaaagtcattgatcttggatgtggccgcgggggatggtcctactattgcgccggcctgaagaaagttacagaggtgaagggctacaccaaagggggacccggccacgaggaacctatccccatggcgacctacgggtggaacctcgtgaagctgcattctggaaaggacgtcttctttattcctcccgaaaaatgtgatacactgctctgcgacatcggcgagagctcccctaatccgaccattgaggaagggcggacacttagagtgctgaagatggttgagccctggctgcgcggaaaccagttctgtatcaaaattctcaatccttatatgcccagcgtggtcgaaacgctggagcaaatgcagcggaagcacggcggcatgcttgtgagaaaccctctgtctcgcaattccacccatgagatgtactgggttagctgcgggacaggaaacatcgtgtctgccgtcaatatgacctcccggatgctcctgaacagatttacaatggctcaccgcaaacccacctatgaacgggatgtggacctgggcgccgggacgagacacgtggctgtcgagccggaagttgccaacctcgatatcattggacagcgcatcgagaatattaagcatgaacacaagagcacctggcattacgacgaggataacccttataaaacatgggcttaccacggctcttatgaggtgaagccctccgggagcgcctccagcatggtgaatggagtcgtgaaactgcttaccaagccctgggacgttatccctatggtgacacagattgcgatgaccgatacaacccccttcggccaacagagagtctttaaagaaaaggtggacacgcggacacctaaggccaaacgcggcaccgctcagatcatggaggttaccgccaagtggctgtgggggttcctctctagaaacaaaaagccgcggatctgtacaagagaagagtttacgcggaaagtgcgcagcaatgctgccattggagccgtcttcgtggacgaaaaccaatggaactccgcgaaggaggctgttgaggatgaaagattttgggacctggtgcatcgggagcgcgaacttcacaagcagggcaaatgcgcgacctgcgtctacaacatgatggggaagagagagaaaaagctgggagagttcggcaaagccaaggggtctcgggctatctggtacatgtggctcggcgcccgcttcctggagtttgaggctctgggattcatgaatgaagatcactggtttagcagagagaactccctctctggcgtggaaggggagggactgcataaacttggctatattctgcgggacatcagcaagattcccgggggaaatatgtacgccgatgacacagcgggctgggatacccgcatcacagaggacgatctccagaacgaagccaagatcaccgacattatggagcctgaacacgctctgcttgccaaatccatcttcaagctgacatatcagaataaagtcgtgagagttcaacggcccgctaagaacgggaccgtgatggatgtcatttctcgcagagaccagcggggcagcggacaggtgggcacgtacgggctcaatacctttacaaacatggaggcccagctgatccgccaaatggaatccgagggaattttcagcccttctgagctggaaacccccaacctcgcgggcagagtgctggattggcttgagaaacatggggttgaacggctgaagagaatggccatctccggagacgactgtgtggtcaagccgatcgatgaccgctttgctacagccctcaccgctctgaatgatatgggcaaagtgcggaaggacattcctcagtgggagcccagcaaagggtggaacgattggcagcaggttcctttctgctctcaccactttcatcaacttatcatgaaggacggcagagaaattgtggtcccctgtcgcaatcaggatgagctggtgggacgggccagagtctcccagggcgctgggtggagcctccgcgagacggcctgcctgggaaaatcctatgcgcagatgtggcaactgatgtacttccaccggagagacctccgcctggccgctaacgccatctgttctgccgtgcctgttgattgggtgcccacaagccggaccacatggtccattcatgctcaccatcagtggatgaccacggaagacatgcttagcgtctggaatagagtgtggatcgaggaaaacccgtggatggaggataagacccacatttcttcctggggcgacgttccttatctggggaagcgcgaagaccagtggtgcggaagcctcatcggcctgacagcccgggcgacctgggctacaaatatccaagtggccattaaccaggtcagacggcttatcgggaatgagaactacctggattacatgacctctatgaaaagatttaagaatgagattgaccccgaaggcgccctctggtga

SEQ ID NO: 19018 - RNA, 9879 nt, synthetic construct
  misc_feature 1..9879: note = derived and/or modified CDS sequence (opt5) from DENV-1__GQ199774__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagacgagcgccggcgttaacatgtgcacccttattgcgatggacctgggggagctctgtgaagataccatgacctacaagtgcccgcgcatcacagaggtggaacccgacgatgtggactgttggtgcaataccacggatacctgggtcacatatggaacctgttcccagacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaagacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccattgccacaatcacaccccaggctcctacgtctgagattcagctcaccgactacggcgccctgacactggattgttcccccagaaccggcctcgacttcaacgaaatggtcctgcttacaatgaaagaaaagagctggctggtgcataaacagtggtttctcgatctgcctcttccctggacctccggggcctctacgagccaagagacatggaatcggcaggacctgctcgtcaccttcaagacagctcacgcgaagaaacaggaagtggttgtgctgggatcccaagagggcgccatgcacaccgctctgaccggggccacagaaatccagacgaccggaacaaccacaatttttgccggccatctcaagtgccgcctgaaaatggataaacttaccctgaaagggatgagctatgtcatgtgtacgggctctttcaagctcgagaaggaagtggctgagacacagcacggaaccgttctggtgcagatcaaatacgagggcaccgacgccccgtgcaagatccctttctccacacaagatgaaaaaggggtcacccagaacggaagactgattacagcgaatcccatcgtgacggacaaggagaaacctgtgaacattgaagctgagccgccctttggcgagagctatatcgttattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtctttaccagcgtgggcaagctggtgcatcagatcttcgggacagcctacggagtcctcttttccggcgtgagctggaccatgaaaattgggatcggcgttctgcttacgtggctgggactcaattctcggtccaccagcctgtctatgacatgtattgctgtgggcctgatcaccctttacctcggggtcatggtgcaggccgattccggatgcgttattaactggaagggcagagaactgaagtgtgggagcggaatcttcgtgacaaatgaggtccacacctggacagaacaatataaatttcaggctgactcccctaagcgcctgtctgccgcgatcggcaaagcctgggaggagggggtgtgcggcattcggagcgctaccagactcgaaaacatcatgtggcgccagatttccaacgagctgaatcatatccttctggaaaacgacatgaagttcacggttgtggtcggagatgtggtgggcattctcgcccaggggaaaaagatggtccggccgcaacccatggagcacaaatactcttggaaaagctggggaaaggctaagatcatcggcgccgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacacaggtgtgcgaccaccggcttatgagcgctgcgatcaaagattctaaggccgtccatgctgacatgggctattggatcgaatccgagaaaaatgaaacatggaagctcgccagagccagcttcattgaggtgaagacctgtatctggcccaaatctcacacactgtggtccaacggggttctggaaagcgagatgattatcccgaagatttacggaggccctatctctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcattcatgaatggtgttgccggtcctgtaccctgcctcccctgcgcttcaaaggggaggacggatgctggtacggcatggagatcagaccggtgcgggaaaaggaggaaaatcttgtcaagagcatggtgtctgccgggtccggagaggttgacagcttttccctcggcctgctgtgtatttctatcatgattgaagaggtgatgagaagccgctggtcccggaaaatgctcatgacggggacactggcggtcttctttcttctgatcatgggacagctcacctggaacgatctgattagatcttgcatcatggtgggcgctaatgccagcgaccgcatgggcatggggacaacctatctggcccttatggctaccttcaagatgagacctatgtttgccgtgggactcctgttccggcgcctgacatccagagaggtcctcctgcttacgatcggcctgtctctcgttgcgagcgtggaactgcccaactccctggaggaacttggggatggactggctatgggcattatgatcctcaaactgctcaccgactttcaaagctaccagctgtgggccacacttctgtctctcaccttcattaagacaaccttttccctgcactatgcctggaaaacgatggctatggtgctgagcatcgtctctcttctgcccctctgtctgtccacaaccagccagaagaccacatggctccctgtgctgcttgggtctctgggatgcaagccgctgaccatgttcctcattgccgagaataaaatctggggccggaagtcctggcccctgaacgaaggcatcatggctgttgggattgtgagcatccttctgtccagcctcctgaaaaacgatgtccctctcgccggacccctgattgcgggcgggatgcttatcgcctgttacgtgatttctggaagctccgctgacctgtctctggagaaggccgctgaggttagctgggaagaggaagccgagcattccggcgcctctcacaatatcctcgtggaagtccaggatgacgggacaatgaaaatcaaggatgaggagcgcgacgatacgctgaccattcttctgaaagctacactcctggcggtgagcggagtctatcctctctccatccccgccaccctgtttgtgtggtacttctggcaaaagaagaaacagagatctggcgttctttgggacacacctagccctcccgaagtggagcgggctgtcctggatgacggcatttatcgcatcatgcagagagggctgctcggacggtcccaggtgggcgttggggtgttccaagaaaacgtctttcataccatgtggcacgtgacgcgcggagccgtgctgatgtaccagggcaagagacttgagcccagctgggcctctgttaaaaaggacctgatttcctacgggggaggctggcggctccagggcagctggaataccggggaggaagtccaggtgatcgctgtggagcccggcaagaatcctaagaatgtccaaacagcccccggcaccttcaagacaccggaaggggaggtgggagcgattgctctggattttaaacctggcacctctgggtcccccatcgttaacagagaaggaaagatcgtgggcctctatggcaatggggtcgtgacaacgagcggaacctacgtttccgccattgcccaggctaaagcctctcaggagggccctctgcccgagatcgaagacgaggtgttccgcaagcggaaccttacaattatggatctgcaccccgggagcggaaaaaccagacgctatctgcctgcgatcgtccgggaagctattaagagaaagctccgcaccctgatccttgccccgacacgggtggttgcctccgagatggctgaagccctgaaaggcatgcccatcagataccaaacgaccgctgtcaagagcgagcatacagggcgcgagattgtcgacctcatgtgccacgccacctttacaatgcggctgctgtctcctgtgagagtgcccaattataacatgatcattatggatgaagcgcatttcaccgacccttccagcatcgccgctcggggctacatttctacgcgcgtcggaatgggcgaggccgctgccatctttatgacagccacaccccctgggagcgttgaggctttcccgcagtccaatgcggtgatccaggatgaggaaagagacattcccgagcggtcttggaacagcggatatgagtggatcaccgattttcctggcaaaacagtgtggttcgtcccctccattaagtctgggaatgacatcgccaactgtctccgcaaaaatggaaagagagtgattcagcttagccggaagacctttgatacagaataccagaagaccaagaacaacgactgggactacgttgtgacgacagatatctccgagatgggcgctaatttcagagccgaccgcgtcattgatcctcggagatgcctgaaacccgtgatcctgaaggacgggccggaacgcgttatcctcgccggccctatgcccgtgaccgtcgctagcgccgcgcagcggagaggacgcattggccggaaccacaataaagagggggatcagtatatctacatgggacagcccctgaacaatgacgaggatcatgctcactggacagaagccaagatgcttctggacaacattaatacccctgagggcatcattcccgccctcttcgaacctgagagagaaaagtctgctgccatcgatggggagtatcgcctgagaggagaggcgcggaaaacgtttgtggaactgatgcgcagaggcgacctcccggtctggctttcctacaaggtggccagcgaggggttccaatattccgatcggcgctggtgctttgacggcgaaagaaacaatcaggttctggaggaaaacatggatgtggagatctggaccaaagagggagaacggaagaaactgagaccccgctggctcgacgctcggacatactctgaccctctggcccttagagagttcaaggaatttgctgccggccgccggagcgtgtccggggatctgattctcgagatcggaaaactgccccagcacctgacccagagagctcaaaatgccctcgacaaccttgtcatgctgcataattctgaacagggcgggcgggcgtatcgccacgccatggaggagctgcctgatacaattgaaaccctcatgctgcttgctctgatcgccgttctcacaggaggcgtgaccctgttctttctgagcggcagagggctcggaaagacgtccattggccttctgtgtgtgatggctagctctgccctgctctggatggcctccgtcgagccccattggatcgctgcgagcatcattctggagttctttcttatggtgctgctcatcccggagcctgaccggcagcgcacaccccaggataaccaactggcctacgttgtgattgggctcctgttcatgatccttaccgtcgctgccaatgagatgggactgctggaaaccacaaagaaagacctcggcattgggcacgtggccgtcgagaaccaccatcacgctaccatgctggatgtggaccttcatcctgcctctgcgtggacactgtacgccgttgctacgaccatcattacacccatgatgagacacaccatcgaaaacacaaccgccaatatctccctcacggctattgccaaccaggcggccatcctgatgggactggataagggctggcctattagcaaaatggacatcggcgtgcccctccttgctctggggtgctattctcaggtcaatccgctgaccctcacagccgctgtgctgatgcttgttgcccattacgctattatcggacctggcctgcaagccaaggcgacccgggaggcccagaaacgcacagctgccgggatcatgaagaaccccaccgtggatggaattgtcgctatcgacctcgatcccgtggtgtatgacgccaagtttgaaaaacagctgggccagattatgctgctcatcctttgtacgagccaaattctgctgatgagaacaacctgggccctctgcgagtccatcacactggcgaccgggcctcttaccacactgtgggagggatctccgggcaagttctggaatacgaccatcgctgttagcatggccaacatttttcggggctcctacctcgctggggccggactggccttcagcctgatgaaatccctcggcgggggacgcagaggcacaggggctcagggagaaacccttggcgagaagtggaaacggcagctgaatcagctgtctaagagcgagttcaacacatataagagatccggcatcatggaggtcgaccgctctgaagccaaagaggggctccggagaggagagaccacgaagcacgcggtgagccgcggcacagccaaactgcggtggtttgtggaaagaaatcttgtcaagcccgaggggaaagttattgatctgggatgtggccgcgggggatggtcctactattgcgctggcctcaagaaggtgaccgaagtgaaaggctacaccaaagggggacctggccacgaggaacccatccctatggccacatacgggtggaacctggtcaaactgcattctggaaaggacgtgttctttattccccctgagaaatgtgataccctcctttgcgacatcggcgagagctccccgaatcccacaattgaagaggggcggacgctgagagttctgaagatggtggaaccttggctccgcggaaaccaattctgtatcaaaatcctgaatccctatatgcctagcgtcgtggagacccttgagcacatgcagcggaagcatggcggcatgctggttagaaaccccctctctcgcaattccacacacgaaatgtactgggtgagctgcgggaccggaaacattgtctctgctgtgaatatgacatcccggatgctgctgaacagatttaccatggcccaccgcaagccgacgtatgagagagatgtggacctcggcgcggggacccggcatgtcgccgttgaacctgaggtggctaacctggatatcattggacagcgcatcgaaaatattaaacacgagcataagagcacatggcactacgacgaggataacccctataaaacctgggcctaccatggctcttatgaagtgaagccctccgggagcgcttccagcatggtcaatggagtggttaaacttctgacaaagccttgggacgtgatccccatggtcacccagatcgccatgacagataccacgcctttcggccaacagagagtgtttaaggagaaagttgacacacggaccccgaaggctaaaagaggcaccgcccagattatggaagtgacagcgcggtggctctgggggttcctgtctcgcaacaagaaacccagaatctgtacgcgggaggaatttacccgcaaggtcagaagcaatgccgctattggagccgtgttcgttgacgagaaccaatggaactccgctaaggaggccgtggaagatgagcggttttgggaccttgtccaccgcgaaagagagctgcacaaacagggcaagtgcgccacatgcgtgtacaacatgatggggaaacgggaaaagaaactcggagagttcggcaaggcgaaggggtctcgcgctatctggtacatgtggctgggcgccagatttctggagttcgaagccctcggattcatgaatgaggatcattggtttagccgggaaaactccctgtctggcgtcgagggggagggacttcacaaactgggctatattctccgcgacatcagcaagatccctgggggaaatatgtacgctgatgacaccgccggctgggatacaagaattaccgaagacgatctgcagaacgaggctaaaatcacagacattatggaacccgagcatgcccttctggcgacctccatcttcaagctcacgtatcagaataaagtggttcgggtgcaacgccctgccaagaacgggaccgtcatggatgtgatttctagacgggaccagagaggcagcggacaggtgggcacatacgggctgaatacctttacaaacatggaagctcagctgatccgccaaatggagtccgagggaatcttcagcccctctgaactcgagaccccgaacctggccgaacgggttcttgattggctggagaaatatggcgtggaaagactcaagcgcatggctatttccggggacgactgtgtcgtgaagcctatcgatgaccggtttgccacggcgctgacagcccttaatgatatgggaaaagttagaaaggacattccccagtgggagcctagcaaaggctggaacgattggcaacaggtgcccttctgctctcaccactttcatcaactgatcatgaaggacgggcgcgagattgtcgtgccttgtcggaatcaggatgaactcgtcggcagagctcgcgtgtcccagggagccggctggagcctgcgggagaccgcttgcctggggaaatcctacgcccagatgtggcaactcatgtatttccacagacgcgacctgcggcttgctgccaacgcgatctgttctgccgttcccgtggattgggtcccgacaagcagaaccacgtggtccattcatgctcaccatcagtggatgaccacagaagacatgctgagcgtgtggaatcgggtttggatcgaggaaaacccttggatggaggataagacccacatctcttcctggggagacgtgccctacctcggcaagagagaggaccagtggtgcgggagcctgattggacttacagcccgcgccacctgggctacaaatatccaagtcgccattaaccaggtgcggagactgatcggcaatgaaaactacctcgattatatgacctctatgaaacgctttaagaatgagagcgaccccgaaggggcgctgtggtga

SEQ ID NO: 19019 - RNA, 9879 nt, synthetic construct
  misc_feature 1..9879: note = derived and/or modified CDS sequence (opt5) from DENV-1__GQ199775__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagacgagcgccggagttaacatgtgcacccttattgcgatggacctgggggaactctgtgaagataccatgacctacaagtgcccgcgcatcacagaggtggaacccgacgatgtggactgttggtgcaataccacggatacctgggtcacatatggaacctgttcccagacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaagacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccattgccacaatcacaccccaggctcctacgtctgagattcagctcaccgactacggcgccctgacactggattgttcccccagaaccggcctcgacttcaacgaaatggtcctgcttacaatgaaagaaaagagctggctggtgcataaacagtggtttctcgatctgcctcttccctggacctccggggcctctacgagccaagagacatggaatcggcaggacctgctcgtcaccttcaagacagctcacgcgaagaaacaggaagtggttgtgctgggatcccaagagggcgccatgcacaccgctctgaccggggccacagaaatccagacgaccggaacaaccacaatttttgccggccatctcaagtgccgcctgaaaatggataaacttaccctgaaagggatgagctatgtcatgtgtacgggctctttcaagctcgagaaggaagtggctgagacacagcacggaaccgttctggtgcagatcaaatacgagggcaccgacgccccgtgcaagatccctttctccacacaagatgaaaaaggggtcacccagaacggaagactgattacagcgaatcccatcgtgacggacaaggagaaacctgtgaacattgaagctgagccgccctttggcgagagctatatcgttattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtctttaccagcgtgggcaagctggtgcatcagatcttcgggacagcctacggagtcctcttttccggcgtgagctggaccatgaaaattgggatcggcgttctgcttacgtggctgggactcaattctcggtccaccagcctgtctatgacatgtattgctgtgggcctgatcaccctttacctcggggtcatggtgcaggccgattccggatgcgttattaactggaagggcagagaactgaagtgtgggagcggaatcttcgtgacaaatgaggtccacacctggacagaacaatataaatttcaggctgactcccctaagcgcctgtctgccgcgatcggcaaagcctgggaggagggggtgtgcggcattcggagcgctaccagactcgaaaacatcatgtggcgccagatttccaacgagctgaatcatatccttctggaaaacgacatgaagttcacggttgtggtcggagatgtggtgggcattctcgcccaggggaaaaagatggtccggccgcaacccatggagcacaaatactcttggaaaagctggggaaaggctaagatcatcggcgccgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacacaggtgtgcgaccaccggcttatgagcgctgcgatcaaagattctaaggccgtccatgctgacatgggctattggatcgaatccgagaaaaatgaaacatggaagctcgccagagccagcttcattgaggtgaagacctgtatctggcccaaatctcacacactgtggtccaacggggttctggaaagcgagatgattatcccgaagatttacggaggccctatctctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcattcatgaatggtgttgccggtcctgtaccctgcctcccctgcgcttcaaaggggaggacggatgctggtacggcatggagatcagaccggtgcgggaaaaggaggaaaatcttgtcaagagcatggtgtctgccgggtccggagaggttgacagcttttccctcggcctgctgtgtatttctatcatgattgaagaggtgatgagaagccgctggtcccggaaaatgctcatgacggggacactggcggtcttctttcttctgatcatgggacagctcacctggaacgatctgattagatcttgcatcatggtgggcgctaatgccagcgaccgcatgggcatggggacaacctatctggcccttatggctaccttcaagatgagacctatgtttgccgtgggactcctgttccggcgcctgacatccagagaggtcctcctgcttacgatcggcctgtctctcgttgcgagcgtggaactgcccaactccctggaggaacttggggatggactggctatgggcattatgatcctcaaactgctcaccgactttcaaagctaccagctgtgggccacacttctgtctctcaccttcattaagacaaccttttccctgcactatgcctggaaaacgatggctatggtgctgagcatcgtctctcttctgcccctctgtctgtccacaaccagccagaagaccacatggctccctgtgctgcttgggtctctgggatgcaagccgctgaccatgttcctcattgccgagaataaaatctggggccggaagtcctggcccctgaacgaaggcatcatggctgttgggattgtgagcatccttctgtccagcctcctgaaaaacgatgtccctctcgccggacccctgattgcgggcgggatgcttatcgcctgttacgtgatttctggaagctccgctgacctgtctctggagaaggccgctgaggttagctgggaagaggaagccgagcattccggcgcctctcacaatatcctcgtggaagtccaggatgacgggacaatgaaaatcaaggatgaggagcgcgacgatacgctgaccattcttctgaaagctacactcctggcggtgagcggagtctatcctctctccatccccgccaccctgtttgtgtggtacttctggcaaaagaagaaacagagatctggcgttctttgggacacacctagccctcccgaagtggagcgggctgtcctggatgacggcatttatcgcatcatgcagagagggctgctcggacggtcccaggtgggcgttggggtgttccaagaaaacgtctttcataccatgtggcacgtgacgcgcggagccgtgctgatgtaccagggcaagagacttgagcccagctgggcctctgttaaaaaggacctgatttcctacgggggaggctggcggctccagggcagctggaataccggggaggaagtccaggtgatcgctgtggagcccggcaagaatcctaagaatgtccaaacagcccccggcaccttcaagacaccggaaggggaggtgggagcgattgctctggattttaaacctggcacctctgggtcccccatcgttaacagagaaggaaagatcgtgggcctctatggcaatggggtcgtgacaacgagcggaacctacgtttccgccattgcccaggctaaagcctctcaggagggccctctgcccgagatcgaagacgaggtgttccgcaagcggaaccttacaattatggatctgcaccccgggagcggaaaaaccagacgctatctgcctgcgatcgtccgggaagctattaagagaaagctccgcaccctgatccttgccccgacacgggtggttgcctccgagatggctgaagccctgaaaggcatgcccatcagataccaaacgaccgctgtcaagagcgagcatacagggcgcgagattgtcgacctcatgtgccacgccacctttacaatgcggctgctgtctcctgtgagagtgcccaattataacatgatcattatggatgaagcgcatttcaccgacccttccagcatcgccgctcggggctacatttctacgcgcgtcggaatgggcgaggccgctgccatctttatgacagccacaccccctgggagcgttgaggctttcccgcagtccaatgcggtgatccaggatgaggaaagagacattcccgagcggtcttggaacagcggatatgagtggatcaccgattttcctggcaaaacagtgtggttcgtcccctccattaagtctgggaatgacatcgccaactgtctccgcaaaaatggaaagagagtgattcagcttagccggaagacctttgatacagaataccagaagaccaagaacaacgactgggactacgttgtgacgacagatatctccgagatgggcgctaatttcagagccgaccgcgtcattgatcctcggagatgcctgaaacccgtgatcctgaaggacgggccggaacgcgttatcctcgccggccctatgcccgtgaccgtcgctagcgccgcgcagcggagaggacgcattggccggaaccacaataaagagggggatcagtatatctacatgggacagcccctgaacaatgacgaggatcatgctcactggacagaagccaagatgcttctggacaacattaatacccctgagggcatcattcccgccctcttcgaacctgagagagaaaagtctgctgccatcgatggggagtatcgcctgagaggagaggcgcggaaaacgtttgtggaactgatgcgcagaggcgacctcccggtctggctttcctacaaggtggccagcgaggggttccaatattccgatcggcgctggtgctttgacggcgaaagaaacaatcaggttctggaggaaaacatggatgtggagatctggaccaaagagggagaacggaagaaactgagaccccgctggctcgacgctcggacatactctgaccctctggcccttagagagttcaaggaatttgctgccggccgccggagcgtgtccggggatctgattctcgagatcggaaaactgccccagcacctgacccagagagctcaaaatgccctcgacaaccttgtcatgctgcataattctgaacagggcgggcgggcgtatcgccacgccatggaggagctgcctgatacaattgaaaccctcatgctgcttgctctgatcgccgttctcacaggaggcgtgaccctgttctttctgagcggcagagggctcggaaagacgtccattggccttctgtgtgtgatggctagctctgccctgctctggatggcctccgtcgagccccattggatcgctgcgagcatcattctggagttctttcttatggtgctgctcatcccggagcctgaccggcagcgcacaccccaggataaccaactggcctacgttgtgattgggctcctgttcatgatccttaccgtcgctgccaatgagatgggactgctggaaaccacaaagaaagacctcggcattgggcacgtggccgtcgagaaccaccatcacgctaccatgctggatgtggaccttcatcctgcctctgcgtggacactgtacgccgttgctacgaccatcattacacccatgatgagacacaccatcgaaaacacaaccgccaatatctccctcacggctattgccaaccaggcggccatcctgatgggactggataagggctggcctattagcaaaatggacatcggcgtgcccctccttgctctggggtgctattctcaggtcaatccgctgaccctcacagccgctgtgctgatgcttgttgcccattacgctattatcggacctggcctgcaagccaaggcgacccgggaggcccagaaacgcacagctgccgggatcatgaagaaccccaccgtggatggaattgtcgctatcgacctcgatcccgtggtgtatgacgccaagtttgaaaaacagctgggccagattatgctgctcatcctttgtacgagccaaattctgctgatgagaacaacctgggccctctgcgagtccatcacactggcgaccgggcctcttaccacactgtgggagggatctccgggcaagttctggaatacgaccatcgctgttagcatggccaacatttttcggggctcctacctcgctggggccggactggccttcagcctgatgaaatccctcggcgggggacgcagaggcacaggggctcagggagaaacccttggcgagaagtggaaacggcagctgaatcagctgtctaagagcgagttcaacacatataagagatccggcatcatggaggtcgaccgctctgaagccaaagaggggctccggagaggagagaccacgaagcacgcggtgagccgcggcacagccaaactgcggtggtttgtggaaagaaatcttgtcaagcccgaggggaaagttattgatctgggatgtggccgcgggggatggtcctactattgcgctggcctcaagaaggtgaccgaagtgaaaggctacaccaaagggggacctggccacgaggaacccatccctatggccacatacgggtggaacctggtcaaactgcattctggaaaggacgtgttctttattccccctgagaaatgtgataccctcctttgcgacatcggcgagagctccccgaatcccacaattgaagaggggcggacgctgagagttctgaagatggtggaaccttggctccgcggaaaccaattctgtatcaaaatcctgaatccctatatgcctagcgtcgtggagacccttgagcacatgcagcggaagcatggcggcatgctggttagaaaccccctctctcgcaattccacacacgaaatgtactgggtgagctgcgggaccggaaacattgtctctgctgtgaatatgacatcccggatgctgctgaacagatttaccatggcccaccgcaagccgacgtatgagagagatgtggacctcggcgcggggacccggcatgtcgccgttgaacctgaggtggctaacctggatatcattggacagcgcatcgaaaatattaaacacgagcataagagcacatggcactacgacgaggataacccctataaaacctgggcctaccatggctcttatgaagtgaagccctccgggagcgcttccagcatggtcaatggagtggttaaacttctgacaaagccttgggacgtgatccccatggtcacccagatcgccatgacagataccacgcctttcggccaacagagagtgtttaaggagaaagttgacacacggaccccgaaggctaaaagaggcaccgcccagattatggaagtgacagcgcggtggctctgggggttcctgtctcgcaacaagaaacccagaatctggacgcgggaggaagtcacccgcaaggtgagaagcaatgccggaattggcgctggggttggagacgagaaccaatggaactccgccaagaaaggcgtggaggatgaacggttttgggaccttgtccaccgcgagagagaactgcacaagcaggggaaatgtgctacatgcgtgtacaacatgatgggcaagcgggagaaaaagctcggagagttcggcaaggccaaagggtctcgcgccatctggtacatgtggctgggagcgagatttctggagttcgaggctctcggctttatgaatgaagatcattggttcagccgggagaactccctgtctggggtcgaaggagagggccttcacaagctggggtatattctccgcgacatcagcaaaatccctggcggaaatatgtacgccgatgacaccgccggctgggatacaagaattaccgaggacgatctgcagaacgaagctaagatcacagacattatggagcccgaacatgcccttctggctacctccatcttcaaactcacgtatcagaataaggtggttcgggtgcaacgccctgccaaaaacgggaccgtcatggatgtgatttctagacgggaccagagaggaagcggccaggtggggacatacggactgaatacctttacaaacatggaggcgcagctgatccgccaaatggaatccgagggcatcttcagcccctctgagctcgaaaccccgaacctggccgagcgggttcttgattggctggaaaagtatggggtggagagactcaagcgcatggctatttccggcgacgactgcgtcgtgaaacctatcgatgaccggtttgccacggctctgacagcccttaatgatatgggaaaggttagaaaagacattccccagtgggaacctagcaagggctggaacgattggcaacaggtgcccttctgttctcaccactttcatcaactgatcatgaaagacgggcgcgagattgtcgtgccttgccggaatcaggatgagctcgtcggcagagcgcgcgtgtcccagggcgccgggtggagcctgcgggaaaccgcttgtctgggaaagtcctacgcccagatgtggcaactcatgtatttccacagacgcgacctgcggcttgctgccaacgctatctgctctgccgttcccgtggattgggtcccgacaagcagaaccacgtggtccattcatgcgcaccatcagtggatgaccacagaggacatgctgagcgtgtggaatcgggtttggatcgaagagaacccttggatggaagataagacccacatctcttcctggggcgacgtgccctacctcgggaaaagagaggaccagtggtgtggcagcctgattggacttacagcccgcgctacctgggccacaaatatccaagtcgccattaaccaggtgcggagactgatcggcaatgagaactacctcgattatatgacctctatgaagcgctttaaaaatgaaagcgaccccgagggggctctgtggtga

SEQ ID NO: 19020 - RNA, 9876 nt, synthetic construct
  misc_feature 1..9876: note = derived and/or modified CDS sequence (opt5) from DENV-1__FJ882546__SS-prME
  source 1..9876: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagaccagcgccggcgttaacatgtgcacccttattgcgatggacctgggggaactctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatgggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggatcatgattctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaacggaaaaagctcagaccccgctggctggacgctcggacctactccgaccctcttgccctgagagagttcaaagaatttgctgccgggcgcaagtctgttagcggagatctcatcctggagatcggcaagctgccccagcacctcacacagcgggcgcagaatgcccttgacaacctggtgatgctgcataattccgaacaagggggacgggcttatcggcacgccatggaggagctccctgataccattgaaacactgatgcttctggctctcatcgccgtgctgaccggcggcgtcacgctgttctttctctctgggcgcggacttggcaaaacaagcattgggctgctgtgtgttatggcctccagcgtgctcctgtggatggcttctgtggagccccattggatcgcggcctccattatccttgagttctttctgatggtcctcctgatcccggagcctgacagacagcggacaccccaggataaccagctggcttacgtggttattggactccttttcatgatcctgaccgtggccgccaatgagatgggcctgctcgaaacaaccaagaaagacctggggattggacacgtcgctgtggagaaccaccatcacgccgcgatgcttgatgtcgacctgcatcctgccagcgcttggacactctacgccgtggctacgaccatcattacacccatgatgcgccacaccatcgaaaacacaaccgccaatatttctctgacggcgatcgccaaccaagctgccatcctgatgggcctcgataagggctggcctatttccaaaatggacatcggggttccccttctggctctgggatgctatagccaggtgaatccgctcaccctgacagccgctgtccttatgctggtggcccattacgcgattatcggccctgggctccaggccaaggctaccagagaggcccaaaagcggacagctgccggaattatgaaaaaccccaccgttgatggcatcgtggccatcgacctggatcccgtcgtgtatgacgcgaagtttgaaaaacagctggggcagattatgctccttatcctgtgtacgtctcagattctgctcatgcgcacaacctgggctctgtgcgagagcatcacacttgccaccggacctctgaccacactctgggagggctccccgggcaagttctggaatacgaccattgctgtgtctatggccaacatctttagagggagctacctggccggagctggcctggccttctccctcatgaaaagccttgggggaggccggcgcgggacaggagcgcaaggcgaaaccctgggcgagaagtggaagagacagctgaatcagctctccaaatctgagttcaacacatataagcggagcgggatcatggaggttgacagatccgaagccaaagagggactgaagcgcggcgagaccacgaaacacgctgtctctcgggggacagccaaacttagatggtttgtggaacgcaatctggtgaagcccgagggaaaagtcattgatctcggctgtgggcggggaggctggagctactattgcgctggcctgaagaaagttaccgaagtgaaggggtacaccaaaggaggccctgggcacgaggaacccatccctatggccacatacggatggaacctggtgaagctccattccggcaaagacgtcttctttattccccctgagaagtgtgatacccttctgtgcgacatcggggagtctagcccgaatcccacaattgaagagggaagaacgctgcgcgtgctcaagatggttgaaccttggctgcggggcaaccagttctgtatcaaaattcttaatccctatatgccttccgtggtcgagaccctggagcaaatgcagagaaagcacggcgggatgctcgtgcgcaaccccctgagcagaaattctacacatgaaatgtactgggtttcctgcggaaccggcaacatcgtgagcgcggtcaatatgacatctagaatgctgctcaaccgctttaccatggcccaccggaaaccgacgtatgagagagatgtggacctggggaccggaacacgccacgtggctgtcgaacctgaggttgccaaccttgatatcattggccagagaatcgaaaatattaagcatgagcacaaatccacctggcattacgacgaggataacccctataagacatgggcttaccacgggagctatgaagtgaagccctctggatccgccagctccatggtgaatggcgtcgtgaaactgctcaccaagccttgggacgttatccccatggtgacacagattgctatgaccgagctgcatcttggccaacagcgggtcttcaaagaaaaggtggatacgcgcacacctagagccaaacgggggaccgcgcagatcatggagatgaccgccagatggctgtggggatttctcagccggaacaagatcccgcgcatttgtacaagagaagagttcacgcggaaggttcgctctaatgctgccatcggcgctgtgtttgtcgacgagaaccaatggaatagcgccaaagaagccgtggaggacgaaagattctgggatctggttcaccgggagcgcgaactgcacaagcaggggaaatgcgcgacctgcgtgtacaacatgatgggaaagagagagaaaaagctcggcgagtttgggaaggctaaaggctcccgggccatttggtacatgtggctgggagcccgcttccttgaatttgaggctctgggcttcatgaatgaagaccattggttctctagagagaacagcctctccggggtcgagggagaaggcctgcacaaacttgggtatatcctgcgggatatttctaaaatccccggaggcaatatgtacgccgacgatacagctgggtgggacacccgcatcacagaggatgacctccagaacgaagccaagattaccgatatcatggagcctgaacatgcgctgctggccaaagctatttttaagctcacatatcagaataaagtggtcagagtgcaacggcccgccaagaacggcaccgttatggacgtgatcagccgcagagatcagcggggatccggccaggtcgggacgtacggactgaataccttcacaaacatggaggctcagcttattagacaaatggagtctgaagagatctttagcccttccgaactggagacccccaacctcgccgaacgcgcgctggactggcttgagaagtatggcgtggagcggctgaaaagaatggccatcagcggggatgactgtgtggttaagccgattgacgatcgcttcgctacagccctcaccgctctgaatgacatgggaaaagtgcggaaggatatccctcagtgggaaccctctaaaggctggaacgactggcagcaggtccctttttgctcccaccacttccatcaactgattatgaaggatgggagagagatcgtggttccctgtcgcaatcaggacgaactcgtgggccgggccagagtcagccagggagctggctggtctctgcgcgagacggcctgccttgggaagtcctacgcgcagatgtggcaactgatgtattttcaccggagagatctccgcctggccgctaacgccatttgtagcgccgtgcctgtcgactgggtgcccacatcccggaccacatggtctatccatgctcaccatcagtggatgaccacggaagatatgcttagcgtttggaatagagtgtggattgaggagaacccgtggatggaagacaaaacccacatctccagctgggaggatgtcccttacctgggaaagcgggaagaccagtggtgcggctctctcatcgggctgacagccagagcgacctgggctacaaatattcaagtggccatcaaccaggttcgccggctgattggaaatgagaactacctcgactatatgacctccatgaaaagattcaagaatgagagcgatcccgaaggcgccctgtggtga

SEQ ID NO: 19021 - RNA, 9879 nt, synthetic construct
  misc_feature 1..9879: note = derived and/or modified CDS sequence (opt5) from DENV-1__KF921935__SS-prME
  source 1..9879: mol_type = other RNA
tccgtgaccatgctgctcatgctgatgcccaccgcccttgctttccacctgacgaccagaggaggggagcctcatatgatcgtgtccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaagagatgattcggccgcaacccatggaatacaagtattcctggaaatcttggggaaaggccaagatcatcggcgccgacgtgcagaataccacatttattatcgatgggcctaacacccccgagtgtcctgacgatcagagagcttggaatatttgggaggtggaagactacggattcggcatctttacgacaaacatttggctgaaacttcgcgatagccacacccaggtctgcgaccaccggctcatgtccgcggccatcaaggatagcaaagctgttcatgccgacatgggctattggatcgagtctgaaaagaatgagacatggaaactggccagagcttccttcattgaagtgaagacctgtatctggcccaagagccacacactgtggtctaacggggtgctcgagtccgagatgattatcccgaaaatttacggaggccctatcagccaacataattatcgccccgggtacttcacccagacggccggaccttggcacctgggcaaacttgaactggattttgacctctgcgaggggaccacagtcgtggttgatgaacactgcggaaaccggggcccctctctgagaaccacaaccgtgacgggcaaaatcattcatgagtggtgttgccggagctgtacactgcctccccttcgcttcagaggggaggacggatgctggtacggcatggaaatccggccggtcaaggagaaagaagagaatctcgtgaagtccatggttagcgcggggtctggagaagtggactcctttagcctgggcctgctctgtatttccatcatgattgaggaggtcatgagatctcgctggagccggaagatgctgatgaccgggacacttgctgtgttctttctgctcatcatgggacagctgacctggaacgatctgattagactttgcatcatggttggcgccaatgcctccgaccgcatgggcatggggaccacatatctggctctcatggccacgttcaaaatgagacctatgtttgcggtgggactcctgttccggcgcctgacctctagagaagtccttctgctcacaatcggcctgagcctggtggcttccgtggagcttcccaactctctggaggaactcggggatggactggccatgggcattatgatcctcaagctgcttaccgactttcaaagccaccagctgtgggccacactcctgtccctgaccttcattaaaacgacatttagccttcattacgcttggaagaccatggccatggtcctgtctatcgtttccctcttccccctgtgtctcagcaccacatctcagaaaaccacatggctgcctgtgcttctggggtccctgggatgcaagccgctcacgatgtttctgattgctgaaaataagatctggggccggcgcagctggccccttaacgagggcatcatggccgtggggattgtctctatcctgctctccagcctgctcaaaaacgatgtgcctctggcgggaccccttattgccggcgggatgctgatcgcttgttatgttatttccggaagctctgccgacctgagcctcgagaaggctgccgaagtgtcctgggaggaagaggccgaacactctggcgctagccataatatcctggtcgaggtgcaggatgacgggaccatgaaaatcaaggatgaggaaagagacgatacacttaccattctgctcaaagcgacactgctcgccgtttccggagtgtaccctctgtctatccccgctacccttttcgtctggtatttctggcaaaagaaaaagcagcggagcggcgtgctgtgggacacgcctagccctcccgaggtcgaacgcgccgtgctggatgacggcatttacagaatcatgcagcgggggctcctgggacgctctcaggttggcgtgggggtctttcaagagaacgtgttccacaccatgtggcacgttacaagaggagccgtgcttatgtatcagggcaagcggctggagcccagctgggcttccgtcaaaaaggacctcattagctacgggggaggctggagactgcagggctcttggaataccggggaagaggtccaggtgatcgccgttgaacccggcaagaatcctaagaatgtccaaacagcgcccggcacctttaaaacaccggagggggaagtgggagctattgccctcgatttcaagcctggcacgtccgggagccccatcgtgaaccgcgagggaaagatcgtcggcctgtacggcaatggggtggttaccacatctggaacctatgtgtccgccattgctcaggccaaagcgagccaggagggccctcttcccgaaatcgaggacgaagtctttcggaagagaaacctgaccattatggatctgcatcccgggtccggaaaaacacgccggtacctccctgctatcgtgagagaggccattaagcgcaaactgcggacgcttatcctggccccgaccagagttgtggcttctgaaatggccgaggctctcaagggcatgcccatccgctatcaaacaaccgccgtcaagagcgagcacacagggaaagaaattgtggacctgatgtgccatgcgaccttcacgatgcggctgctctcccctgttagagtgcccaattacaacatgatcattatggatgaggcccactttacagaccctagctctatcgctgcccggggctatatttccacccgcgtcggaatgggcgaagctgccgccatcttcatgaccgctacaccccctgggagcgtggaggcgtttccgcagtctaatgccgtgatccaggatgaagagagagacattcccgagcggagctggaactccggatacgaatggatcaccgatttccctggcaagacagtctggtttgttccctctattaaaagcgggaatgacatcgctaactgtcttcgcaagaatggaaaaagagtgattcagctgtcccggaagaccttcgatacggagtatcaaaagaccaagaacaacgactgggactacgtggtcaccacagatatctctgaaatgggcgccaatttcagagccgaccgcgtgattgatcctcggagatgcctgaagcccgttatcctcaaagacgggccggagcgcgtgatcctggctggccctatgcccgtcaccgtggccagcgcggctcagcggagaggacgcattggccggaaccataataaggagggggatcagtacatctatatgggacagccccttaacaatgacgaagatcacgcccactggacggaggccaaaatgctgctcgacaacattaatacccctgaaggcatcattcccgctctgtttgagcctgaaagagagaagtccgccgcgatcgatggggagtaccgcctgagaggagaagcccggaagacattcgttgagctcatgcgcagaggcgaccttccggtgtggctgagctataaagtcgcttctgaagggtttcaatactccgatcggcgctggtgcttcgacggcgagagaaacaatcaggtgctggaagagaacatggatgtcgagatctggaccaaggaaggagagcggaaaaagctcagaccccgctggctggacgcccggacatatagcgaccctcttgctctgagagaatttaaagagttcgccgctggccgccggtccgtgtctggggatctcattctggaaatcggaaagctgccccagcatctcacccagagagcccaaaatgcgcttgacaacctggttatgctgcacaatagcgagcagggcgggcgggcctaccgccatgctatggaggaactccctgatacaattgagaccctgatgcttctggccctcatcgctgtgctgacgggaggcgtgacactgtttttcctctccggcagagggcttggaaaaacctctattggcctgctgtgtgtcatggccagctccgttctcctgtggatggccagcgtggaaccccactggatcgctgcgtctatcattcttgagtttttcctgatggtgctcctgatcccggagcctgaccggcagcgcacaccccaggataaccaactggcctatgtcgtgattgggctcctttttatgatcctgacagttgctgccaatgaaatgggactgctcgagaccacaaagaaggacctgggcattgggcacgtggccgtcgaaaaccatcaccatgctgccatgcttgatgtggacctgcaccctgcgtccgcctggacgctctacgctgtcgccaccacaatcattacccccatgatgagacatacaatcgagaacaccacggctaatatcagcctgaccgccattgcgaaccaggccgctatcctgatgggactcgataaaggctggcctatttctaagatggacatcggcgtgccccttctggccctggggtgctactcccaggttaatccgctcacactgaccgctgccgtgcttatgctggtcgctcactatgccattatcggacctggcctccaagcgaaagccacacgggaagctcagaagcgcaccgccgctgggatcatgaaaaaccccacggtggatggaattgttgccatcgacctggatcccgtggtctacgacgccaagttcgagaagcagctgggccagattatgctccttatcctgtgtacaagccaaattctgctcatgagaaccacatgggcgctgtgcgagtctatcacccttgctaccgggcctctgacaacgctctgggaaggaagcccgggcaaattttggaataccacaatcgccgtgtccatggctaacattttccggggctcttatctggccggggccggactggctttcagcctcatgaagtcccttggcgggggacgcagaggcaccggggcccagggagagacactgggcgaaaaatggaagcggcagctgaatcagctcagcaaatccgagtttaacacctacaagagatctggcatcatggaagtggaccgcagcgaggcgaaggaggggctgaaacggggagaaacgacaaagcacgccgtttccagaggcaccgctaaacttcgctggttcgtcgagcggaatctggtgaagcccgaagggaaagtgattgatctcggatgtggcagagggggatggtcttattactgcgccggcctgaagaaggtcaccgaggttaaaggctatacaaaagggggacctggccatgaggaacccatccctatggctacctacgggtggaacctggtgaaactccacagcggaaaggacgtgtttttcattccccctgagaaatgtgatacacttctgtgcgacatcggcgaatcctctccgaatcccacgattgaggaagggcgcaccctgcgggtcctcaagatggtggagccttggctgagaggaaaccaattttgtatcaaaatccttaatccctacatgcctagcgttgtggagacactggaacagatgcagcgcaagcatggcggcatgctcgtccggaaccccctgtccagaaatagcacccacgagatgtattgggtgtcttgcgggacaggaaacattgtttccgccgtgaatatgaccagccgcatgctgctcaaccggttcacgatggcgcacagaaagccgacctacgaacgcgatgtcgacctgggcgccgggacaagacatgtggctgtggagcctgaaatcgccaaccttgatattatcggacagcggattgagaatatcaaacacgagcataagtctacctggcactatgacgaagataacccctacaaaacatgggcttatcatggctcctacgaggtcaagcccagcgggtctgcctccagcatggttaatggagtggtgaaactgctcaccaagccttgggacgtcatccccatggtgacacaaattgctatgaccgatacgacaccttttggccagcagcgcgttttcaaggaaaaagtggacaccagaaccccgaaggccaaacggggcacagcgcaaatcatggaggtcacggccaagtggctgtgggggtttctttccagaaacaaaaagccccggatttgtacccgcgaagagttcacaagaaaggtgcggagcaatgctgccatcggagctgtttttgtggacgagaaccagtggaactctgccaaagaagccgtcgaggatgaacgcttctgggacctggtgcacagagagcgggaactccacaagcagggcaaatgcgcgacctgcgtttataacatgatggggaagcgcgagaaaaagctgggagagtttggcaaggctaaagggagcagagccatttggtacatgtggctgggcgcccggttcctcgagttcgaggctctgggatttatgaatgaagatcattggttctcccgcgagaactctcttagcggcgtggagggggaaggactgcacaagctcggctacatcctgagagacatctccaaaattcctgggggaaatatgtatgccgatgacacagctggctgggatacccggatcacagaggacgatcttcagaacgaagcccgcattaccgacatcatggagcccgaacatgcgctgctcgccaagtctatttttaaactgacgtaccaaaataaggtcgtgagagtccagcggcctgctaaaaacgggaccgtgatggatgttatcagccgcagagaccagcggggctccggacaggtgggcacatatgggctgaataccttcacaaacatggaggcccaactcatcagacagatggagtctgaaggaatttttagcccctccgagctggaaaccccgaaccttgctgagcgcgtcctggattggctcgaaaagtacggcgtggagcggctgaagagaatggccatcagcggggacgactgtgtggttaaacctattgatgaccgcttcgcgacggcccttacagctctgaatgatatgggaaaggtgcggaaagacatcccccagtgggagccttctaagggctggaacgattggcagcaagtccccttttgctcccaccacttccatcagctcattatgaaagacgggagagaaatcgtggttccttgtcgcaatcaggatgagctggtgggccgggccagagtcagccagggagctggctggtctctgcgcgaaaccgcctgcctcgggaagtcctatgctcaaatgtggcagctgatgtactttcaccggagagaccttcgcctggccgcgaacgccatttgtagcgctgtgcccgtcgattggatcccgacatcccggaccacgtggtctatccatgcccaccatcagtggatgaccacagaggacatgctcagcgtgtggaatagagtttggattgaagagaacccttggatggaggataagacccacatctccagctggggagacgtgccctatctgggcaaacgggaagaccaatggtgcgggtctcttattggactgacagccagagctacctgggccacaaatatccaggtcgcgattaaccaggtgcgccggctcatcggcaatgagaactacctggattacatgacctccatgaagagattcaaaaatgaaggggaccccgagggcgctctgtggtga

SEQ ID NO: 19022 - RNA, 9879 nt, synthetic construct
  misc_feature 1..9879: note = derived and/or modified CDS sequence (opt5) from DENV-1__GQ199776__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttatcgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgctgtctcttcactatgcctggaagacaatggctatggttctgtccattgtgagcctctttcccctgtgtctctctaccacctcccagaaaacaacctggctgcctgtgcttctggggagcctgggatgcaagccgctcacaatgttcctgatcgccgagaataagatttggggccgcagatcttggccccttaacgaaggcatcatggcggtcgggatcgtgtccattctgctcagctccctgctcaaaaacgatgttcctctggccggaccccttatcgctggcgggatgctgattgcctgttacgtgatcagcggatctagcgctgacctgtccctcgagaaggccgccgaggtctcttgggaagaggaagctgagcatagcggcgcgtcccacaatattctggtggaagttcaggatgacgggacgatgaaaatcaaggatgaggagcgggacgatacccttacaatcctgctcaaagccaccctgctcgctgtgtctggagtctatcctctgagcattcccgccacactttttgtgtggtacttctggcaaaagaaaaagcagcgctccggcgtcctgtgggacaccccttctcccccggaagtggagagagccgttctggatgacggcatctatcggattatgcagcgcgggctcctgggaagaagccaggtgggcgtcggggtgttccaagaaaacgtttttcatacgatgtggcacgtgacccggggagctgtccttatgtaccagggcaagagactggagccttcctgggccagcgtgaaaaaggacctcatctcttacgggggaggctggcgcctgcagggctcctggaatacaggggaggaagtgcaggttattgcggtcgagcccggcaagaaccctaagaatgtgcaaaccgctcccggcacattcaaaaccccggaaggggaggtgggagccatcgccctcgattttaagcctggcacaagcgggtctcccattgtcaaccgggaaggaaagatcgtgggcctgtatggcaatggggttgtgacgacctccggaacatacgtcagcgctatcgcccaggcgaaggcttcccaggagggccctcttcccgagattgaagacgaggtgttcagaaagcgcaacctgaccatcatggatctgcaccccgggtctggaaaaacccggagatatctccctgccattgttcgcgaagccatcaagcggaaactgagaacacttattctggctccgacgcgcgtggtcgccagcgagatggctgaagccctcaagggcatgcccatccggtaccaaaccacagcggtgaagtccgagcataccgggaaagagatcgttgacctgatgtgccacgccacatttaccatgagactgctcagccctgtgcgggtccccaattataacatgattatcatggatgaagctcatttcacggacccttcttccattgccgctcgcggctacatcagcacaagagtgggaatgggcgaggccgccgctatttttatgaccgcgacaccccctgggtctgtggaagccttcccgcagagcaatgctgtcatccaggatgaggaacgggacatccccgagcgctcctggaactctggatatgagtggattacagattttcctggcaagaccgtttggttcgtgcccagcatcaaatccgggaatgacattgccaactgtcttagaaagaatggaaaacgggtgatccagctgtctagaaagacatttgataccgaataccaaaagacgaaaaacaacgactgggactacgtcgtgacaaccgatattagcgagatgggcgccaatttccgcgctgaccgggttatcgatcctagacgctgcctgaagcccgtgattctcaaagacgggccggaacgggtcatcctggccggccctatgcccgtgacagttgcgtccgctgcccagagacgcggacggatcggcagaaaccacaataaggagggggatcagtatatttacatgggacagccccttaacaatgacgaggatcatgcccactggaccgaagctaaaatgctgctcgacaacatcaatacgcctgagggcattatccccgccctgttcgaacctgagcgcgaaaagagcgcggccattgatggggagtatagactgcggggagaggctcgcaagacctttgtggaactcatgagacggggcgaccttccggtctggctgtcttacaaagtggcctccgaggggttccaatatagcgatcgcagatggtgctttgacggcgaacggaacaatcaggtcctggaggaaaacatggatgtggagatctggacaaaggagggagaacgcaagaaactccgcccccggtggctggacgctagaacctactccgaccctcttgccctgcgcgagttcaaagaatttgctgccggccggagatctgttagcggggatctcatcctggagattggaaagctgccccagcacctcacacagcgggcgcaaaatgcccttgacaacctggtgatgctgcataattccgaacagggcgggcgcgcttatagacacgccatggaggagctccctgataccatcgaaacactgatgcttctggctctcattgccgtgctgaccggaggcgtcacgctgttctttctctctggccgggggcttggaaaaacaagcatcggcctgctgtgtgttatggcctccagcgtgctcctgtggatggcttctgtggagccccattggattgcggcctccatcatccttgagttctttctgatggtcctcctgattccggagcctgaccgccagagaacaccccaggataaccaactggcttacgtggttatcgggctccttttcatgattctgaccgtggccgccaatgagatgggactgctcgaaacaaccaagaaggacctgggcatcgggcacgtcgctgtggagaaccaccatcacgccgcgatgcttgatgtcgacctgcatcctgccagcgcttggacactctacgccgtggctacgaccattatcacacccatgatgcggcacaccattgaaaacacaaccgccaatatctctctgacggcgatcgccaaccaggctgccattctgatgggactcgataaaggctggcctatctccaagatggacattggcgttccccttctggctctggggtgctatagccaggtgaatccgctcaccctgacagccgctgtccttatgctggtggcccattacgcgatcattggacctggcctccaagccaaagctacccgcgaggcccagaagagaacagctgccgggatcatgaaaaaccccaccgttgatggaatcgtggccattgacctggatcccgtcgtgtatgacgcgaagtttgaaaagcagctgggccagatcatgctccttattctgtgtacgtctcaaatcctgctcatgcggacaacctgggctctgtgcgagagcattacacttgccaccgggcctctgaccacactctgggagggatccccgggcaaattctggaatacgaccatcgctgtgtctatggccaacatctttcgcggcagctacctggccggggctggactggccttctccctcatgaaaagccttggcgggggaagacggggcacaggggcgcagggagaaaccctgggcgagaaatggaagagacagctgaatcagctctccaaatctgagttcaacacatataagcgcagcggcattatggaggttgaccggtccgaagccaaggaggggctgaaaagaggagagaccacgaagcacgctgtctctcgcggcacagccaaacttcggtggtttgtggaaagaaatctggtgaagcccgaggggaaagtcatcgatctcggatgtggccgcgggggatggagctactattgcgctggcctgaagaaggttaccgaagtgaaaggctacaccaaaggcgggcctgggcacgaggaacccattcctatggccacatacgggtggaacctggtgaaactccattccggaaaggacgtcttctttattccccctgagaaatgtgatacccttctgtgcgacattggcgagtctagcccgaatcccacaatcgaagaggggcggacgctgagagtgctcaagatggttgaaccttggctgcgcggaaaccaattctgtattaaaatccttaatccctatatgccttccgtggtcgagaccctggagcagatgcagcggaagcacggcggcatgctcgtgagaaaccccctgagccgcaattctacacatgaaatgtactgggtttcctgcgggaccggaaacatcgtgagcgcggtcaatatgacatctcggatgctgctcaacagatttaccatggcccaccgcaagccgacgtatgagagagatgtggacctgggcgctgggacccggcacgtggtcgttgaacctgaggtggccaaccttgatattatcggacagcgcattgaaaatatcaaacatgagcacaagtccacatggcattacgacgaggataacccctataaaacctgggcttaccacggcagctatgaagtgaagccctctgggtccgccagctccatggtcaatggagtggttaaactgctcacaaagccttgggacgtgattcccatggtcacccaaatcgctatgacagataccacgcctttcggccagcagagagtgtttaaggagaaagttgacacacggaccccgaaggccaaaagaggcaccgcgcaaatcatggaagtgacagccaagtggctgtgggggttccttagccggaacaaaaagccccgcatttgtacgagagaggaatttacccggaaggtccgctctaatgctgccatcggagctgtgttcgttgacgagaaccagtggaatagcgccaaagaggccgtggaagatgagagattttgggacctggtccatcgggaacgcgagctccacaagcagggcaaatgcgcgacatgcgtgtacaacatgatggggaagagagagaaaaagctgggagagttcggcaaggctaaagggtcccgggccatttggtacatgtggctgggcgcccgctttctcgagttcgaagctctgggattcatgaatgaggatcactggttttctagagaaaacagcctttccggcgtcgagggggagggactgcataagctcggctatatcctgcgggacatttctaaaatccctgggggaaatatgtacgccgatgacaccgctggctgggatacacgcatcaccgaagacgatcttcagaacgaggccagaattacagacatcatggaacccgagcacgcgctgctcgccaagagcattttcaaactgacctatcaaaataaggtggttcgggtgcagcgccctgctaaaaacgggacggtcatggatgtgatctccagacgggaccagagaggctctggacaggtgggcacctacgggctgaatacatttaccaacatggaagcccaactcattcgccagatggagagcgagggaatcttctcccccagcgaactggagacaccgaaccttgctgaacgggttctggattggctcgagaagtatggcgtggaaagactgaagcgcatggccatctctggggacgactgtgtcgtgaaacctattgatgaccggtttgcgaccgcccttacggctctgaatgatatgggaaaggttagaaaagacatcccccagtgggagccttccaagggctggaacgattggcagcaagtgcccttctgcagccatcactttcaccagctcattatgaaagacgggcgcgagatcgtcgtgccttgtcggaatcaggatgaactggtcggcagagcccgcgtgtctcagggagctggctggtccctgcgggagacagcctgcctcggaaagagctacgctcaaatgtggcagctgatgtatttccatagacgcgaccttcggctggccgcgaacgccatttgttccgctgttcccgtggattggatcccgacctctagaacaacctggagcattcacgcccatcaccagtggatgacgaccgaagacatgctctccgtctggaatcgggtgtggatcgaggaaaacccttggatggaggataagacacatatcagctcttggggagacgttccctacctgggcaaaagagaggaccaatggtgcgggtcccttattggactgaccgcccgcgctacatgggccaccaatatccaggtggcgattaaccaggtccggagactcatcggcaatgaaaactacctggattatatgacaagcatgaagcgctttaaaaatgagtctgaccccgaaggggctctgtggtga

SEQ ID NO: 19023 - RNA, 9879 nt, synthetic construct
  misc_feature 1..9879: note = derived and/or modified CDS sequence (opt5) from DENV-1__GQ199777__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagaccagcgccggcgttaatatgtgcacccttattgcgatggacctgggggaactctgtgaagatacaatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaggacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggcctcttcaaactggagaaggaagtggccgagacccagcacggaacagttctggtgcagattaagtacgagggcaccgacgctccgtgcaaaatccctttctctacacaagatgaaaagggggtcacgcagaacggacggcttatcaccgccaatcccattgtgacagacaaagagaagcctgtgaacatcgaagcggagccgccctttggcgagtcctatattatcattggggctggagaaaaagccctcaagctgagctggttcaagaaaggctctagcatcgggaagatgtttgaggccaccgctagaggcgcccgccggatggctatcctgggagatacagcctgggacttcggctccattgggggagtttttacctctgtcggcaaactcgtgcatcagatcttcgggacggcgtacggagtgctgtttagcggcgtctcctggaccatgaagattgggatcggcgtgcttctgacatggctcggactgaatagcagatctacctccctgagcatgacatgtattgccgttggccttgtgaccctctacctgggggtcatggtgcaggctgattctggatgcgttatcaactggaaaggccgcgaactgaagtgtgggtccggaattttcgtgacaaatgaggtccacacctggacggaacaatataagtttcaggccgacagccctaaacggctctccgctgccatcggcaaggcgtgggaggagggggtgtgcggcatcagatctgccacacgcctggaaaacattatgtggaaacagatcagcaacgagcttaatcatattctgctcgaaaacgacatgaagttcaccgttgtggtcggagatgtggctggcatcctggcccaggggaaaaagatgattcggccgcaacccatggagtacaaatattcctggaagtcttggggaaaggctaaaatcatcggcgccgacgtgcagaataccacatttattatcgatgggcctaacacccccgaatgtcctgacgatcagagagcctggaatatttgggaggtcgaggactacggattcggcatctttacgacaaacatttggctgaaacttcgcgatagctatacccaggtttgcgaccaccggctcatgtccgctgcgatcaaagatagcaaggccgtgcacgctgacatgggctactggatcgaatctgagaaaaatgaaacatggaagctggccagagcctccttcattgaggtgaagacctgtatctggcccaaaagccatacactgtggtctaacggggtcctcgaatccgagatgattatcccgaagatttatggaggccctatcagccaacacaattaccgccccgggtacttcacccagacggctggaccttggcatctgggcaaacttgagctggattttgacctctgcgaagggaccacagtggttgtggatgagcactgcggaaaccggggcccctctctgagaaccacaaccgtcacgggcaagatcattcacgaatggtgttgccggagctgtacactgcctccccttcgcttcagaggggaggacggatgctggtatggcatggagatccggccggtgaaagaaaaggaggaaaatctcgttaagtccatggtgagcgccgggtctggagaggtcgactcctttagcctgggcctgctctgtatttccatcatgattgaagaggtgatgagatctcgctggagccggaaaatgctgatgaccgggacacttgcggttttctttctgctcatcatgggacagctgacctggaacgatctgattagactttgcatcatggtgggcgctaatgcctccgaccgcatgggcatggggaccacatacctggccctcatggctacgttcaagatgagacctatgtttgccgtcggactcctgttccggcgcctgacctctagagaggtgcttctgctcacaatcggcctgagcctggtggcgtccgtcgaacttcccaactctctggaggaactcggggatggactggctatgggcattatgatcctcaaactgcttgccgactttcaaagccatcagctgtgggccaccctcctgtccctgacattcattaagaccacgtttagccttcactatgcttggaaaacaatggccatggttctgtctatcgtgtccctcttccccctgtgtctcagcaccacctctcagaagacaacctggctgcctgtgcttctggggtccctgggatgcaagccgctcacaatgtttctgattgctgagaataaaatctggggccggcgcagctggccccttaacgaaggcatcatggccgtcgggattgtgtctatcctgctctccagcctgctcaagaacgatgttcctctggcgggaccccttattgccggcgggatgctgatcgcttgttacgtgatttccggaagctctgccgacctgagcctcgagaaagctgccgaggtctcctgggaagaggaagccgagcattctggcgctagccacaatatcctggtggaagttcaggatgacgggacgatgaagatcaaagatgaggagagagacgatacccttacaattctgctcaaggcgaccctgctcgccgtgtccggagtctatcctctgtctatccccgctacacttttcgtgtggtacttctggcagaagaagaagcagcggagcggcgtcctgtgggacacccctagccctcccgaagtggagcgcgccgttctggatgacggcatttatagaatcatgcagcgggggctcctgggacgctctcaggtgggcgtcggggtgtttcaagaaaacgttttccatacgatgtggcacgtgaccagaggagccgtccttatgtaccagggcaaacggctggagcccagctgggcttccgtgaagaaagacctcattagctacgggggaggctggagactgcagggctcttggaatacaggggaggaagtgcaggttatcgccgtcgagcccggaaagaaccctaaaaatgtgcaaaccgcgcccggcacatttaagaccccggaaggggaggtgggagctattgccctcgatttcaagcctggcacatccgggagccccatcgtcaaccgcgaaggaaaaatcgtgggcctgtatggcaatggggttgtgacgacctctggaacatacgtctccgccattgctcaggccaaggcgagccaggagggccctcttcccgagatcgaagacgaggtgtttcggaaaagaaacctgaccattatggatctgcaccccgggtccggaaagacccgccggtatctccctgctatcgttagagaagccattaaacgccggctgagaacacttatcctggccccgacgcgcgtggtcgcttctgagatggccgaagctctcaagggcatgcccatccggtaccaaaccacagccgtgaagtccgagcataccgggaaagagattgttgacctgatgtgccacgcgacattcaccatgagactgctctcccctgtgcgggtccccaattataacatgatcattatggatgaagcccattttacggaccctagctctatcgctgcccgcggctacatttccacaagagtgggaatgggcgaggctgccgccatcttcatgaccgctacaccccctgggagcgtggaagcgtttccgcagtctaatgccgtcatccaggatgaggaacgggacattcccgagcgcagctggaactccggatatgagtggatcacagatttccctggcaagaccgtttggtttgtgccctctattaaaagcgggaatgacatcgctaactgtcttagaaagaatggaaaacgggtgattcagctgtccagaaagacattcgataccgaataccaaaagacgaaaaacaacgactgggactacgtcgtgacaaccgatatctctgagatgggcgccaatttccgcgccgaccgggttattgatcctagacgctgcctgaagcccgtgatcctcaaagacgggccggaacgggtcatcctggctggccctatgcccgtgacagttgccagcgcggctcagagacgcggacggattggcagaaaccacaataaggagggggatcagtatatctacatgggacagccccttaacaatgacgaggatcatgcccactggaccgaagccaaaatgctgctcgacaacattaatacgcctgagggcatcattcccgctctgtttgaacctgagcgcgaaaagtccgccgcgatcgatggggagtatagactgcggggagaggcccgcaagaccttcgtggaactcatgagacggggcgaccttccggtctggctgagctacaaagtggcttctgaggggtttcaatattccgatcgcagatggtgcttcgacggcgaacggaacaatcaggtcctggaggaaaacatggatgtggagatctggacaaaggagggagaacgcaagaagctccgcccccggtggctggacgccagaacctacagcgaccctcttgctctgcgcgagtttaaagagttcgccgctggccggagatccgtttctggggatctcattctggagatcggaaagctgccccagcacctcacacagcgggcccaaaatgcgcttgacaacctggtgatgctgcataatagcgaacagggcgggcgcgcctatagacacgctatggaggagctccctgataccattgaaacactgatgcttctggccctcatcgctgtgctgaccggaggcgtcacgctgtttttcctctccggccgggggcttggaaaaacatctattggcctgctgtgtgttatggccagctccgtgctcctgtggatggccagcgtggagccccattggatcgctgcgtctatcattcttgaatttttcctgatggtcctcctgatcccggagcctgaccgccagagaacaccccaggataaccaactggcctacgtggttattgggctcctttttatgatcctgaccgtggctgccaatgagatgggactgctcgaaacaaccaagaaggacctgggcattgggcacgtcgccgtggagaaccaccatcacgctgccatgcttgatgtcgacctgcatcctgcgtccgcctggacactctacgctgtggccacgaccatcattacacccatgatgcggcacaccatcgaaaacacaaccgctaatatcagcctgacggccattgcgaaccaggccgctatcctgatgggactcgataaaggctggcctatttctaagatggacatcggcgttccccttctggccctggggtgctattcccaggtgaatccgctcaccctgacagctgccgtccttatgctggtggctcattacgccattatcggacctggcctccaagcgaaagccacccgcgaggctcagaagagaacagccgctgggatcatgaaaaaccccaccgttgatggaattgtggccatcgacctggatcccgtcgtgtatgacgccaagttcgaaaagcagctgggccagattatgctccttatcctgtgtacgagccaaattctgctcatgcggacaacctgggcgctgtgcgagtctatcacacttgctaccgggcctctgaccacactctgggagggaagcccgggcaaattttggaatacgaccatcgccgtgtccatggctaacattttccgcggctcttacctggccggggccggactggctttcagcctcatgaagtcccttggcgggggaagacggggcacaggggcccagggagaaaccctgggcgagaaatggaagagacagctgaatcagctcagcaaatccgaatttaacacatataagcgctctggcatcatggaggttgaccggagcgaagcgaaggaggggctgaaaagaggagagaccacgaagcacgccgtctcccgcggcacagctaaacttcggtggttcgtggaaagaaatctggtgaagcccgaggggaaagtcattgatctcggatgtggccgcgggggatggtcttactattgcgccggcctgaagaaggttaccgaagtgaaaggctacaccaaagggggacctggccacgaggaacccatccctatggctacatacgggtggaacctggtgaaactccatagcggaaaggacgtctttttcattccccctgagaaatgtgatacccttctgtgcgacatcggcgagtcctctccgaatcccacaattgaagaggggcggacgctgagagtgctcaagatggttgaaccttggctgcgcggaaaccaattttgtatcaaaatccttaatccctatatgcctagcgtggtcgagaccctggagcagatgcagcggaagcacggcggcatgctcgtgagaaaccccctgtcccgcaatagcacacatgaaatgtactgggtttcttgcgggaccggaaacattgtgtccgccgtcaatatgacaagccggatgctgctcaacagattcaccatggcgcaccgcaagccgacgtatgagagagatgtggacctgggcgccgggacccggcacgtggctgtcgaacctgaggttgccaaccttgatatcattggacagcgcatcgaaaatattaaacatgagcacaagtctacatggcattacgacgaggataacccctataaaacctgggcttaccacggctcctatgaagtgaagcccagcgggtctgcctccagcatggtgaatggagtcgtgaaactgctcacaaagccttgggacgttatccccatggtgacccaaatcgctatgacagataccacgccttttggccagcagagagtcttcaaggagaaagtggacacacggaccccgaaggccaaaagaggcaccgcgcaaattatggaagttacagccaagtggctgtgggggtttctttcccggaacaaaaagccccgcatctgtacgagagaggagttcacccggaaggtgcgcagcaatgctgccattggagctgtctttgtggacgagaaccagtggaactctgccaaagaggccgttgaagatgagagattctgggacctggtgcatcgggaacgcgagctccacaagcagggcaaatgcgcgacatgcgtctacaacatgatggggaagagagagaaaaagctgggagagtttggcaaggctaaagggagccgggccatctggtacatgtggctgggcgcccgcttcctcgagttcgaagctctgggatttatgaatgaggatcactggttctccagagaaaactctcttagcggcgtggagggggagggactgcataagctcggctatattctgcgggacatctccaaaatccctgggggaaatatgtacgccgatgacaccgctggctgggatacacgcattaccgaagacgatcttcagaacgaggccagaatcacagacattatggaacccgagcacgcgctgctcgccaagtctatctttaaactgacctatcaaaataaggtcgtgcgggttcagcgccctgctaaaaacgggacggtgatggatgtcattagcagacgggaccagagaggctccggacaggtgggcacctacgggctgaatacattcaccaacatggaagcccaactcatccgccagatggagtctgagggaatctttagcccctccgaactggagacaccgaaccttgctgaacgggtgctggattggctcgagaagtatggcgttgaaagactgaagcgcatggccattagcggggacgactgtgtggtcaaacctatcgatgaccggttcgcgaccgcccttacggctctgaatgatatgggaaaggtgagaaaagacattccccagtgggagccttctaagggctggaacgattggcagcaagttcccttttgctcccatcacttccaccagctcatcatgaaagacgggcgcgagattgtggtcccttgtcggaatcaggatgaactggtgggcagagcccgcgtcagccagggagctggctggtctctgcgggagacagcctgcctcgggaagtcctacgctcaaatgtggcagctgatgtattttcatagacgcgaccttcggctggccgcgaacgccatctgtagcgctgtgcccgttgattggattccgacctccagaacaacctggtctatccacgcccatcaccagtggatgacgaccgaagacatgctcagcgtgtggaatcgggtctggatcgaggaaaacccttggatggaggataagacacatatttccagctggggagacgtgccctacctgggcaaaagagaggaccaatggtgcgggtctcttatcggactgaccgcccgcgctacatgggccaccaatattcaggttgcgatcaaccaggtgcggagactcattggcaatgaaaactacctggattatatgacatccatgaagcgcttcaaaaatgagagcgaccccgaaggggctctgtggtga

SEQ ID NO: 19024 - RNA, 9879 nt, synthetic construct
  misc_feature 1..9879: note = derived and/or modified CDS sequence (opt5) from DENV-1__GQ199778__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagataccatgacctacaaatgcccccgcatcacagaaaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagaggcttggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagttcacagttgtggtcggagatgtggctggcattctcgcccaggggaaaaagatgatccggccgcaacccatggagtacaaatattcttggaaaagctggggaaaggccaagattatcggcgctgacgtgcagaataccacctttatcattgatgggcctaacacacccgaatgtcctgacgatcagagagcgtggaatatctgggaggtcgaggactacggattcggcatttttaccacgaacatctggctgaagctgcgcgattcctatacacaggtttgcgaccaccggcttatgagcgccgctattaaagattctaaggccgtgcacgccgacatgggctactggatcgaatccgagaaaaatgaaacctggaagctcgctagagccagcttcatcgaggtgaagacatgtatttggcccaaatctcataccctgtggtccaacggggtcctggaaagcgagatgatcattccgaagatctatggaggccctatttctcaacacaattaccgccccgggtacttcacacaggcggctggaccttggcatctcggcaaactggagcttgattttgacctgtgcgaagggaccacggtggttgtggatgagcactgcggaaaccggggccccagcctcagaaccacaaccgtcacaggcaagatcatccacgaatggtgttgccggtcctgtaccctgcctcccctgcgcttcagaggggaggacggatgctggtatggcatggagattcggccgatcaaagaaaaggaggaaaatcttgtcaagagcatggtttctgccgggtccggagaggtggacagcttttccctcggcctgctgtgtatttctatcatgattgaagaggtcatgagaagccgctggtcccggagaatgctcatgacggggacactggccgtgttctttcttctgatcatgggacagctcacctggaacgatctgattcgcctgtgcatcatggttggcgctaatgcctctgacagaatgggcatggggacaacctaccttgcgctgatggctaccttcaaaatgcggcctatgtttgccgtgggactcctgttccgcagactcacaagccgggaggtcctgcttctgacgatcggcctctccctggtggcctctgtggaactgcccaacagccttgaggaactgggggatggactcgctatgggcattatgatcctgaagctcctgaccgactttcaatcccatcagctttgggccacactgctcagcctgaccttcattaaaacaaccttttctctgcactatgcttggaagacgatggccatggtcctttccatcgttagcctgttccccctctgtctgtctacaacctcccagaaaaccacatggctccctgtgctgcttgggagcctgggatgcaagccgctgaccatgtttctcattgcggagaataagatctggggccgcagatcttggcccctgaacgaaggcatcatggccgtggggattgtctccatccttctgagctccctcctgaaaaacgatgtgcctctcgctggacccctgattgccggcgggatgcttatcgcttgttacgttattagcggatctagcgccgacctgtccctggagaaggccgctgaggtgtcttgggaagaggaagcggagcatagcggcgcctcccacaatatcctcgtcgaagtgcaggatgacgggacaatgaaaatcaaggatgaggagcgggacgatacgctgaccattcttctgaaagctacactcctggccgtttctggagtgtatcctctcagcatccccgccaccctgttcgtctggtacttctggcaaaagaaaaagcagcgctccggcgtgctttgggacacaccttctcccccggaagtcgagagagctgtgctggatgacggcatttatcggatcatgcagcgcgggctgctcggaagaagccaggttggcgtgggggtctttcaagaaaacgtgttccataccatgtggcacgttacgcggggagccgtgctgatgtaccagggcaagagacttgagccttcctgggcgagcgtcaaaaaggacctgatttcttacgggggaggctggcgcctccagggctcctggaataccggggaggaagtccaggtgatcgctgttgagcccggcaagaaccctaagaatgtccaaacagcccccggcacctttaaaacaccggaaggggaggtgggagccattgctctggatttcaagcctggcaccagcgggtctcccatcgtgaaccgggaaggaaagatcgtcggcctctatggcaatggggtggttacaacgtccggaacctacgtgagcgccattgcgcaggctaaagcctcccaggagggccctctgcccgagatcgaagacgaggtctttagaaagcgcaaccttacaattatggatctgcaccccgggtctggaaaaacccggagatatctgcctgccatcgtgcgcgaagctattaagcggaaactcagaaccctgatccttgccccgacacgcgttgtggctagcgagatggccgaagcgctgaagggcatgcccatccggtaccaaacgaccgccgtcaagtccgagcatacagggaaagagattgtggacctcatgtgccacgctaccttcacaatgagactgctgagccctgttcgggtgcccaattataacatgatcattatggatgaagcccattttaccgacccttcttccatcgctgcccgcggctacattagcacgagagtcggaatgggcgaggccgctgcgatcttcatgacagccacaccccctgggtctgtggaggcttttccgcagagcaatgccgtgatccaggatgaggaacgggacattcccgagcgctcctggaactctggatatgagtggatcaccgatttccctggcaagacagtctggtttgttcccagcattaaatccgggaatgacatcgccaactgtctcagaaagaatggaaaacgggtgattcagctttctagaaagaccttcgatacagaataccaaaagaccaaaaacaacgactgggactacgtggtcacgacagatatcagcgagatgggcgctaatttccgcgccgaccgggtgattgatcctagacgctgcctgaagcccgttatcctgaaagacgggccggaacgggtgatcctcgcgggccctatgcccgtcaccgtggcttccgccgcccagagacgcggacggattggcagaaaccacaataaggagggggatcagtatatctacatgggacagcccctgaacaatgacgaggatcatgctcactggacagaagccaaaatgcttctggacaacattaatacccctgagggcatcattcccgcgctctttgaacctgagcgcgaaaagagcgccgctatcgatggggagtatagactgcggggagaggcccgcaagacgttcgttgaactgatgagacggggcgacctcccggtgtggctttcttacaaagtcgcttccgaggggtttcaatatagcgatcgcagatggtgcttcgacggcgaacggaacaatcaggtgctggaggaaaacatggatgtcgagatctggaccaaggagggagaacgcaagaagctgcgcccccggtggctcgacgccagaacatactccgaccctctggctcttagagagtttaaagagttcgccgcgggccggagatctgtgagcggggatctgattctcgagatcggaaagctgccccagcacctgacccagcgggcccaaaatgctctcgacaaccttgttatgctgcataattccgaacagggcgggcgcgcctatagacacgctatggaggagctgcctgatacaattgaaaccctcatgctgcttgccctgatcgccgtgctcacaggaggcgtgaccctgtttttcctgtctggccgggggctcggaaaaacgagcattggccttctgtgtgtcatggcttccagcgttctgctctggatggcgtctgtggagccccattggatcgccgcttccatcattctggaatttttccttatggtgctgctcatcccggagcctgaccgccagagaacaccccaggataaccaactggcctacgtcgtgattgggctgctctttatgatccttaccgttgccgctaatgagatgggactgctggaaaccacaaagaaggacctcggcattgggcacgtggccgtcgagaaccaccatcacgcggccatgctggatgtggaccttcatcctgctagcgcctggaccctgtacgctgtcgccacaacgatcattacccccatgatgcggcacacaatcgaaaacaccacagcgaatatctctctcaccgccattgctaaccaggccgctatcctgatgggactggataaaggctggcctatttccaagatggacatcggcgtgcccctccttgccctggggtgctatagccaggttaatccgctgacgctcaccgctgccgtgctgatgcttgtcgcgcattacgccattatcggacctggcctgcaagctaaagccacacgcgaggctcagaagagaaccgccgccgggatcatgaaaaaccccacagtggatggaattgttgcgatcgacctcgatcccgtggtctatgacgctaagttcgaaaagcagctgggccagattatgctgctcatcctttgtacctctcaaattctgctgatgcggacgacatgggccctctgcgagagcatcaccctggctacagggcctcttaccaccctgtgggagggatccccgggcaaattttggaatacaacgatcgccgtgtctatggccaacattttccgcggcagctacctcgctggggccggactggcgttctccctgatgaaaagcctcggcgggggaagacggggcaccggggcccagggagaaacacttggcgagaaatggaagagacagctgaatcagctgtccaaatctgaatttaacacctataagcgcagcggcatcatggaggtggaccggtccgaagctaaggaggggctcaaaagaggagagacaaccaagcacgccgtttctcgcggcacggctaaactgcggtggttcgtcgaaagaaatcttgtgaagcccgaggggaaagtgattgatctgggatgtggccgcgggggatggagctactattgcgccggcctcaagaaggtcacagaagttaaaggctacaccaaaggcgggcctgggcacgaggaacccatccctatggcgacctacgggtggaacctggtgaaactgcattccggaaaggacgtgtttttcattccccctgagaaatgtgatacactcctttgcgacatcggcgagtctagcccgaatcccaccattgaagaggggcggacactgagagtcctgaagatggtggaaccttggctccgcggaaaccaattttgtatcaaaatcctgaatccctatatgccttccgttgtggagacgcttgagcagatgcagcggaagcacggcggcatgctggtcagaaaccccctcagccgcaattctacccatgaaatgtactgggtgtcctgcgggacaggaaacattgttagcgccgtgaatatgacctctcggatgctgctgaacagattcacaatggctcaccgcaagccgacctatgagagagatgtcgacctcggcgccgggacgcggcacgtggctgtggaacctgaggtcgccaacctggatatcattggacagcgcatcgaaaatattaaacatgagcacaagtccacctggcattacgacgaggataacccctataaaacatgggcttaccacggcagctatgaagttaagccctctgggtccgccagctccatggtgaatggagtggtcaaacttctgaccaagccttgggacgtgatccccatggttacacaaatcgcgatgaccgatacaaccccttttggccagcagagagtgttcaaggagaaagtcgacacgcggacaccgaaggccaaaagaggcaccgctcaaattatggaagtgaccgccaagtggctctgggggtttctgagccggaacaaaaagccccgcatctgtacaagagaggagttcacgcggaaggttcgctctaatgctgccattggagccgtgtttgtcgacgagaaccagtggaatagcgcgaaagaggctgtggaagatgagagattctgggaccttgttcatcgggaacgcgagctgcacaagcagggcaaatgcgctacctgcgtgtacaacatgatggggaagagagagaaaaagctcggagagtttggcaaggccaaagggtcccgggctatctggtacatgtggctgggcgcccgcttcctggagttcgaagctctcggatttatgaatgaggatcactggttctctagagaaaacagcctgtccggcgtcgagggggagggacttcataagctgggctatattctccgggacatctctaaaatccctgggggaaatatgtacgccgatgacacagcgggctgggatacccgcattacagaagacgatctgcagaacgaggccagaatcaccgacattatggaacccgagcacgcccttctggccaagagcatctttaaactcacatatcaaaataaggtggtccgggtgcagcgccctgctaaaaacgggaccgttatggatgtgatttccagacgggaccagagaggctctggacaggtcggcacgtacgggctgaataccttcacaaacatggaagcccaactgatccgccagatggagagcgagggaatcttttcccccagcgaactcgagaccccgaacctggcggaacgggtgcttgattggctggagaagtatggcgtggaaagactcaagcgcatggccatttctggggacgactgtgttgtgaaacctatcgatgaccggttcgctacagccctgaccgctcttaatgatatgggaaaggtcagaaaagacattccccagtgggagccttccaagggctggaacgattggcagcaagtgcccttttgcagccatcacttccaccagctgatcatgaaagacgggcgcgagattgttgtgccttgtcggaatcaggatgaactcgtcggcagagcccgcgtgtctcagggagctggctggtccctgcgggagacggcctgcctgggaaagagctacgcgcaaatgtggcagctcatgtattttcatagacgcgacctgcggcttgccgctaacgccatctgttccgccgtccccgtggattggattccgacatctagaaccacatggagcatccacgctcatcaccagtggatgaccacggaagacatgctgtccgtttggaatcgggtgtggatcgaggaaaacccttggatggaggataagacccatattagctcttggggagacgtcccctacctcggcaaaagagaggaccaatggtgcgggtccctgatcggacttacagcccgcgcgacctgggctacaaatattcaggtggccatcaaccaggttcggagactgattggcaatgaaaactacctcgattatatgaccagcatgaagcgcttcaaaaatgagtctgaccccgaaggggccctgtggtga

SEQ ID NO: 19025 - RNA, 9879 nt, synthetic construct
  misc_feature 1..9879: note = derived and/or modified CDS sequence (opt5) from DENV-1__GQ199780__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccgccctgctcaaaaacgatgttcctctggctggacccctcatcgccggcgggatgctgattgcttgttacgtgatcagcggatctagcgccgacctttccctggagaaggccgctgaggtctcttgggaagaggaagcggagcatagcggcgcctcccacaatattctggtggaagttcaggatgacgggacaatgaaaatcaaggatgaggagcgggacgatacgctcaccatcctgcttaaggctacactgctcgccgtgtctggagtctatcctctgagcattcccgccaccctcttcgtgtggtacttttggcagaaaaagaaacaacgctccggcgtcctgtgggacacaccttctcccccggaagtggagagagctgttcttgatgacggcatctatcggattatgcagcgcgggctgctgggaagaagccaggtgggcgtcggggtgttccaggaaaacgtttttcataccatgtggcacgtgacgcggggagccgtcctcatgtaccaaggcaagcgcctggagccttcctgggcgagcgtgaaaaaggaccttatctcttacgggggaggctggagactgcagggctcctggaataccggggaggaagtgcaggttattgctgtcgagcccggaaagaaccctaaaaatgtgcagacagcccccggcaccttcaagacaagcgaaggggaggtgggagccatcgctctcgattttaaaccgggcacctctgggtcccctattgtcaaccgggaaggaaagatcgtgggcctgtatggcaatggggttgtgacaacgagcggaacctacgtctccgccatcgcgcaagctaaagcctctcaggagggccccctccctgagattgaagacgaggtgttcagaaagcgcaacctgacaatcatggatcttcaccccgggagcggaaagacccggagatatctgcccgccattgttcgcgaagctatcaaacggaagctgagaaccctcattctggcccctacacgcgtggtcgcttccgagatggccgaagcgcttaaaggcatgccgatccggtaccagacgaccgccgtgaagtccgagcatacagggaaagagatcgttgacctgatgtgccacgctacctttacaatgagactcctgtctcccgtgcgcgtccctaattataacatgattatcatggatgaagcccatttcaccgacccctccagcattgctgcccggggctacatctctacgagagtgggaatgggcgaggccgctgcgatttttatgacagccacccctcccgggagcgtggaggctttccctcaatccaatgccgtcatccaggatgaagaacgggacatcccggagcgctcttggaacagcggatatgagtggattaccgattttcccggcaagacagtttggttcgtgccttccatcaagtctgggaatgacattgccaactgtctgcgcaagaatggaaagcgggtgatccagctcagccgcaaaaccttcgatacagaataccagaagaccaaaaacaacgactgggactacgtcgtgacgacagatatttccgagatgggcgctaattttagagccgaccgggttatcgatcccagacgctgccttaagcctgtgattctgaaggacgggcccgaacgggtcatcctggcgggcccgatgcctgtgaccgttgctagcgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatctgccgctattgatggggagtatcggctcagaggagaggcccgcaagacgtttgtggaactgatgagacggggcgacctgcctgtctggctctcctacaaagtggctagcgaggggttccagtattccgatcgcagatggtgctttgacggcgaacggaacaatcaagtccttgaggaaaacatggatgtggagatctggaccaaggagggagaacgcaaaaagctgagaccgcggtggctggacgccagaacatactctgaccccctcgctctgcgcgagttcaaggaatttgccgcgggccggagaagcgtttccggggatcttatcctggagattggaaaactccctcagcacctgacccagcgcgcccagaatgctctggacaacctcgtgatgcttcataattctgaacaaggcgggcgggcctatagacacgctatggaggagctgcccgatacaatcgaaaccctgatgctcctggcccttattgccgtgctgacaggaggcgtcaccctcttctttctgagcggccgggggctgggaaagacgtccatcggcctcctttgtgttatggctagctctgtgctgctgtggatggcgtccgtggagcctcattggattgccgctagcatcatcctcgagttctttctgatggtccttctgattcccgagccggaccgccagagaacacctcaggataaccagctcgcctacgtggttatcgggctgctgttcatgattctcaccgtggccgctaatgagatgggacttctggaaaccaccaagaaggacctgggcatcgggcacgtcgccgtggagaaccaccatcacgcggccatgctcgatgtcgacctgcatcccgcttctgcctggaccctttacgctgtggccacaacgattatcacccctatgatgcggcacacaattgaaaacaccacagcgaatatctccctgaccgccatcgctaaccaagccgctattctcatgggactggataaaggctggcccatcagcaagatggacattggcgttcctctgctcgcccttgggtgctattctcaggtgaatcccctgacgctgaccgctgccgtcctcatgctggtggcgcattacgccatcattggaccgggccttcaggctaaggccacacgcgaggctcagaagagaaccgccgccgggatcatgaagaaccctacagttgatggaatcgtggcgattgacctggatcccgtcgtgtatgacgctaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggttgaccggtctgaagctaaggaggggctgaaaagaggagagacaaccaagcacgccgtcagccgcggcacggctaagctccggtggtttgtggaaagaaatctggtgaaaccggaggggaaggtcatcgatcttggatgtggccgcgggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggcggacacttagagtgctgaaaatggttgaaccctggctgcgcggaaaccagttctgtattaagatcctcaatccttatatgcccagcgtggtcgagacgctggagcaaatgcagcggaaacacggcggcatgcttgtgagaaaccctctgtctcgcaattccacccatgaaatgtactgggttagctgcgggacaggaaacatcgtgtctgccgtcaatatgacctcccggatgctcctgaacagatttacaatggctcaccgcaagcccacctatgagcgggatgtggacctgggcgccgggacgagacacgtggctgtcgaaccggaggttgccaacctcgatattatcggacagcgcattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccaacagagagtctttaaggagaaagtggacacgcggacacctaaggccaagcgcggcaccgctcagatcatggaagttaccgccaaatggctgtgggggttcctctctagaaacaagaaaccgcggatttgtacaagagaggaatttacgcggaaggtgcgcagcaatgctgccatcggagccgtcttcgtggacgagaaccaatggaactccgcgaaagaggctgttgaagatgagagattttgggacctggtgcatcgggaacgcgagcttcacaagcagggcaagtgcgccacatgcgtctacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtggagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtcgtgagagttcaacggcccgctaaaaacgggaccgtgatggatgtcatctctcgcagagaccagcggggcagcggacaggtgggcacgtacgggctcaatacctttacaaacatggaagcccagctgattcgccaaatggagtccgagggaatcttcagcccttctgaactggagacccccaacctcgcgggcagagtgctggattggcttgaaaagcatggggttgagcggctgaaaagaatggccatctccggagacgactgtgtggtcaagccgattgatgaccgctttgctacagccctcaccgctctgaatgatatgggcaaggtgcggaaagacgttcctcagtgggaacccagcaaggggtggaacgattggcaacaggtgcctttctgctctcaccactttcatcaacttatcatgaaagacggcagagagattgtcgtgccctgtcgcaatcaggatgagctggtcggacgggccagagtgtcccagggcgctgggtggagcctccgcgaaacggcctgcctgggaaagtcctatgcgcagatgtggcaactgatgtacttccaccggagagacctccgcctggccgctaacgccatctgttctgccgttcctgtggattgggtccccacaagccggaccacatggtccattcatgctcaccatcagtggatgaccacggaggacatgcttagcgtgtggaatagagtttggatcgaagagaacccgtggatggaagataaaacccacatttcttcctggggcgacgtgccttatctggggaagcgcgaggaccagtggtgcggaagcctcatcggcctgacagcccgggcgacctgggctacaaatatccaagtcgccattaaccaggtgagacggcttatcgggaatgagaactacctggattacatgacctctatgaagagatttaaaaatgaaagcgaccccgagggcgccctctggtga

SEQ ID NO: 19026 - RNA, 9879 nt, synthetic construct
  misc_feature 1..9879: note = derived and/or modified CDS sequence (opt5) from DENV-1__GQ199781__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgctacccgcctcgaaaacattatgtggaaacagatctccaacgagctgaatcatattcttctggaaaacgacatgaagttcacggttgtggtcggagatgtggtgggcatcctcgcccaggggaaaaagatgattcggccgcaacccatggagcacaaatactcttggaaaagctggggaaaggctaagatcatcggcgccgacgcccagaatacaacctttattatcgatgggcctaacacccccgaatgtcctgacgatcagagagcttggaatatttgggaggtcgaggactatggattcggcatctttacaaccaacatttggctgaagctgcgcgattcctacacgcaggcgtgcgaccaccggcttatgagcgccgctatcaaagattctaaggccgttcatgccgacatgggctattggatcgaatccgagaaaaatgaaacatggaagctcgctagagccagcttcattgaggtgaagacctgtatctggcccaaatctcacacactgtggtccaacggggtgctggaaagcgagatggtcattccgaagatctacggaggccctatttctcaacataattatcgccccgggtacttcacccagacagcgggaccttggcacctcggcaaactggagcttgattttgacctgtgcgaagggaccacggtggttgtggatgagcactgcggaaaccggggccccagcctcagaaccacaaccgtcacaggcaagatcatccatgaatggtgttgccggtcctgtaccctgcctcccctgcgcttcaaaggggaggacggatgctggtacggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgcaagatgctcatgacggggacactggccgttttccttctgctcattatgggacagctgacctggaacgatctgatccggctttgcattatggtgggcgccaatgcttctgacagaatgggcatggggacaacctatctggccctcatggcgacctttaaaatgcgccctatgttcgctgtcggactgctctttagacggctgacaagccgcgaggtgcttctgctcacgatcggcctgtccctggtggcctctgtcgaacttcccaacagcctggaggaactcggggatggactggccatgggcatcatgattctcaagctgcttaccgacttccaatcccaccagctgtgggctacactcctgagcctgacctttatcaaaacaaccctttctctgcattacgcctggaagacgatggctatggttctctccattgtgagcctgttccccctctgtctgtctacaacctcccagaagaccacatggcttcctgtgctgctggggagcctcggatgcaaaccgctgaccatgtttcttatcgccgagaataagatttggggcagaaaatcttggcccctgaacgaaggcatcatggcggtcggggtggtttccatcctcctgagctccctcctgaagaacgatgtgcctcttgccggacccctgattgctggcgggatgctgatcgcctgttatgtcattagcggatctagcgctgacctctccctggagaaagccgccgaggtgtcttgggaagaggaagctgagcacagcggcgcgtcccataatatccttgttgaagtgcaggatgacgggacaatgaagattaaagatgaggagcgggacgatacgctgaccatcctcctgaaggccacactcctggctgtctctggagtgtaccctcttagcatccccgccaccctgttcgtctggtatttttggcaaaagaaaaagcagcgctccggcgtgctgtgggacacaccttctcccccggaagttgagagagccgtgctcgatgacggcatttaccggatcatgcagcgcgggctgcttggaagaagccaggtcggcgtgggggttttccaagaaaacgtgttccacaccatgtggcacgtcacgcggggagctgtgctgatgtatcagggcaaacgcctcgagccttcctgggccagcgtgaagaaagacctgatttcttacgggggaggctggagactccagggctcctggaataccggggaggaagttcaggtcatcgcggtggagcccggaaagaaccctaagaatgtgcaaacagctcccggcacctttaaaacaccggaaggggaggtcggagccattgccctggatttcaagcctggcaccagcgggtctcccatcgtgaaccgggaaggaaaaattgttggcctttacggcaatggggtggtcacaacgtccggaacctatgtgagcgctatcgcccagacaaaggcgtcccaggagggccctctgcccgagatcgaagacgaggtttttagaaaacgcaacctgaccattatggatctccatcccgggtctggaaagacccggagatacctgcctgctatcattcgcgaagccatcaagcggaaacttagaacactgattctcgccccgacgcgcgtggtcgctagcgagatggccgaagctctgaagggcatgcccatccggtatcaaaccacagccgtgaaatccgagcacaccgggaaggagatcgttgacctgatgtgccatgcgacattcaccatgagactccttagccctgtgcgcgtccccaattacaacatgattatcatggatgaagcccactttacggacccttcttccattgctgcccggggctatatcagcacaagagtgggaatgggcgaggctgccgccattttcatgaccgctacaccccctgggtctgtggaagcgtttccgcagagcaatgccgtcatccaggatgaggaacgggacatccccgagcgctcctggaactctggatacgagtggattacagatttccctggcaaaaccgtttggtttgtgcccagcatcaagtccgggaatgacattgctaactgtctgagaaagaatggaaaacgggtgatccagctgtctcgcaagacattcgataccgaatatcagaagacgaagaacaacgactgggactacgtcgtgacaaccgatattagcgagatgggcgccaattttagagccgaccgggttatcgatcctagacgctgcctcaaacccgtgattctgaaggacgggccggaacgggtcatccttgctggccctatgcccgtgacagttgcctccgcggctcagagacgcggacggatcggcagaaaccataataaggagggggatcagtacatttatatgggacagcccctgaacaatgacgaggatcacgcccactggaccgaagccaaaatgctcctggacaacatcaatacgcctgagggcattatccccgctctgttcgaacctgagcgcgaaaagagcgccgcgattgatggggagtaccggctcagaggagaggcccgcaaaaccttcgtggaacttatgagacggggcgacctgccggtctggctgtcttataaggtggcttccgaggggtttcaatacagcgatcgcagatggtgcttcgacggcgaacggaacaatcaggtcctcgaggaaaacatggatgtggagatctggacaaaagagggagaacgcaagaaactgagaccccggtggcttgacgccagaacctattccgaccctctggctctccgcgagtttaaggagttcgccgctggccggagatctgttagcggggatctgatcctggagattggaaagctcccccagcatcttacacagcgcgcccaaaatgcgctggacaacctggtgatgctccacaattccgaacagggcgggcgggcctacagacatgctatggaggagctgcctgataccatcgaaacacttatgctgctcgccctgattgctgtgctgaccggaggcgtcacgctctttttcctttctggccgggggctgggaaaaacaagcatcggcctgctctgtgttatggcctccagcgtgctgctttggatggcctctgtggagccccactggattgctgcgtccatcatcctggaatttttcctcatggtcctgctgattccggagcctgaccgccagagaacaccccaggataaccaactcgcctatgtggttatcgggcttctgtttatgattctgaccgtggctgccaatgagatgggactcctggaaacaaccaagaaagaccttggcatcgggcacgtcgccgtggagaaccatcaccatgctacaatgctggatgtcgacctccaccctgccagcgcgtggacgctgtacgccgtggctaccacaattatcacccccatgatgcggcatacaattgaaaacaccacggccaatatctctctgaccgctatcgccaaccaggcggccattctcatgggacttgataagggctggcctatctccaaaatggacattggcgttcccctgctggctctcgggtgctacagccaggtgaatccgctgacacttaccgccgctgtcctgatgctcgtggcccactatgctatcattggacctggcctgcaagccaaggcgacacgcgaggcccagaagagaaccgctgccgggatcatgaaaaaccccacggttgatggaatcgtggctattgacctggatcccgtcgtgtacgacgccaagttcgaaaaacagctcggccagatcatgcttctgattctgtgtacatctcaaatcctcctgatgcggaccacatgggccctttgcgagagcattaccctggcgaccgggcctctcacaacgctgtgggagggatccccgggcaagttttggaataccacaatcgctgtgtctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatttacaagagaagcggcatcatggaggttgaccggtccgaagccaaagaggggcttaagagaggagagaccacgcgccacgcggtctctcggggcacagccaaactgagatggttcgtggaacgcaatctcgtgaagcccgaggggaaggtcattgatctgggatgtggcagagggggatggagctattactgcgctggcctgaaaaaggttaccgaagtgaaaggctataccaaagggggacctggccatgaggaacccatccctatggccacatacgggtggaacctcgtgaaacttcactccggaaaggacgtctttttcgctccccctgagaaatgtgataccctgctgtgcgacattggcgagtctagcccgaatcccacaatcgaagaggggagaacgctccgcgtgctgaagatggttgaaccttggcttcggggaaaccaattttgtattaagatcctgaatccctacatgccttccgtggtcgagaccctcgagcagatgcagagaaaacatggcggcatgctggtgcgcaaccccctgagcagaaattctacacacgaaatgtattgggtttcctgcgggaccggaaacatcgtgagcgccgtcaatatgacatctagaatgctcctgaaccgcttcaccatggcgcaccggaagccgacgtacgagagagatgtggaccttggcgccgggacccgccatgtggctgtcgaacctgaggttgccaacctggatattatcggacagagaattgaaaatatcaaacacgagcataagtccacatggcactatgacgaggataacccctacaaaacctgggcttatcatggcagctacgaagtgaagccctctgggtccgccagctccatggtgaatggagtcgtgaagctcctgacaaaaccttgggacgttattcccatggtgacccaaatcgctatgacagataccacgccttttggccagcagcgggtcttcaaggagaaagtggacacacgcaccccgaaggccagacggggcaccgcgcaaatcatggaagttacagccagatggctttgggggtttctgagccggaacaaaaagccccgcatttgtacgagagaggagttcacccggaaggtgcgctctaatgctgccatcggagctgtctttgtggacgagaaccagtggaatagcgccaaagaggccgttgaagatgagagattctgggacctcgtgcagaaggaacgggagctgcacaaacagggcaagtgcgcgacatgcgtctataacatgatggggaaacgcgaaaagaagctgggagagtttggcaaagctaaggggtccagagccatttggtacatgtggctcggcgcccggttcctggagtttgaagctcttggattcatgaatgaggatcactggttctctcgcgaaaacagcctgtccggcgtggagggggagggactccataaactgggctacatccttagagacatttctaagatccctgggggaaatatgtatgccgatgacaccgctggctgggatacacggatcaccgaagacgatctgcaaaacgaggccaaaattacagacatcatggaacccgagcacgcgctcctggccaccagcatttttaagctgacgtaccagaataaagtcgtgcgcgttcagagacctgctaagaacgggaccgtgatggatgtcatctcccggcgcgaccagagaggctctggacaagtgggcacatatgggctcaataccttcacaaacatggaagcccagctgattcggcagatggagagcgagggaatctttcttccctccgaactggagaccccgaacctcgctgaaagagtgctggattggcttgagaagcatggcgttgaacgcctgaaacggatggccatcagcggggacgactgtgtggtcaagcctattgatgacagattcgcgacggccctcacagctctgaatgatatgggaaaagtgcgcaaggacatcccccagtgggagccttctaaaggctggaacgattggcaacaggttcccttttgctcccaccacttccatcagctgattatgaaggacgggcgggagatcgtggtcccttgtagaaatcaggatgaactcgtgggccgcgcccgggtcagccaaggagctggctggtctctgagagagaccgcctgccttgggaagtcctacgctcagatgtggcagctgatgtattttcaccgccgggacctcagactggccgcgaacgccatttgtagcgctgtgcccgttgattgggtgccgacatcccgcaccacgtggtctatccatgcccaccatcaatggatgaccacagaagacatgcttagcgtctggaatcgggtgtggattgaggaaaacccttggatggaggataaaacccacgtttccagctggggagacgtgccctacctgggcaagagagaggaccagtggtgcgggtctctcatcggactgacagcccgggctacctgggcctccaatatccaggtcgcgattaaccaggtgagacgcctgatcggcaatgaaaactatctcgattacatgacaagcatgaaacggttcaagaatgagggggaccccgaaggcgctctgtggtga

SEQ ID NO: 19027 - RNA, 9879 nt, synthetic construct
  misc_feature 1..9879: note = derived and/or modified CDS sequence (opt5) from DENV-1__GQ199782__SS-prME
  source 1..9879: mol_type = other RNA
agcgtgaccatgctgctcatgctgatgcccacagcccttgctttccacctgacgaccagaggaggggaacctcatatgatcgtgacaaagcaggaacggggaaaatccctcctgtttaagacctctgccggcgttaacatgtgcacacttattgcgatggacctgggggaactctgtgaagataccatgacatacaaatgccccagaatcaccgaggctgaacccgacgatgtggactgttggtgcaatgccacggatacctgggtgacatatggaacctgtagccaaacaggcgagcacagacgggacaagcgctccgtggccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacatccagaataccacctttatcattgatgggcctaacacacccgaatgtcctgacgatcagagagcttggaatatctgggaggtcgaggactatggattcggcatttttaccacgaacatctggctgcgcctgcgggattcctacacacaggtttgcgaccacagacttatgagcgcggccattaaggattctaaagctgtgcatgccgacatgggctattggatcgaatccgagaagaatgaaacctggaaactcgcccgcgctagcttcatcgaggtgaagacatgtatttggcccaagtctcacaccctgtggtccaacggggtcctggaaagcgagatgatcattccgaaaatctacggaggccctatttctcaacataattatcggcccgggtacttcacacagaccgccggaccttggcacctcggcaagctggagcttgattttgacctgtgcgaagggacgaccgtggttgtggatgagcactgcggaaacagaggccccagcctccggacaaccacagtcaccggcaaaatcatccatgaatggtgttgccgctcctgtacgctgcctcccctgagattcaagggggaggacggatgctggtacggcatggagattcggccggtgaaagaaaaggaggaaaatcttgttaagagcatggtgtctgcggggtccggagaggtcgacagcttttccctcggcctgctgtgtatctctattatggtggaagaggttatgagaagccgctggtcccggaaaatgctcatgacagggaccctggctgtgttccttctgctcatcatgggacagctgacatggaacgatctgattagactttgcatcatggtcggcgccaatgcctctgaccgcatgggcatggggaccacctatctggctctcatggccacatttaagattagacctatgttcgcggtgggactgctcgtgcggcgcctgacgagcagagaggtccttctgctcaccatcggcctgtccctggttgcttctgtggaacttcccaacagcctggaggaactcggggatggactggccatgggcatcatgattctcaaactgcttacagactttcaatcccaccagctgtgggccaccctcctgagcctgacattcatcaagaccacgctttctctgcattacgcttggaaaacaatggccatggtgctctccattgtcagcctgtttcccctctgtctgtctaccacctcccagaagacaacctggcttcctgtgctgctggggagcctcggatgcaagccgctgacaatgttccttatcacggagaataaaatttggggccggaagtcttggcccctgaacgaaggcatcatggctgttggggtggtctccatcctcctgagctccctcctgaaaaacgatgtgcctcttgccggacccctgattgcgggcgggatgctgatcgcctgttatgttattagcggatctagcgctgacctctccctggagaaggccgctgaggtgtcttgggaagaggaagccgagcacagcggcgcctcccataatatccttgtcgaagtgcaggatgacgggaccatgaaaattaaggatgaggagcgcgacgatacactgaccatcctcctgaaagctacactcctggcggtctctggagtgtaccctcttagcatccccgccaccctgtttgtttggtatttctggcaaaagaagaaacagagatccggcgtgctgtgggacacgccttctcccccggaagtcgagcgggctgtgctcgatgacggcatttaccgcatcatgcagagagggctgcttggacggagccaggttggcgtgggggtctttcaagaaaacgtgttccacaccatgtggcacgtgacacgcggagccgttctgatgtatcagggcaagagactcgagccttcctgggccagcgtcaaaaaggacctgatttcttacgggggaggctggcggctccagggctcctggaataccggggaggaagtccaggtgatcgctgtcgagcccggcaagaaccctaagaatgtgcaaacagcccccggcaccttcaagacaccggaaggggaggttggagcgattgctctggattttaaacctggcacgagcgggtctcccatcgtgaacagagaaggaaagattgtcggcctttacggcaatggggtggttaccacatccggaacctatgtgagcgccatcgcccaggctaaagcctcccaggagggccctctgcccgagatcgaagacgaggtcttccgcaagcggaacctgaccattatggatctccatcccgggtctggaaaaacaagacgctacctgcctgcgatcgtgcgggaagctattaagagaaaacttcgcacgctgatcctcgccccgacccgggttgtggccagcgagatggctgaagccctgaaaggcatgcccattagatatcaaacaaccgctgtcaagtccgagcacacagggaaagagatcgtggacctgatgtgccatgccacctttacgatgcgcctccttagccctgtgcgggtccccaattacaacatgatcattatggatgaagcgcacttcacagacccttcttccatcgccgctagaggctatattagcacccgggttggaatgggcgaggccgctgccatctttatgaccgccacaccccctgggtctgtggaggctttcccgcagagcaatgcggtgattcaggatgaggaacgcgacatccccgagagatcctggaactctggatacgagtggatcaccgattttcctggcaagacagtctggttcgtgcccagcattaaatccgggaatgacatcgccaactgtctgcggaagaatggaaagcgcgttattcagctgtctagaaaaacctttgatacggaatatcaaaagaccaagaacaacgactgggactacgtggtcaccacagatatcagcgagatgggcgctaatttccgggccgacagagtgattgatcctcgccggtgcctcaagcccgttatcctgaaagacgggccggaaagagtgattcttgccggccctatgcccgtcaccgtggcttccgccgcgcagcgccggggaagaatcggccgcaaccataataaggagggggatcagtacatctatatgggacagcccctgaacaatgacgaggatcacgctcactggacggaagccaagatgctcctggacaacattaatacccctgagggcatcattcccgccctgtttgaacctgagcgggaaaagagcgctgccatcgatggggagtacagactccgcggagaggcgagaaagacattcgtcgagcttatgcggcgcggcgacctgccggtgtggctgtcttataaagttgcctccgaggggttccaatacagcgatagacggtggtgctttgacggcgaacgcaacaatcaggtgctcgaggaaaacatggatgtggagatttggaccaaggagggagaacgcaaaaagctgcggcccagatggcttgacgctcgcacatattccgaccctctggccctccgggagttcaaagaatttgctgccggcagacgctctgtcagcggggatctgatcctggagatcggaaagctcccccagcatcttacccagcgggctcaaaatgccctggacaacctggttatgctccacaattccgaacagggcgggagagcgtaccggcatgccatggaggagctgcctgatacaattgaaacccttatgctgctcgctctgatcgccgtgctgacgggaggcgtgacactcttctttctttctggccgcgggctgggaaagaccagcattggcctgctctgtgtcatggcttccagcgtgctgctttggatggcctctgttgagccccactggatcgccgcttccattatcctggagttctttctcatggtgctgctgatcccggagcctgacagacagcggacaccccaggataaccaactcgcgtatgtcgtgattgggcttctgttcatgatcctgacagtcgccgctaatgagatgggactcctggaaaccaccaaaaaggaccttggcattgggcacgtggccgttgagaaccatcaccatgccacgatgctggatgtggacctccaccctgctagcgcctggaccctgtacgcggtcgccacaaccatcattacacccatgatgcgccataccatcgaaaacacgaccgctaatatttctctgacagccatcgctaaccaggccgcgatcctcatgggacttgataaaggctggcctatttccaagatggacatcggcgtgcccctgctggccctcgggtgctacagccaggttaatccgctgacccttacagctgccgtgctgatgctcgtcgctcactatgccattatcggacctggcctgcaagctaaagccaccagagaggcgcagaagcggacggccgctgggattatgaagaaccccacagtggatggaatcgtggccatcgacctggatcccgttgtctacgacgctaaatttgaaaagcagctcggccagattatgcttctgatcctgtgtacctctcaaattctcctgatgcgcacaacctgggccctttgcgagagcatcaccctggccacagggcctctcacgaccctgtgggagggatccccgggcaaattctggaatacaaccattgcggtgtctatggctaacatctttagaggcagctatctggccggggctggactcgccttctcccttatgaaaagcctgggcgggggacggcgcggcacaggggcccagggagaaaccctgggcgagaaatggaagagacagctcaatcagctgtccaagtctgaatttaacatctacaaacggagcggcattatggaggtggacagatccgaagctaaggaggggcttaaacgcggagagacgacacggcacgccgtctctagaggcaccgcgaagctgcgctggttcgttgaacggaatctcgtgaaacccgaggggaaggtgatcgatctgggatgtggcagagggggatggagctattactgcgccggcctgaagaaagtcaccgaagtgaagggctatacaaaagggggacctggccatgaggaacccattcctatggctacctacgggtggaacctcgttaaacttcactccggaaaagacgtgttctttacaccccctgagaagtgtgatacgctgctgtgcgacatcggcgagtctagcccgaatcccaccattgaagaggggcgcacactccgggtcctgaaaatggtggaaccttggcttagaggaaaccaattctgtatcaagattctgaatccctacatgccttccgttgtggagaccctcgagcagatgcagcgcaagcatggcggcatgctggtccggaaccccctgagcagaaattctacacacgaaatgtattgggtgtcctgcgggaccggaaacatcgtgagcgccgtcaatatgacgtctcgcatgctcctgaaccggtttaccatggctcacagaaaaccgacatacgagcgcgatgttgaccttggcgccgggaccagacatgtggcggtggaacctgaggtcgccaacctggatatcattggacagcggatcgaaaatatgaagcacgagcataaatccacatggcactatgacgaggataacccctacaagacctgggcttatcatggcagctacgaagtgaaaccctctgggtccgccagctccatggttaatggagtggtcaagctcctgacaaagccttgggacgtgattcccatggttacccaaatcgctatgacggatacaacccctttcggccagcagcgcgtgtttaaagagaaggtcgacaccagaacaccgaaagccaagcggggcacggctcaaattatggaagtgaccgccagatggctttgggggttcctgagccggaacaaaaagccccgcatctgtacaagagaggaatttacccggaaggttcgctctaatgcggccatcggagctgtgttcgtcgacgagaaccagtggaatagcgccaaagaggctgtggaagatgagagattttgggacctcgtccagaaggaacgggagctgcacaaacagggcaagtgcgccacatgcgtgtataacatgatggggaaacgcgaaaagaagctgggagagttcggcaaagccaaggggtccagagcgatttggtacatgtggctcggcgctcggtttctggagttcgaagcccttggatttatgaatgaggatcactggttctctcgcgaaaacagcctgtccggcgttgagggggagggactccataaactgggctacatccttagagacatttctaagatccctgggggaaatatgtatgccgatgacaccgctggctgggatacacggattaccgaagacgatctgcaaaacgaggccaaaatcacggacatcatggaacccgagcacgctctcctggccaccagcattttcaagctgacataccagaataaagtggtccgcgtgcagagacctgcgaagaacgggaccgtgatggatgttatctcccggcgcgaccagagaggctctggacaagtgggcacatatgggctcaatacctttacgaacatggaagcccagctgattcggcagatggagagcgagggaatcttccttccctccgaactggagacaccgaacctcgctgaaagagtcctggattggcttgagaagtacggcgtggaacgcctgaaacggatggccattagcggggacgactgtgttgtgaagcctatcgatgacagatttgctaccgccctcacagcgctgaatgatatgggaaaagtccgcaaggacatcccccagtgggagccttctaaaggctggaacgattggcaacaggtgcccttctgctcccatcactttcaccagctgattatgaaggacgggcgggagatcgtcgtgccttgtagaaatcaggatgaactcgttggccgcgcccgggtgagccaaggagctggctggtctctgagagagaccgcctgccttgggaagtcctatgctcagatgtggcagctgatgtacttccatcgccgggacctcagactggccgctaacgccatttgtagcgcggtccccgtggattgggttccgacgtcccgcaccacatggtctatccacgcccatcaccaatggatgaccacagaagacatgcttagcgtgtggaatcgggtctggattgaggaaaacccttggatggaggataaaacccatgtgtccagctggggagacgtgccctatctgggcaagagagaggaccagtggtgcgggtctctcatcggactgacagctcgggccacctgggcctccaatattcaggttgctatcaaccaggtcagacgcctgatcggcaatgaaaactacctcgattacatgacgagcatgaaacggtttaagaatgagggggaccccgaaggcgccctgtggtga

SEQ ID NO: 19028 - RNA, 9879 nt, synthetic construct
  misc_feature 1..9879: note = derived and/or modified CDS sequence (opt5) from DENV-1__GQ199783__SS-prME
  source 1..9879: mol_type = other RNA
agcgtgaccatgctgctgatgctgatgcccacagcccttgctttccacctgacgacccggggcggggaacctcatatgatcgtgaccaagcaggaacggggaaagtccctcctgtttaagacctctgccggcgttaatatgtgcacacttattgcgatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggaacgtccggcgccacctgggtggacgtcgtgctggagcacgggagctgtgtgacaaccatggctaaggataaacccacactcgacatcgaactgctgaagaccgaggtcacgaaccctgccgttctccgcaaactgtgcattgaagcgaagatctctaatacaaccaccgattccagatgtccgacacaaggagaggccacccttatggaagaacaagacgctaacttcgtgtgccggcgcacatttgtggatagaggctggggcaatgggtgtggactgttcggcaaagggagcctcattacgtgcgccaagtttaagtgcgtcaccaaactggagggaaagatcgtgcagtacgaaaaccttaaatattctgttatcgtgacagtccacaccggcgaccagcatcaagtggggaatgagtccacagaacacggaaccacggctaccattacaccccaggcccctaccagcgagatccagctgacagactacggcgccctcaccctggattgttctccccggacgggcctggacttcaacgaaatggttctcctgacaatgaaggagaaatcctggcttgtgcataagcagtggtttctggatctccctctgccctggaccagcggggcttccacatctcaagagacctggaatcgccaggaccttctggtcaccttcaaaacagcgcacgccaagaagcaggaagtggtcgtgctcggaagccaagagggcgctatgcacacggccctgaccggggccacagaaattcagacctccggaacaaccacgatctttgctggccatctgaaatgcagactcaagatggataaactgacacttaaggggatgagctatgttatgtgtaccggctctttcaaactggagaaggaagtggccgagacccagcacggaacagtcctcgtgcagattaagtacgagggcaccgacgcgccgtgcaaaatccctttctccacacaagatgaaaagggggttacgcagaacggacggctgatcaccgctaatcccattgtgacagacaaagagaagcctgtcaacatcgaagccgagccgccctttggcgagagctatattgtgatcggggccggagaaaaagctctgaaactttcttggttcaagaaaggcagctccattgggaagatgtttgaggccaccgctagaggcgcccgccggatggcgatcctcggagatacagcctgggacttcggctctgtcgggggagtttttaccagcgtcggcaaactggtgcatcagatcttcgggacggcttacggagtgctgttttccggcgtcagctggaccatgaagattgggatcggcgtgctcctgacatggcttggactcaattctagatccaccagcctctctatgacatgtattgccgttggcctggtgaccctgtaccttggggtcatggtgcaggctgattccggatgcgttatcaactggaaaggccgcgaactcaagtgtgggagcggaattttcgtgacaaatgaggtccacacctggacggaacaatataagtttcaggccgactcccctaaacggctgtctgcggccatcggcaaggcttgggaggagggggtgtgcggcattagaagctccacacgcctggaaaacatcatgtggaaacagatctctaacgagctcaatcatattctgcttgaaaacgacatgaagttcaccgttgtggtcggagatgtggtgggcatcctggcccaggggaaaaagatgattcggccgcaacccatggagcacaaatacagctggaagtcctggggaaaggctaaaatcattggcgccgacgtccagaataccacatttatcatcgatgggcctaacacccccgaatgtcctgacgatcagagagcctggaatatttgggaggttgaggactatggattcggcatctttacgacaaacatttggctcaagctgcgcgatagctacacccaggtgtgcgaccaccggctgatgtctgctgcgatcaaagattccaaggccgtgcatgctgacatgggctattggattgaaagcgagaaaaatgaaacatggaaacttgccagagcctctttcatcgaggtcaagacctgtatctggcccaaatcccacacactctggagcaacggggtgctggaatctgagatgattatcccgaagatttacggaggccctatcagccaacataattatcgccccgggtacttcacccagacggctggaccttggcacctgggcaaactcgagctggattttgacctttgcgaagggaccacagttgtggtcgatgagcactgcggaaaccggggcccctccctgagaaccacaaccgtgacgggcaagattatccatgaatggtgttgccggagctgtacactccctcccctgcgcttcaaaggggaggacggatgctggtacggcatggagatcagaccggttaaggaaaaggaggaaaatctggtgaaatctatggtctccgccgggagcggagaggtggactccttttctcttggcctcctgtgtattagcatcatgattgaagaggttatgcggtccagatggtctcgcaagatgctgatgaccgggacactcgcggtgttcctgcttctgatcatgggacagctcacctggaacgatctgattcggctgtgcatcatggtcggcgctaatgccagcgacagaatgggcatggggaccacatatcttgccctgatggctacgtttaaaattcgccctatgttcgccgtgggactcctgtttagacggctcacctcccgcgaggtgctgcttctgacaatcggcctctctctggtcgcgagcgttgaactgcccaactcccttgaggaactgggggatggactcgctatgggcatcatgattctgaagctcctgaccgacttccaaagccaccagctttgggccacactgctctctctgacctttatcaaaacgacactgtcccttcatcacgcctggaagaccatggctatggtgctgagcattgtgtctctcttccccctgtgtctctccaccacaagccagaagaccacatggctgcctgtccttctggggtctctgggatgcaaaccgctcacgatgtttctgatcaccgagaataagatttggggcagaaaatcctggccccttaacgaaggcatcatggccgtgggggttgtgagcatcctgctctccagcctgctcaagaacgatgtccctctggctggaccccttattgccggcgggatgctgatcgcgtgttacgtgatttctggaagctccgccgacctgtctctcgagaaagctgccgaggttagctgggaagaggaagctgagcattccggcgcctctcacaatatcctggtggaagtccaggatgacgggacaatgaagattaaagatgaggagcgggacgatacccttacaatcctgctcaaggccaccctgctcgctgtgagcggagtctatcctctgtccatccccgcgacgcttttcgtgtggtacttttggcaaaagaaaaagcagcgctctggcgttctgtgggacacccctagccctcccgaagtggagagagccgtcctggatgacggcatttatcggatcatgcagcgcgggctcctgggaagatcccaggtgggcgttggggtgttccaagaaaacgtcttccacacaatgtggcatgtgacccggggagctgtgcttatgtaccagggcaaacgcctggagcccagctgggcctctgttaagaaagacctcatttcctatgggggaggctggagactgcagggcagctggaatacaggggaggaagtccaggtgatcgccgtggagcccggaaagaaccctaagaatgtccaaaccgctcccggcacatttaaaacgccggaaggggaggtgggagccattgcgctcgatttcaagcctggcacctctgggtcccccatcgttaaccgggaaggaaaaattgtgggcctgtacggcaatggggtcgtgacaaccagcggaacctacgtttccgctatcgcccagacaaaggcctctcaggagggccctcttcccgagatcgaagacgaggtgtttagaaaacgcaacctgacgattatggatctgcaccccgggagcggaaagacccggagatatctccctgctatcgtccgcgaagccattaagcggaaactgagaacacttatcctggcgccgacccgcgtggttgcttccgagatggccgaagccctcaagggcatgcccattcggtaccaaacaaccgctgtgaaaagcgagcatacggggaaggagatcgtcgacctgatgtgccacgccacattcaccatgagactgctctctcctgtgcgcgtgcccaattataacatgatcattatggatgaagctcattttaccgacccttccagcatcgccgcgcggggctacatttctacaagagtcggaatgggcgaggccgctgccatcttcatgaccgctacaccccctgggagcgttgaagcctttccgcagtccaatgccgtgattcaggatgaggaacgggacatccccgagcgctcttggaacagcggatatgagtggatcaccgatttccctggcaaaacggtgtggtttgtcccctccattaagtctgggaatgacatcgctaactgtcttagaaagaatggaaaacgggtgattcagctgagccgcaagacattcgataccgaataccagaagaccaagaacaacgactgggactatgttgtgaccacggatatctccgagatgggcgcgaattttagagccgaccgggtcattgatcctagacgctgcctgaaacccgtgatcctcaaggacgggccggaacgggttattctggctggccctatgcccgtgaccgtcgccagcgccgctcagagacgcggacggatcggcagaaaccacaataaggagggggatcagtacatctacatgggacagccccttaacaatgacgaggatcacgcccattggacagaagcgaaaatgctgctcgacaacattaatacccctgagggcatcattcccgctctgttcgaacctgagcgcgaaaagtctgccgccatcgatggggagtatcggctgagaggagaggctcgcaaaacattcgtggaactcatgagacggggcgaccttccggtctggctgtcctacaaggtggccagcgaggggtttcaatattccgatcgcagatggtgcttcgacggcgaacggaacaatcaggttctggaggaaaacatggatgtggagatttggaccaaagagggagaacgcaagaaactcagaccccggtggctggacgcgagaacatactctgaccctcttgccctgcgcgagtttaaggagttcgctgccggccggagaagcgtgtccggggatctcatcctggagatcggaaagctgccccagcacctcacccagcgcgctcaaaatgcccttgacaacctggtcatgctgcataattctgaacagggcgggcgggcttatagacacgccatggaggagctccctgatacgattgaaacactgatgcttctggcgctcatcgccgttctgaccggaggcgtgaccctgtttttcctcagcggccgggggcttggaaaaacatccattggcctgctgtgtgtgatggctagctctgtcctcctgtggatggcctccgtggagccccactggatcgctgccagcattatccttgaatttttcctgatggttctcctgatcccggagcctgaccgccagagaacaccccaggataaccaactggcctacgtggtcattgggctcctttttatgatcctgacagtggctgcgaatgagatgggactgctcgaaacgaccaagaaagacctgggcattgggcatgtcgccgtggagaaccaccatcacgctacaatgcttgatgttgacctgcatcctgcctctgcctggaccctctatgctgtggccacaaccatcattacgcccatgatgcggcacaccatcgaaaacacaaccgcgaatatttccctgacagccatcgctaaccaggccgctatcctgatgggactcgataagggctggcctattagcaaaatggacatcggcgtcccccttctggccctggggtgctactctcaggtgaatccgctcaccctgacggcggccgttcttatgctggtggctcactacgccattatcggacctggcctccaagctaaggccacacgcgaggctcagaagagaaccgccgcggggattatgaaaaaccccacagtcgatggaatcgtggccatcgacctggatcccgtggtttatgacgctaagttcgaaaaacagctgggccagattatgctccttatcctgtgtaccagccaaattctgctcatgcggaccacatgggccctgtgcgagtccatcacgcttgctaccgggcctctgacaaccctctgggagggatctccgggcaagttttggaatacaaccattgccgtcagcatggccaacatcttccgcggctcctacctggcgggggctggactggcctttagcctcatgaaatcccttggcgggggaagacggggcacgggggctcagggagaaacactgggcgagaagtggaagcgccagctgaatcagctctctaaaagcgagttcaacatctataagagatccggcattatggaggtggaccggtctgaagccaaagaggggctgaagagaggagagaccacccgccatgccgtgagccggggcacagctaaacttagatggttcgtcgaacgcaatctggttaagcccgaggggaaggtgatcgatctcggatgtggcagagggggatggtcctactattgcgccggcctgaaaaaggtgaccgaagtcaaaggctacacaaaagggggacctggccacgaggaacccattcctatggcgacgtatgggtggaacctggtgaaactccattctggaaaggacgtctttttcacaccccctgagaaatgtgatacacttctgtgcgacatcggcgagagctccccgaatcccaccattgaagaggggagaacactgcgcgtgctcaagatggtcgaaccttggctgcggggaaaccaattttgtatcaagattcttaatccctacatgcctagcgtggttgagaccctggagcagatgcagagaaaacacggcggcatgctcgtgcgcaaccccctgtctagaaattccacgcacgaaatgtactgggtcagctgcgggaccggaaacatcgtgtctgccgtgaatatgacatccagaatgctgctcaaccgcttcaccatggctcatcggaagccgacatatgagagagatgtcgacctgggcgccgggacccgccacgttgctgtggaacctgaggtggccaaccttgatatcattggacagagaatcgaaaatattaaacatgagcacaagagcacatggcattacgacgaggataacccctataaaacctgggcgtaccacggctcttatgaagtcaagccctccgggagcgcctccagcatggtgaatggagttgtgaagctgctcacgaaaccttgggacgtcatccccatggtgacacaaattgctatgaccgataccacaccttttggccagcagcgggttttcaaggagaaagtggacacgcgcaccccgaaggccaaaagaggcacagctcaaatcatggaagtcaccgcccggtggctgtgggggtttctttctagaaacaagaagccccggatctgtacacgcgaggagttcaccagaaaagtgcggagcaatgctgccattggagcggtttttgtggacgagaaccagtggaactccgccaaggaggctgtcgaagatgagcgcttctgggacctggtgcagaaagaaagagagctccacaagcagggcaaatgcgccacatgcgtctacaacatgatggggaagcgggaaaagaaactgggagagtttggcaaggctaaagggtctcgcgccatctggtatatgtggctgggcgccagattcctcgagtttgaagcgctgggattcatgaatgaggatcattggttcagccgggaaaactccctttctggcgtggagggggagggactgcacaagctcggctacattctgcgcgacatcagcaaaattcctgggggaaatatgtacgctgatgacaccgccggctgggatacgagaatcaccgaagacgatcttcaaaacgaggccaagatcacagacattatggaacccgagcatgctctgctcgccacctccatctttaaactgacatatcagaataaggttgtgcgggtccagcgccctgctaagaacgggaccgtgatggatgtgatttctagacgggaccagcgcggcagcggacaagttggcacgtacgggctgaatacattcaccaacatggaagcccagctcatcagacagatggagtccgagggaatttttctgcccagcgaacttgagacaccgaacctggcggaacgggtgctcgattggctggagaaatatggcgtcgaaagacttaagcgcatggccatctctggggacgactgtgtggttaaacctatcgatgaccggttcgctaccgccctgacggctctcaatgatatgggaaaggtgagaaaagacattccccagtgggagccttccaagggctggaacgattggcaacaggtccccttttgcagccaccacttccatcagctgatcatgaaggacgggcgcgagattgtggtcccttgtcggaatcaggatgaactggtgggcagagcccgcgtttctcaaggagcgggctggtccctccgggagaccgcctgcctggggaaaagctacgctcagatgtggcagcttatgtattttcacagacgcgacctgcggctcgccgctaacgccatctgttccgctgtgcccgtcgattgggtgccgacatctagaaccacatggagcattcatgcccaccatcaatggatgaccacagaagacatgctgtccgtttggaatcgcgtgtggatcgaggaaaacccttggatggaggataagacccacgtcagctcttggggagacgtgccctaccttggcaaacgggaggaccagtggtgcgggtccctgattggactcacggcgagagccacatgggctagcaatatccaggtggccatcaaccaggttcggagactgattggcaatgaaaactatctggattacatgacctctatgaagcgcttcaaaaatgagggggaccccgaaggcgccctctggtga

SEQ ID NO: 19029 - RNA, 9879 nt, synthetic construct
  misc_feature 1..9879: note = derived and/or modified CDS sequence (opt5) from DENV-1__GQ199784__SS-prME
  source 1..9879: mol_type = other RNA
agcgtgaccatgctgctgatgctgatgcccaccgcccttgctttccacctgacgacccggggcggggaacctcatatgatcgtcacaaagcaggaacggggaaagtcccttctgtttaagacctctgccggcgttaacatgtgcacccttattgcgatggacctgggggaactctgtgaagataccatgacatacaagtgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgtcattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataagcccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggctgggcgtgcttctgacctggctcggactcaattctagatccacaagcctgtctatgacctgtattgctgttggccttgtgacactctacctgggggtcatggtgcaggccgattccggatgcgttatcaactggaaaggccgcgaactgaagtgtgggagcggaattttcgtgaccaatgaggtccacacatggaccgaacaatataagtttcaggctgactcccctaaacggctctctgccgcgatcggcaaggcctgggaggagggggtgtgcggcattagaagcgctacgcgcctggaaaacatcatgtggaaacagatctccaacgagcttaatcatattctgctcgaaaacgacatgaagttcacagttgtggtcggagatgtggtgggcatcctggcccaggggaaaaagatgattcggccgcaacccatggagcacaaatactcttggaaaagctggggaaaggctaagatcattggcgccgacgtccagaataccacctttatcatcgatgggcctaacacacccgaatgtcctgacgatcagagagcctggaatatttgggaggttgaggactatggattcggcatctttaccacgaacatttggctgaaacttcgcgattcccacacacaggtgtgcgaccatcggctcatgagcgctgcgatcaaagattctaaggccgtgcacgctgacatgggctactggattgaatccgagaaaaatgaaacctggaagctggccagagccagcttcatcgaggtcaagacatgtatctggcccaaatctcataccctgtggtccaacggggtgctcgaaagcgagatgattatcccgaagatttatggaggccctatctctcaacacaattaccgccccgggtatttcacacagaccgctggaccttggcacctgggcaaacttgagctggattttgacctctgcgaagggacgaccgttgtggtcgatgagcattgcggaaaccggggccccagcctgagaacaaccacagtgaccggcaagattatccacgaatggtgttgccggtcctgtacgctgcctccccttcgcttcaaaggggaggacggatgctggtacggcatggagatcagaccggttaaggaaaaggaggaaaatctcgtgaaaagcatggtctctgccgggtccggagaggtggacagcttttccctgggcctgctctgtatttctatcatgattgaagaggttatgcggagcagatggtcccgcaagatgctgatgacagggacccttgcggtgttcctgctcctgatcatgggacagctgacatggaacgatcttattcggctgtgcatcatggtcggcgctaatgcctctgacagaatgggcatggggaccacctacctcgccctgatggctacatttaaaatgcgccctatgttcgccgtgggactcctgtttagacggcttacgagccgcgaggtgctgctcctgaccattggcctgtcccttgtcgcgtctgttgaactgcccaacagcctcgaggaactgggggatggactcgctatgggcatcatgatcctgaaacttctgacagacttccaatcccatcagctctgggccaccctgctgagccttacatttattaaaaccacgctgtctctccactatgcctggaagacaatggctatggtgctgtccatcgtgagcctcttccccctgtgtctttctaccacctcccagaagacaacctggctgcctgtcctgctcgggagcctgggatgcaaaccgcttgccatgtttctgattgctgagaataagatctggggcagaaaatcttggcccctcaacgaaggcattatggccgtgggggttgtgtccatcctgctcagctccctgcttaagaacgatgtccctctggcgggacccctgatcgccggcgggatgctcattgcttgttacgtgatcagcggatctagcgccgacctgtcccttgagaaagctgccgaggtttcttgggaagaggaagccgagcatagcggcgcttcccacaatattctggtggaagtccaggatgacgggacaatgaagatcaaagatgaggagcgggacgatacgctcaccattctgctcaaggcgacactgcttgccgtgtctggagtctatcctctgagcatccccgctaccctgttcgtgtggtacttttggcaaaagaaaaagcagcgctccggcgttctctgggacacaccttctcccccggaagtggagagagccgtcctggatgacggcatctatcggattatgcagcgcgggcttctgggaagaagccaggtgggcgttggggtgttccaagaaaacgtcttccacaccatgtggcatgtgacgcggggagccgtgctcatgtaccagggcaaacgcctggagccttcctgggctagcgttaagaaagacctcatctcttatgggggaggctggagactgcagggctcctggaataccggggaggaagtccaggtgattgccgtggagcccggaaagaaccctaagaatgtccaaacagcgcccggcacctttaaaacaccggaaggggaggtgggagctatcgcccttgatttcaagcctggcaccagcgggtctcccattgttaaccgggaaggaaaaatcgtgggcctgtacggcaatggggtcgtgacaacgtccggaacctacgttagcgccattgctcaggccaaggcgtcccaggagggccctctgcccgagatcgaagacgaggtgtttagaaaacgcaacctcacaatcatggatctgcaccccgggtctggaaagacccggagatatcttcctgctattgtccgcgaagccatcaagcggaaactgagaaccctcattctggccccgacacgcgtggttgctagcgagatggccgaagctctgaagggcatgcccatccggtaccaaacgaccgccgtgaaatccgagcatacagggaaggagattgtcgacctcatgtgccacgcgaccttcacaatgagacttctgagccctgtgcgcgtgcccaattataacatgatcatcatggatgaagcccattttaccgacccttcttccattgctgcccggggctacatcagcacgagagtcggaatgggcgaggctgccgccattttcatgacagctacaccccctgggtctgttgaagcgtttccgcagagcaatgccgtgatccaggatgaggaacgggacattcccgagcgctcctggaactctggatatgagtggatcaccgatttccctggcaaaacagtgtggtttgtccccagcatcaagtccgggaatgacattgctaactgtctgagaaagaatggaaaacgggtgatccagctctctcgcaagaccttcgatacagaataccagaagaccaagaacaacgactgggactatgttgtgacgacagatattagcgagatgggcgccaattttagagccgaccgggtcatcgatcctagacgctgcctgaaacccgtgattcttaaggacgggccggaacgggttatcctggctggccctatgcccgtgaccgtcgcctccgcggctcagagacgcggacggattggcagaaaccacaataaggagggggatcagtacatctacatgggacagcccctcaacaatgacgaggatcacgcccattggacagaagccaaaatgctgctggacaacatcaatacccctgagggcattatccccgctctcttcgaacctgagcgcgaaaagagcgccgcgattgatggggagtatcggcttagaggagaggcccgcaaaacgttcgtggaactgatgagacggggcgacctgccggtctggctctcttacaaggtggcttccgaggggtttcaatatagcgatcgcagatggtgcttcgacggcgaacggaacaatcaggttctggaggaaaacatggatgtggagatctggaccaaagagggagaacgcaagaaacttagaccccggtggctggacgccagaacatactccgaccctctcgctctgcgcgagtttaaggagttcgccgctggccggagatctgtgagcggggatctgattctcgagatcggaaaacttccccagcacctgacccagcgcgcccaaaatgcgctggacaacctcgtcatgctgcataattccgaacagggcgggcgggcctatagacacgctatggaggagcttcctgatacaatcgaaaccctgatgctcctggccctgattgctgttctcacaggaggcgtgaccctctttttcctgtctggccgggggctgggaaaaacgagcatcggcctcctgtgtgtgatggcctccagcgtccttctgtggatggcctctgtggagccccactggattgctgcgtccatcattctcgaatttttcctgatggttctgctcatcccggagcctgaccgccagagaacaccccaggataaccaacttgcctacgtggtcatcgggctgctgtttatgattctcaccgtggctgccaatgagatgggactgcttgaaaccacaaagaaagacctgggcatcgggcatgtcgccgtggagaaccaccatcacgctaccatgctcgatgttgacctgcatcctgccagcgcgtggacactgtatgccgtggctacgaccattatcacacccatgatgcggcacaccattgaaaacacaaccgccaatatctctctcacggctattgccaaccaggcggccatccttatgggactggataagggctggcctatctccaaaatggacattggcgtccccctgctcgctctggggtgctacagccaggtgaatccgcttaccctgacagccgctgttctcatgctggtggcccactacgctatcattggacctggcctgcaagccaaggcgacccgcgaggcccagaagagaacagctgccgggatcatgaaaaaccccaccgtcgatggaattgtggctatcgacctcgatcccgtggtttatgacgccaagttcgaaaaacagcttggccagatcatgctgctgattctctgtacgtctcaaatcctgcttatgcggacaacctgggccctgtgcgagagcattacactcgcgaccgggcctctgaccacactgtgggagggatccccgggcaagttttggaatacgaccatcgctgtctctatggccaacattttccgcggcagctacctcgctggggccggacttgccttttccctgatgaaaagcctgggcgggggaagacggggcacaggggctcagggagaaaccctcggcgagaagtggaagcgccagctgaatcagctttccaaatctgagttcaacatctataagagaagcggcatcatggaggtggaccggtccgaagccaaagaggggctgaagagaggagagacaacccgccatgcggtgtctcggggcacggccaaactcagatggttcgtcgaacgcaatctggttaagcccgaggggaaggtgattgatctgggatgtggcagagggggatggagctactattgcgctggcctcaaaaaggtgacagaagtcaaaggctacaccaaagggggacctggccacgaggaacccatccctatggccacctatgggtggaaccttgtgaaactgcattccggaaaggacgtgtttttcacaccccctgagaaatgtgataccctgctctgcgacattggcgagtctagcccgaatcccacaatcgaagaggggagaacgctgcgcgttcttaagatggtcgaaccttggctgcggggaaaccaattttgtattaagatcctcaatccctacatgccttccgtggttgagaccctggagcagatgcagagaaaacacggcggcatgctggtgcgcaaccccctcagcagaaattctacacacgaaatgtactgggtctcctgcgggaccggaaacattgtgagcgctgtgaatatgacatctagaatgctgcttaaccgcttcaccatggcccatcggaagccgacgtatgagagagatgtcgacctgggcgcggggacccgccacgttgccgtggaacctgaggtggctaacctcgatatcatcggacagagaattgaaaatatcaaacatgagcacaagtccacatggcattacgacgaggataacccctataaaacctgggcctaccacggcagctatgaagtcaagccctctgggtccgctagctccatggtgaatggagttgtgaagctgcttacaaaaccttgggacgtcattcccatggtgacccaaatcgccatgacagataccacgccttttggccagcagcgggttttcaaggagaaagtggacacacgcaccccgaaggctaaaagaggcaccgcccaaattatggaagtcacagcgcggtggctgtgggggtttctcagcagaaacaagaagccccggatctgtacgcgcgaggagttcaccagaaaagtgcggtctaatgccgctatcggagccgtttttgtggacgagaaccagtggaatagcgctaaggaggccgtcgaagatgagcgcttctgggacctggtgcagaaagaaagagagctgcacaagcagggcaaatgcgccacatgcgtctacaacatgatggggaagcgggaaaagaaactcggagagtttggcaaggcgaaagggtcccgcgctatttggtatatgtggctgggcgccagattccttgagtttgaagccctgggattcatgaatgaggatcattggttctctcgggaaaacagcctctccggcgtggagggggagggactgcacaaacttggctacatcctgcgcgacatttctaaaatccctgggggaaatatgtacgctgatgacaccgccggctgggatacaagaattaccgaagacgatctccaaaacgaggctcggatcacagacatcatggaacccgagcatgccctgctggcgaccagcatttttaagctcacgtatcagaataaagttgtgcgcgtccagagacctgccaagaacgggaccgtgatggatgtgatctcccggcgcgaccagagaggctctggacaagttggcacatacgggctgaataccttcacaaacatggaagctcagcttattcggcagatggagagcgagggaatctttctgccctccgaactcgagacccagaacctggccgaaagagtgcttgattggctggagaagtatggcgtcgaacgcctcaaacggatggctattagcggggacgactgtgtggttaagccgatcgatgacagattcgccacggcgctgacagccctgaatgatatgggaaaagtgcgcaaggacatccctcaatgggagccctctaaaggctggaacgattggcagcaggtccctttttgctcccaccacttccatcagctcattatgaaggacgggcgggagatcgtggtcccctgtagaaatcaagatgaactggtgggccgcgctcgggttagccagggagccggctggtctcttagagagaccgcttgcctggggaagtcctacgcccagatgtggcaactcatgtattttcaccgccgggacctgagacttgctgccaacgcgatttgtagcgccgtgcctgtcgattgggtgcccacatcccgcaccacgtggtctatccatgctcaccatcagtggatgaccacagaagacatgctgagcgtttggaatcgggtgtggattgaggaaaacccgtggatggaggataaaacccacgtctccagctggggagacgtgccttacctcggcaagagagaggaccagtggtgcgggtctctgatcggactgacagcccgggccacctgggcttccaatattcaggtggccatcaaccaagttagacgcctcatcggcaatgaaaactatctggattacatgacaagcatgaaacggttcaagaatgagggggaccccgaaggcgcgctttggtga

SEQ ID NO: 19030 - RNA, 9879 nt, synthetic construct
  misc_feature 1..9879: note = derived and/or modified CDS sequence (opt5) from DENV-1__GQ199785__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttatcgcgatggacctgggggagctctgtgaagatacaatgacctacaagtgcccgagaatcacagaggtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaagcagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaggataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggcaaggggctcggaaaaacgagcatcggccttctgtgtgtgatggcttcttccgccctgctctggatggccagcgtcgagccccattggattgctgcgtctatcatcctggagttctttcttatggtgctgctcattccggagcctgaccgccagagaacaccccaggataaccaactggcctacgttgtgatcgggctcctgttcatgattcttaccgtcgctgccaatgagatgggactgctggaaaccacaaagaaagacctcggcatcgggcacgtggccgtcgagaaccaccatcacgctaccatgctggatgtggaccttcatcctgcctccgcgtggacactgtacgccgttgctacgaccattatcacacccatgatgcggcacaccattgaaaacacaaccgccaatatcagcctcacggctatcgccaaccaggcggccattctgatgggactggataagggctggcctatctctaaaatggacattggcgtgcccctccttgctctggggtgctatagccaggtcaatccgctgaccctcacagccgctgtgctgatgcttgttgcccattacgctatcattggacctggcctgcaagccaaggcgacccgcgaggcccagaagagaacagctgccgggatcatgaaaaaccccaccgtggatggaatcgtcgctattgacctcgatcccgtggtgtatgacgccaagtttgaaaaacagctgggccagatcatgctgctcattctttgtacgtcccaaatcctgctgatgcggacaacctgggccctctgcgagtctattacactggcgaccgggcctcttaccacactgtgggagggaagcccgggcaagttctggaatacgaccatcgctgtttccatggccaacatctttcgcggcagctacctcgctggggccggactggccttctccctgatgaaatctctcggcgggggaagacggggcacaggggctcagggagaaacccttggcgagaagtggaagcgccagctgaatcagctgagcaaatccgagttcaacacatataagagatctggcattatggaggtcgaccggagcgaagccaaagaggggctcagacgcggagagaccacgaagcacgcggtgtcccggggcacagccaaactgagatggtttgtggaacgcaatcttgtcaagcccgaggggaaggttatcgatctgggatgtggcagagggggatggtcttactattgcgctggcctcaaaaaggtgaccgaagtgaaaggctacaccaaagggggacctggccacgaggaacccattcctatggccacatacgggtggaacctggtcaaactgcatagcggaaaggacgtgttctttattccccctgagaaatgtgataccctcctttgcgacattggcgagtccagcccgaatcccacaatcgaagaggggagaacgctgcgcgttctgaagatggtggaaccttggctccggggaaaccaattctgtattaagatcctgaatccctatatgccttctgtcgtggagacccttgagcagatgcagagaaaacacggcggcatgctggttcgcaaccccctctcccggaatagcacacatgaaatgtactgggtgtcttgcgggaccggaaacatcgtctccgctgtgaatatgacaagcagaatgctgctgaaccgctttaccatggcccaccggaagccgacgtatgagagagatgtggacctcggcgcggggacccgccacgtcgccgttgaacctgaggtggctaacctggatattatcggacagagaattgaaaatatcaaacatgagcacaagtctacatggcattacgacgaggataacccctataaaacctgggcctaccacggctcctatgaagtgaagcccagcgggtccgctagctctatggtcaatggagtggttaaacttctgacaaaaccttgggacgtgattcccatggtcacccaaatcgccatgacagataccacgcctttcggccagcagcgggtgtttaaggagaaagttgacacacgcaccccgaaggctaaaagaggcaccgcccaaatcatggaagtgacagcgaagtggctctgggggttcctgagccggaacaagaaacccagaatttgtacgcgggaggaatttacccgcaaggtcagatccaatgccgctatcggagccgtgttcgttgacgagaaccagtggaactctgctaaagaggccgtggaagatgagcggttttgggaccttgtccatcgcgaaagagagctgcacaagcagggcaaatgcgccacatgcgtgtacaacatgatggggaagcgggaaaagaaactcggagagttcggcaaggcgaaagggagccgcgctatttggtacatgtggctgggcgccagatttctggagttcgaagccctcggattcatgaatgaggatcactggttttcccgggaaaactctctgagcggcgtcgagggggagggacttcataagctgggctatatcctccgcgacatttccaaaatccctgggggaaatatgtacgctgatgacaccgccggctgggatacaagaatcaccgaagacgatctgcagaacgaggctaagattacagacatcatgaaacccgaacacgcccttctggcgacctctattttcaagctcacgtatcaaaataaggtggttcgggtgcagcgccctgccagaaacgggaccgtcatggatgtgatcagccggcgcgaccagagaggctccggacaggtgggcacatacgggctgaatacctttacaaacatggaggctcaactgattcggcagatggaaagcgagggaatcttctctccctccgagctcgaaaccccgaacctggccgagagagttcttgattggctggaaaaacatggcgtggagcgcctcaagcggatggctatcagcggggacgactgtgtcgtgaaacctattgatgacagatttgccacggcgctgtctgcccttaatgatatgggaaaggttcgcaaagacatcccccagtgggaaccttccaagggctggaacgattggcagcaagtgcccttctgcagccaccactttcatcagctgattatgaaggacgggcgggagatcgtcgtgccttgtagaaatcaggatgagctcgtcggccgcgctcgggtgtcccagggagccggctggtctctgagagaaacagcttgcctggggaaaagctatgcccaaatgtggcagctcatgtacttccaccgccgggacctgagacttgctgccaacgcgatttgttccgccgttcccgtggattgggtcccgaccagccgcacaacctggtctatccatgctcaccatcagtggatgacgaccgaggacatgctgtccgtgtggaatcgggtttggattgaagagaacccttggatggaagataagacacacatcagctcttggggagacgtgccctatctcggcaaaagagaggaccaatggtgcgggagcctgatcggacttaccgcccgggccacatgggctaccaatattcaggtcgccatcaaccaggtgagacgcctgattggcaatgagaactacctcgattacatgacatccatgaagcggtttaaaaatgaatctgaccccgagggggcgctgtggtga

SEQ ID NO: 19031 - RNA, 9879 nt, synthetic construct
  misc_feature 1..9879: note = derived and/or modified CDS sequence (opt5) from DENV-1__GQ199786__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaagaagaagcagcggtccggcgtcctttgggacacgccttctcccccggaagtggagcgcgccgttctggatgacggcatctatagaattatgcagcgggggctgctcggacgcagccaggtgggcgtcggggtgtttcaagaaaacgttttccataccatgtggcacgtgacaagaggagccgtcctgatgtaccagggcaaacggcttgagccttcctgggctagcgtgaagaaagacctgatctcttacgggggaggctggagactccagggctcctggaataccggggaggaagtgcaggttattgccgtcgagcccggaaagaaccctaaaaatgtgcaaacagcgcccggcacctttaagacaccggaaggggaggtgggagctatcgccctggatttcaagcctggcacgagcgggtctcccattgtcaaccgcgaaggaaaaatcgtgggcctctatggcaatggggttgtgaccacatccggaacctacgtcagcgccatcgctcaggccaaggcgtcccaggagggccctctgcccgagattgaagacgaggtgtttcggaaaagaaaccttaccatcatggatctgcaccccgggtctggaaagacacgccggtatctgcctgctattgttagagaagccatcaaacgcaagctccggacgctgattcttgccccgaccagagtggtcgctagcgagatggccgaagctctgaagggcatgcccatccgctaccaaacaaccgccgtgaaatccgagcatacagggaaggagatcgttgacctcatgtgccacgcgaccttcacgatgcggctgctgagccctgtgagagtccccaattataacatgattatcatggatgaagcccattttacagacccttcttccattgctgcccggggctacatcagcacccgcgtgggaatgggcgaggctgccgccattttcatgaccgctacaccccctgggtctgtggaagcgtttccgcagagcaatgccgtcatccaggatgaggaaagagacatccccgagcggtcctggaactctggatatgagtggattaccgatttccctggcaaaacagtttggtttgtgcccagcatcaagtccgggaatgacattgctaactgtctccgcaaaaatggaaagagagtgatccagctttctcggaagaccttcgatacggaataccagaaaaccaagaacaacgactgggactacgtcgtgaccacagatattagcgagatgggcgccaatttcagagccgaccgcgttatcgatcctcggagatgcctgaaacccgtgattctgaaggacgggccggaacgcgtcatcctcgctggccctatgcccgtgaccgttgcctccgcggctcagcggagaggacgcatcggccggaaccacaataaagagggggatcagtatatttacatgggacagcccctgaacaatgacgaggatcatgcccactggacggaagccaagatgcttctggacaacatcaatacccctgagggcattatccccgctctctttgaacctgagagagaaaagagcgccgcgattgatggggagtatcgcctgagaggagaggcccggaaaacattcgtggaactgatgcgcagaggcgacctcccggtctggctttcttacaaggtggcttccgaggggtttcaatatagcgatcggcgctggtgcttcgacggcgaaagaaacaatcaggtcctggaggaaaacatggatgtggagatctggaccaaagagggagaacggaagaaactgagaccccgctggctcgacgcccggacatactccgaccctctggctcttagagagtttaaggagttcgccgctggccgccggtctgttagcggggatctgatcctcgagattggaaaactgccccagcacctgacccagagagcccaaaatgcgctcgacaaccttgtgatgctgcataattccgaacagggcgggcgggcctatcgccacgctatggaggagctgcctgatacaatcgaaaccctcatgctgcttgccctgattgctgtgctcacgggaggcgtcatcctgtttttcctgtctggcagagggctcggaaagacaagcattggccttctgtgtgttatggcctccagcgtgctgctctggatggcctctgtggagccccattggatcgctgcgtccatcattctggaatttttccttatggtcctgctcatcccggagcctgaccggcagcgcacaccccaggataaccaactggcctacgtggttattgggctgctctttatgatccttaccgtggctgccaatgagatgggactgctggaaacaaccaagaaagacctcggcattgggcacgtcgccgtggagaaccaccatcacgctgccatgctggatgtcgaccttcatcctgcgagcgcctggacactgtacgctgtggccacgaccatcattacacccatgatgagacacaccatcgaaaacacaaccgctaatatctctctcacggccattgcgaaccaggccgctatcctgatgggactggataagggctggcctatttccaaaatggacatcggcgttcccctccttgccctggggtgctatagccaggtgaatccgctgaccctcacagctgccgtcctgatgcttgtggctcattacgccattatcggacctggcctgcaagcgaaggccacccgggaggctcagaaacgcacagccgctgggatcatgaagaaccccaccgttgatggaattgtggccatcgacctcgatcccgtcgtgtatgacgccaagttcgaaaaacagctgggccagattatgctgctcatcctttgtacgtctcaaattctgctgatgagaacaacctgggcgctctgcgagagcatcacactggctaccgggcctcttaccacactgtgggagggatccccgggcaagttttggaatacgaccatcgccgtgtctatggctaacattttccggggcagctacctcgccggggccggactggctttctccctgatgaaaagcctcggcgggggacgcagaggcacaggggcccagggagaaacccttggcgagaagtggaaacggcagctgaatcagctgtccaagtctgaatttaacacatataagagaagcggcatcatggaggttgaccgctccgaagcgaaagaggggctcaagcggggagagaccacgaaacacgccgtctctagaggcacagctaagctgcgctggttcgtggaacggaatcttgtgaaacccgaggggaaggtcattgatctgggatgtggcagagggggatggagctactattgcgccggcctcaagaaagttaccgaagtgaagggctacaccaaagggggacctggccacgaggaacccatccctatggctacatacgggtggaacctggtgaagctgcattccggaaaagacgtctttttcattccccctgagaagtgtgataccctcctttgcgacatcggcgagtctagcccgaatcccacaattgaagaggggcgcacgctgcgggtgctgaaaatggttgaaccttggctcagaggaaaccaattttgtatcaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacattgtgagcgccgtcaatatgacatctcgcatgctgctgaaccggttcaccatggcgcacagaaaaccgacgtatgagcgcgatgtggacctcggcgccgggaccagacacgtggctgtcgaacctgaggttgccaacctggatatcattggacagcggatcgaaaatattaagcatgagcacaaatccacatggcattacgacgaggataacccctataagacctgggcttaccacggcagctatgaagtgaaaccctctgggtccgccagctccatggtgaatggagtcgtgaaacttctgacaaagccttgggacgttatccccatggtgacccaaatcgctatgacagataccacgccttttggccagcagcgcgtcttcaaagagaaggtggacacaagaaccccgaaagccaagcggggcaccgcgcaaattatggaagttacagccaaatggctctgggggtttctgagcagaaacaagaagccccggatctgtacgcgcgaggagttcaccagaaaagtgcggtctaatgctgccattggagctgtctttgtggacgagaaccagtggaatagcgccaaggaggccgttgaagatgagcgcttctgggaccttgtgcatagagaacgggagctgcacaaacagggcaagtgcgcgacatgcgtctacaacatgatggggaaacgcgaaaagaagctcggagagtttggcaaagctaaggggtccagagccatctggtacatgtggctgggcgcccggttcctggagttcgaagctctcggatttatgaatgaggatcactggttctctcgcgaaaacagcctgtccggcgtggagggggagggacttcataaactgggctatattctcagagacatctctaagatccctgggggaaatatgtacgccgatgacaccgctggctgggatacacggattaccgaagacgatctgcagaacgaggcccgcatcacagacattatggaacccgagcacgcgcttctggccagaagcatctttaaactcacctatcaaaataaggtcgtgcgggttcagcgccctgctaaaaacgggacggtgatggatgtcatttccagacgggaccagagaggctctggacaggtgggcacctacgggctgaatacattcaccaacatggaagcccaactgatccgccagatggagagcgagggaatcttttcccccagcgaactcgagacaccgaacctggctgaacgggtgcttgattggctggagaagtatggcgttgaaagactcaagcgcatggccatttctggggacgactgtgtggtcaaacctatcgatgaccggttcgcgaccgccctgacggctcttaatgatatgggaaaggtgagaaaagacattccccagtgggagccttccaagggctggaacgattggcagcaagttcccttttgcagccatcacttccaccagctgatcatgaaagacgggcgcgagattgtggtcccttgtcggaatcaggatgaactcgtgggcagagcccgcgtctctcagggagctggctggtccctgcgggagacagcctgcctgggaaagagctacgctcaaatgtggcagctcatgtattttcatagacgcgacctgcggcttgccgcgaacgccatctgttccgctgtgcccgttgattggattccgacctctagaacaacctggagcatccacgcccatcaccagtggatgacgaccgaagacatgctgtccgtgtggaatcgggtctggatcgaggaaaacccttggatggaggataagacacatattagctcttggggagacgtgccctacctcggcaaaagagaggaccaatggtgcgggtccctgatcggacttaccgcccgcgctacatgggccaccaatattcaggttgcgatcaaccaggtgcggagactgattggcaatgaaaactacctcgattatatgacaagcatgaagcgcttcaaaaatgagtctgaccccgaaggggctctgtggtga

SEQ ID NO: 19032 - RNA, 9879 nt, synthetic construct
  misc_feature 1..9879: note = derived and/or modified CDS sequence (opt5) from DENV-1__GQ199787__SS-prME
  source 1..9879: mol_type = other RNA
agcgtgaccatgctgctcatgctggtccccaccgcccttgctttccacctgacgacccggggcggggaacctcatatgatcgttacaaagcaggaacggggaaagtcccttctgtttaagacctctgccggcgtgaacatgtgcacccttattgcgatggacctgggggaactctgtgaagataccatgacatacaagtgcccccgcatcaccgaggctgaacccgacgatgtggactgttggtgcaatgccacggatacctgggttacatatggaacctgtagccaaacaggcgagcaccggcgggacaagcgctccgtggccctggctcctcatgttgggctgggactcgagaccagaacggaaacatggatgtctagcgagggcgcctggaaacagattcagcgggtggaaacctgggctctgcgccaccccggcttcacagtcatcgccctttttctggcgcatgccattgggacctccatcacccagaagggaatcattttcatcctcctgatgcttgtgacaccttctatggctatgagatgcgttggcattgggagccgggattttgtggagggactgtccggcgccacgtgggtcgacgtggtgctcgagcacgggagctgtgtcaccacaatggctaaggataaacccaccctggacatcgaactgctcaagacagaggttaccaaccctgccgtgctgcgcaaactttgcattgaagcgaagatctctaatacgacaaccgattccagatgtccgacccaaggagaggccacactgatggaagaacaagacgctaacttcgtgtgccggcgcacctttgtcgatagaggctggggcaatgggtgtggactcttcggcaaagggagcctgattacatgcgccaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgctacgattacaccccaggcccctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgatccagaacggacggctgattacagctaatcccatcgtcacggacaaagagaagcctgtgaacattgaagccgagccgccctttggcgagagctatatcgtgattggggttggagaaaaagcccttaagctctcttggttcaagaaaggcagctccatcgggaagatgtttgaggctaccgccagaggcgctcgccggatggccatcctgggagatacagcgtgggacttcggctctattgggggagtctttaccagcgtgggcaaactggtgcatcagatcttcgggacagcctacggagtcctcttttccggcgtgagctggaccatgaagattgggatcggcgttctgcttacgtggctgggactcaattctagatccaccagcctgtctatgacatgtattgctgtgggcctggtcaccctttacctcggggtgatggttcaggccgattccggatgcgtgatcaactggaaaggccgcgaactgaagtgtgggagcggaattttcgtcacaaatgaggtgcacacctggacagaacaatataagtttcaggctgactcccctaaacggctgtctgccgcgatcggcaaggcctgggaggagggggtttgcggcatcagaagcgctacccgcctcgaaaacattatgtggaaacagatctccaacgagctgaatcatattcttctggaaaacgacatgaagttcacggtggtcgtgggagatgtggtcggcatcctcgcccaggggaaaaagatgattcggccgcaacccatggagcacaaatactcttggaaaagctggggaaaggctaagatcatcggcgccgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacgcaggcttgcgaccaccggcttatgagcgcggccatcaaagattctaaggctgtgcatgccgacatgggctattggatcgaatccgagaaaaatgaaacatggaagctcgccagagctagcttcattgaggtcaagacctgtatctggcccaaatctcacacactgtggtccaacggggtgctggaaagcgagatggttattccgaagatctacggaggccctatttctcaacataattatcgccccgggtacttcacccagacagccggaccttggcacctcggcaaactggagcttgattttgacctgtgcgaagggaccacggtggtcgtggatgagcactgcggaaaccggggccccagcctcagaaccacaaccgttacaggcaagatcatccatgaatggtgttgccggtcctgtaccctgcctcccctgcgcttcaaaggggaggacggatgctggtacggcatggagattagaccggtgaaggaaaaggaggaaaatcttgtcaaaagcatggtgtctgcggggtccggagaggttgacagcttttccctcggcctgctgtgtatctctattatgatcgaagaggtgatgcggagcagatggtcccgcaagatgctcatgacggggacactggctgtcttccttctgctcattatgggacagctgacctggaacgatctgatccggctttgcattatggtgggcgccaatgcctctgacagaatgggcatggggacaacctatctggctctcatggccacctttaaaatgcgccctatgttcgcggtgggactgctctttagacggctgacaagccgcgaggtccttctgctcacgatcggcctgtccctggttgcttctgtggaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtcagcctgttccccctctgtctgtctacaacctcccagaagaccacatggcttcctgtgctgctggggagcctcggatgcaaaccgctgaccatgtttcttatcgctgagaataagatttggggcagaaaatcttggcccctgaacgaaggcatcatggccgttggggtggtctccatcctcctgagctccctcctgaagaacgatgtgcctcttgcgggacccctgattgccggcgggatgctgatcgcttgttatgttattagcggatctagcgccgacctctccctggagaaagctgccgaggtgtcttgggaagaggaagccgagcacagcggcgcttcccataatatccttgtcgaagtgcaggatgacgggacaatgaagattaaagatgaggagcgggacgatacgctgaccatcctcctgaaggcgacactcctggccgtctctggagtgtaccctcttagcatccccgctaccctgttcctgtggtatttttggcaaaagaaaaagcagcgctccggcgttctctgggacacaccttctcccccggaagtggagagagccgtcctggatgacggcatttaccggatcatgcagcgcgggcttctgggaagaagccaggtgggcgttggggtgttccaagaaaacgtcttccacaccatgtggcacgtgacgcggggagccgtgctcatgtatcagggcaaacgcctggagccttcctgggctagcgttaagaaagacctcatttcttacgggggaggctggagactgcagggctcctggaataccggggaggaagtccaggtgatcgccgtggagcccggaaagaaccctaagaatgtccaaacagcgcccggcacctttaaaacaccggaaggggaggtgggagctattgcccttgatttcaagcctggcaccagcgggtctcccatcgttaaccgggaaggaaaaattgtgggcctgtacggcaatggggtcgtgacaacgtccggaacctatgttagcgccatcgctcaggccaaggcgtcccaggagggccctctgcccgagatcgaagacgaggtgtttagaaaacgcaacctcacaattatggatctgcatcccgggtctggaaagacccggagataccttcctgctatcgtccgcgaagccattaagcggaaactgagaaccctcatcctggccccgacacgcgtggttgctagcgagatggccgaagctctgaagggcatgcccattcggtatcaaacgaccgccgtgaaatccgagcacacagggaaggagatcgtcgacctcatgtgccatgcgaccttcacaatgagacttctgagccctgtgcgcgtgcccaattacaacatgatcattatggatgaagcccactttaccgacccttcttccatcgctgcccggggctatattagcacgagagtcggaatgggcgaggctgccgccatcttcatgacagctacaccccctgggtctgttgaagcgtttccgcagagcaatgccgtgattcaggatgaggaacgggacatccccgagcgctcctggaactctggatacgagtggatcaccgatttccctggcaaaacagtgtggtttgtccccagcattaagtccgggaatgacatcgctaactgtctgagaaagaatggaaaacgggtgattcagctctctcgcaagaccttcgatacagaatatcagaagaccaagaacaacgactgggactacgttgtgacgacagatatcagcgagatgggcgccaattttagagccgaccgggtcattgatcctagacgctgcctgaaacccgtgatccttaaggacgggccggaacgggttattctggctggccctatgcccgtgaccgtcgcctccgcggctcagagacgcggacggatcggcagaaaccataataaggagggggatcagtacatctatatgggacagcccctcaacaatgacgaggatcacgcccactggacagaagccaaaatgctgctggacaacattaatacccctgagggcatcattcccgctctcttcgaacctgagcgcgaaaagagcgccgcgatcgatggggagtaccggcttagaggagaggcccgcaaaacgttcgtggaactgatgagacggggcgacctgccggtctggctctcttataaggtggcttccgaggggtttcaatacagcgatcgcagatggtgcttcgacggcgaacggaacaatcaggttctggaggaaaacatggatgtggagatttggaccaaagagggagaacgcaagaaacttagaccccggtggctggacgccagaacatattccgaccctctcgctctgcgcgagtttaaggagttcgccgctggccggagatctgtgagcggggatctgatcctcgagatcggaaaacttccccagcatctgacccagcgcgcccaaaatgcgctggacaacctcgtcatgctgcacaattccgaacagggcgggcgggcctacagacatgctatggaggagcttcctgatacaattgaaaccctgatgctcctggccctgatcgctgttctcacaggaggcgtgaccctctttttcctgtctggccgggggctgggaaaaacgagcattggcctcctgtgtgtgatggcctccagcgtccttctgtggatggcctctgtggagccccactggatcgctgcgtccattatcctcgaatttttcctgatggttctgctcatcccggagcctgaccgccagagaacaccccaggataaccaacttgcctatgtggtcattgggctgctgtttatgatcctcaccgtggctgccaatgagatgggactgcttgaaaccacaaagaaagacctgggcattgggcacgtcgccgtggagaaccatcaccatgctaccatgctcgatgttgacctgcaccctgccagcgcgtggacactgtacgccgtggctacgaccatcattacacccatgatgcggcataccatcgaaaacacaaccgccaatatttctctcacggctatcgccaaccaggcggccatccttatgggactggataagggctggcctatttccaaaatggacatcggcgtccccctgctcgctctggggtgctacagccaggtgaatccgcttaccctgacagccgctgttctcatgctggtggcccactatgctattatcggacctggcctgcaagccaaggcgacccgcgaggcccagaagagaacagctgccgggattatgaaaaaccccaccgtcgatggaatcgtggctatcgacctcgatcccgtggtttacgacgccaagttcgaaaaacagcttggccagattatgctgctgatcctctgtacgtctcaaattctgcttatgcggacaacctgggccctgtgcgagagcatcacactcgcgaccgggcctctgaccacactgtgggagggatccccgggcaagttttggaatacgaccattgctgtctctatggccaacatcttccgcggcagctatctcgctggggccggacttgccttttccctgatgaaaagcctgggcgggggaagacggggcacaggggctcagggagaaaccctcggcgagaagtggaagcgccagctgaatcagctttccaaatctgagttcaacatctacaagagaagcggcattatggaggtggaccggtccgaagccaaagaggggctgaagagaggagagacaacccgccacgcggtgtctcggggcacggccaaactcagatggttcgtcgaacgcaatctggttaagcccgaggggaaggtgatcgatctgggatgtggcagagggggatggagctattactgcgctggcctcaaaaaggtgacagaagtcaaaggctataccaaagggggacctggccatgaggaacccattcctatggccacctacgggtggaaccttgtgaaactgcactccggaaaggacgtctttttcacaccccctgagaaatgtgataccctgctctgcgacatcggcgagtctagcccgaatcccacaattgaagaggggagaacgctgcgcgtgcttaagatggtcgaaccttggctgcggggaaaccaattttgtatcaagattctcaatccctacatgccttccgtggttgagaccctggagcagatgcagagaaaacatggcggcatgctggtgcgcaaccccctcagcagaaattctacacacgaaatgtattgggtctcctgcgggaccggaaacatcgtgagcgctgtgaatatgacatctagaatgctgcttaaccgcttcaccatggcccaccggaagccgacgtacgagagagatgtcgacctgggcgcggggacccgccatgttgccgtggaacctgaggtggctaacctcgatatcattggacagagaatcgaaaatattaaacacgagcataagtccacatggcactatgacgaggataacccctacaaaacctgggcctatcatggcagctacgaagtcaagccctctgggtccgctagctccatggtgaatggagttgtgaagctgcttacaaaaccttgggacgtcatccccatggtgacccaaattgccatgacagataccacgccttttggccagcagcgggttttcaaggagaaagtggacacacgcaccccgaaggctaaaagaggcaccgcccaaatcatggaagtcacagcgcggtggctgtgggggtttctcagcagaaacaagaagccccggatctgtacgcgcgaggagttcaccagaaaagtgcggtctaatgccgctattggagccgtttttgtggacgagaaccagtggaatagcgctaaggaggccgtcgaagatgagcgcttctgggacctggtgcagaaagaaagagagctgcacaagcagggcaaatgcgccacatgcgtctataacatgatggggaagcgggaaaagaaactcggagagtttggcaaggcgaaagggtcccgcgctatctggtacatgtggctgggcgccagattccttgagtttgaagccctgggattcatgaatgaggatcactggttctctcgggaaaacagcctctccggcgtggagggggagggactgcataaacttggctacattctgcgcgacatctctaaaattcctgggggaaatatgtatgctgatgacaccgccggctgggatacaagaatcaccgaagacgatctccaaaacgaggctaagatcacagacattatggaacccgagcacgccctgctggcgaccagcatctttaaactcacgtaccagaataaggttgtgcgggtccagcgccctgccaagaacgggaccgtgatggatgtgatttccagacgggaccagcgcggctctggacaagttggcacatatgggctgaataccttcacaaacatggaagctcagcttatcagacagatggagagcgagggaatttttctgccctccgaactcgagaccccgaacctggccgaacgggtgcttgattggctggagaaacatggcgtcgaaagactcaagcgcatggctatcagcggggacgactgtgtggttaaacctatcgatgaccggttcgccacggcgctgacagccctgaatgatatgggaaaggtgagaaaagacattccccagtgggagccttctaagggctggaacgattggcaacaggtccccttttgctcccaccacttccatcagctcatcatgaaggacgggcgcgagattgtggtcccttgtcggaatgaagatgagctggtgggcagagctcgcgttagccagggagccggctggtctcttcgggaaaccgcttgcctggggaaatcctacgcccaaatgtggcagctcatgtattttcacagacgcgacctgcggcttgctgccaacgcgatctgtagcgccgtgcccgtcgattgggtgccgacatccagaaccacgtggtctattcatgctcaccatcagtggatgaccacagaggacatgctgagcgtttggaatcgcgtgtggatcgaagagaacccttggatggaggataagacccacgtctccagctggggagacgtgccctacctcggcaaacgggaagaccaatggtgcgggtctctgattggactgacagccagagccacctgggcttccaatatccaggtggccatcaaccaggttcggagactcattggcaatgagaactatctggattacatgacaagcatgaagcgcttcaaaaatgaaggggaccccgagggcgcgctttggtga

SEQ ID NO: 19033 - RNA, 9879 nt, synthetic construct
  misc_feature 1..9879: note = derived and/or modified CDS sequence (opt5) from DENV-1__GQ199788__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacaccgccggctgggatacacgcatcaccgaagacgatctccagaacgaggcgaagatcacagacattatggaacctgagcacgccctgcttgctaagtctatcttcaaactgacctatcagaataaggtcgtgagagttcaacggcccgccaaaaacgggacggtgatggatgtcattagccgcagagaccagcggggctccggacaggtgggcacctacgggctcaatacatttaccaacatggaagctcagctgatccgccaaatggagagcgagggaattttctctccttccgaactggagacacccaacctcgccagacgggtgctggattggcttgaaaagcatggcgttgagagactgaaacgcatggcgatcagcggggacgactgtgtggtcaagccgatcgatgaccggtttgccaccgctctcacggccctgaatgatatgggaaaggtgagaaaagacattcctcagtgggaaccctctaagggctggaacgattggcagcaggttcctttctgctcccaccactttcatcaacttatcatgaaagacgggcgcgagattgtggtcccctgtcggaatcaggatgagctggtgggcagagctcgcgtcagccagggagccggctggtccctccgggaaacagcttgcctggggaagtcttatgcccagatgtggcaactgatgtacttccacagacgcgacctccggctggcggccaacgctatctgtagcgccgtgcctgttgattgggtgcccacctccagaacaacctggagcattcatgcccaccatcagtggatgacgaccgaggacatgctttctgtctggaatcgcgtgtggatcgaagagaacccgtggatggaagataaaacacacatttccagctggggagacgttccttatctgggcaagcgggaggaccagtggtgcgggtctctcatcggactgaccgctagagccacatgggcgaccaatatccaagtggctattaaccaggtccggagacttatcggcaatgagaactacctggattacatgacaagcatgaagcgctttaaaaatgaatccgaccccgagggggccctctggtga

SEQ ID NO: 19034 - RNA, 9879 nt, synthetic construct
  misc_feature 1..9879: note = derived and/or modified CDS sequence (opt5) from DENV-1__GQ199789__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggacatcttacgtgatgtgtaccggctccttcaagctggagaaagaagtcgccgagacccagcatggaacagtgctcgttcagatcaagtatgagggcaccgacgcgccgtgcaaaattccttttagcacacaggatgaaaagggggtgacgcaaaacggaagactgatcaccgctaatcccatcgtcacagacaaagagaagcctgtgaacattgaagccgagccgcccttcggcgagtcttacatcgtgattggggccggagaaaaggctctgaaacttagctggtttaagaaaggctcctctatcgggaagatgttcgaggccaccgctcggggcgccagacgcatggcgattctcggagatacagcctgggactttggcagcatcgggggagttttcacctccgtcggcaaactggtgcaccagatctttgggacggcttatggagtgctgttcagcggcgtctcttggaccatgaagattgggatcggcgtgctcctgacatggcttggactcaattcccggagcacctctctctccatgacatgtattgccgttggcctggtgaccctgtaccttggggtcatggtgcaggctgatagcggatgcgttatcaactggaagggcagagaactcaaatgtgggtccggaatttttgtgacaaatgaggtccatacctggacggaacagtacaagttccaagccgactctcctaaacgcctgagcgcggccatcggcaaggcttgggaggagggggtgtgcggcattcggtccgccacaagactggaaaacatcatgtggaaacagatctctaacgagctcaatcacattctgcttgaaaacgacatgaagtttaccgttgtggtcggagatgtggctggcatcctggcccaggggaaaaagatgattcgcccgcagcccatggagtataagtacagctggaaatcctggggaaaggccaaaatcattggcgctgacgtgcaaaataccacattcatcatcgatgggcctaacacccccgaatgtcctgacgatcagcgggcgtggaatatttgggaggtcgaggactatggatttggcatcttcacgacaaacatttggctcaagctgagagatagctacacccaggtttgcgaccaccgcctgatgtctgccgctatcaaagattccaaggccgtgcatgccgacatgggctattggattgaaagcgagaagaatgaaacatggaaacttgctcgggcctctttcatcgaggtgaagacctgtatctggcccaaatcccacacactctggagcaacggggtcctggaatctgagatgattatcccgaagatttacggaggccctaccagccagcataattatagacccgggtactttacgcaaaccgcgggaccttggcacctgggcaaactcgagctggatttcgacctttgcgaagggacaaccgtggttgtggatgagcactgcggaaaccgcggcccctccctgcggacaaccacggtcacaggcaagatcattcatgaatggtgttgcagaagctgtaccctccctcccctgcggtttaagggggaggacggatgctggtacggcatggagatccgcccggtgaaagaaaaggaggaaaatctggttaaatctatggtgtccgctgggagcggagaggtcgactccttctctcttggcctcctgtgtatcagcattatgatcgaagaggtgatgagatcccggtggtctagaaagatgctgatgacagggaccctcgccgtctttttcctgcttattatgggacagctgacctggaacgatctcatccgcctgtgcattatggtgggcgccaatgctagcgaccggatgggcatggggacaacgtatctggcccttatggcgacctttaaaatgagacctatgttcgctgtcggactgctctttcgcagactgacatcccgggaggtgctcctgcttaccatcggcctgtctctcgtggccagcgtcgaactgcccaactccctggaggaacttggggatggactggccatgggcattatgatcctcaagctgctcacagacttccagagccaccaactgtgggctacccttctgtctctcacgtttatcaagacaaccttctccctgcattacgcctggaaaaccatggctatggttctgagcattgtgtctctttttcccctgtgtctctccacaaccagccagaagacaacgtggctgcctgtgctcctggggtctcttggatgcaaaccgctgaccatgttcctgatcgccgagaataagatttggggccgcaaatcctggcccctcaacgaaggcatcatggcggtcgggattgtgagcatcctgctttccagcctgctcaagaacgatgttcctctggccggacccctcatcgctggcgggatgctgattgcctgttatgtgatctctggaagctccgctgacctttctctggagaaagccgccgaggtcagctgggaagaggaagctgagcactccggcgcgtctcataatattctggtggaagttcaggatgacgggacaatgaagatcaaggatgaggagagagacgataccctcacaattctgcttaaagccaccctgctcgctgtgagcggagtctaccctctgtccatccccgccacgctgttcgtgtggtatttttggcagaagaaaaagcaacggtctggcgtcctgtgggacacccctagccctcccgaagtggagcgcgccgttcttgatgacggcatctacagaattatgcagcgggggctgctgggacgctcccaggtgggcgtcggggtgttccaggaaaacgtttttcacacaatgtggcacgtgaccagaggagctgtcctcatgtatcaaggcaaacggctggagcccagctgggcctctgtgaagaaggaccttatctcctacgggggaggctggcgcctgcagggcagctggaatacaggggaggaagtgcaggttattgcggtcgagcccggcaaaaatcctaagaatgtgcagaccgctcccggcacattcaaaacgtctgaaggggaggtgggagccatcgccctcgattttaagccgggcacctccgggagccctattgtcaacagagaaggaaaaatcgtgggcctgtacggcaatggggttgtgacaacctccggaacctatgtctctgctattgcccaagcgaaggctagccaggagggccccctccctgagatcgaagacgaggtgttccggaagagaaacctgacaatcatggatcttcatcccgggtccggaaaaacgcgccggtacctgcccgccattgttagagaagccatcaagcgcaaactgcggaccctcattctggctcctacaagagtggtcgccagcgagatggctgaagcccttaagggcatgccgatccgctatcagaccacagcggtgaaaggggagcacaccggcaaggagattgttgacctgatgtgccatgccacgtttacaatgcggctcctgtctcccgtgagagtccctaattacaacatgatcatcatggatgaagctcacttcaccgacccctccagcattgccgctcgcggatatatctctacccgggtgggcatgggggaggccgccgctatttttatgacagcgacccctcccggaagcgtggaagccttccctcaatccaatgctgtcatccaggatgaggaaagagacattccggagcggtcttggaacagcggctacgagtggatcacagattttcccgggaagaccgtttggttcgtgccttccatcaaatctggaaatgacattgccaactgtctgcgcaagaatggcaaaagagtgatccagctcagccggaagacgttcgatacagaatatcagaaaaccaagaacaacgactgggactacgtcgtgacaaccgatatttccgagatgggggccaattttcgcgctgacagagttatcgatccccggagatgccttaagcctgtgattctgaaagacggccccgaacgcgtcatcctggccggaccgatgcctgtgacggttgcgagcgctgcccaacggagaggccgcattgggcggaaccataataaggagggagatcagtacatctatatgggccagcccctcaacaatgacgaggatcacgcccactggaccgaagctaaaatgctgcttgacaacatcaatacacccgaggggattatccctgccctgttcgaacccgagagagaaaagtctgcggccattgatggagagtaccgcctccggggcgaggctagaaaaacctttgtggaactgatgcgcagaggggacctgcctgtctggctctcctataaggtggccagcgagggcttccagtactccgatcggcgctggtgctttgacggagaaagaaacaatcaagtccttgaggaaaacatggatgtggagatctggacaaaagagggcgaacggaagaagctgcgcccgagatggctggacgctcggacctattctgaccccctcgccctgagagagttcaaagaatttgctgccgggcgccggagcgtttccggagatcttattctggagatcggcaagctccctcagcatctgacacagagagcgcagaatgccctggacaacctcgtgatgcttcacaattctgaacaagggggacgcgcttaccggcatgccatggaggagctgcccgataccatcgaaacgctgatgctcctggctcttattgccgtgctgacaggcggcgtcaccctcttctttctgagcgggagaggactgggcaaaacctccatcgggctcctttgtgttatggccagctctgctctgctgtggatggcgtccgtggagcctcactggattgccgctagcatcattctcgagttctttctgatggtgcttctgatccccgagccggaccggcagcgcacacctcaggataaccagctcgcctatgtcgtgatcggactgctgttcatgattctcaccgttgccgctaatgagatgggccttctggaaacaacgaagaaagacctggggatcggacacgtggccgtcgagaaccatcaccatgcggccatgctcgatgtggacctgcaccccgcttctgcctggaccctttacgctgtcgccacaaccattatcacacctatgatgagacataccattgaaaacacgaccgcgaatatctccctgacagccattgctaaccaagccgctatcctcatgggcctggataagggctggcccatcagcaagatggacattggggtgcctctgctcgcccttggatgctactctcaggttaatcccctgaccctgacagctgccgtgctcatgctggtcgcgcactatgccatcattggcccggggcttcaggctaaagccacccgggaggctcaaaagcgcacggccgccggaatcatgaaaaaccctacagtggatggcattgttgcgatcgacctggatcccgtggtctacgacgctaagtttgaaaaacagctcgggcagatcatgctgctggtgctctgtaccagccagattcttctgatgagaacaacctgggccctgtgcgagtccatcaccctcgctacaggacccctgacgaccctttgggagggctctcctggcaagttctggaatacaaccattgccgtgagcatggccaacatcttccgggggtcctatctggctggagccggcctcgcgtttagcctgatgaagtccctcgggggaggccgcagagggacaggagcccaaggcgaaaccctcggcgagaaatggaagcggcagcttaatcagctgtctaaaagcgagttcaacacgtacaagcgctccgggattatggaggttgacagatctgaagctaaagagggactgaagcggggcgagacaaccaagcacgccgtcagcagagggaccgctaaactccgctggtttgtggaacggaatctggtgaagccggagggaaaagtcatcgatcttggctgtgggagaggaggctggtcctattactgcgccggcctgaagaaagttacagaagtgaaggggtataccaaaggaggccccgggcatgaggaacctatccccatggcgacatacggatggaacctcgtgaagctgcactctggcaaggacgtcttctttattcctcccgagaaatgtgatacgctgctctgcgacatcggggagagctcccctaatccgaccattgaagagggacgcacacttcgggtgctgaagatggttgaaccctggctgagaggcaaccagttctgtatcaaaattctcaatccttacatgcccagcgtggtcgagaccctggagcaaatgcagcgcaagcatggcgggatgcttgtgcggaaccctctgtctagaaattccacacacgaaatgtattgggttagctgcggaaccggcaacatcgtgtctgccgtcaatatgacgtcccgcatgctcctgaaccggtttaccatggctcacagaaaacccacatacgagcgcgatgtggacctgggggccggaacccggcatgtggctgtcgaaccggaggttgccaacctcgatattatcggccagagaatcgaaaatattaagcacgagcataagagcacatggcactatgacgaggataacccttacaaaacctgggcttatcatgggtcttacgaagtgaagccctccggaagcgcctccagcatggtgaatggcgtcgtgaaactgcttacaaagccctgggacgttatccctatggtgacccagattgcgatgacggatacaacccccttcggccaacagcgcgtctttaaagagaaggtggacaccagaacacctaaggccaaacgggggacggctcagatcatggaagttaccgccaagtggctgtggggattcctctctcgcaacaaaaagccgagaatttgtacacgggaggaatttaccagaaaagtgcggagcaatgctgccatcggcgccgtcttcgtggacgagaaccaatggaactccgcgaaggaggctgttgaagatgagcgcttttgggacctggtgcacagagaacgggagcttcacaagcaggggaaatgcgccacatgcgtctataacatgatgggaaagcgcgagaaaaagctgggcgagttcgggaaagccaagggctctagagctatctggtacatgtggctcggagcccggttcctggagtttgaagctctgggcttcatgaatgaggatcattggtttagccgcgaaaactccctctctggggtggagggagagggcctgcacaaacttgggtacattctgagagacatcagcaagattcccggaggcaatatgtatgccgatgacaccgcggggtgggatacacggatcaccgaagacgatctccagaacgaggccaagattacggacatcatggaacctgagcatgctctgcttgccaaatccatcttcaagctgacctaccagaataaagtcgtgcgcgttcaaagacccgctaagaacggcacagtgatggatgtcatttctcggcgcgaccagagaggaagcggccaggtggggacctatggactcaatacatttaccaacatcgaagcccagctgattcggcaaatggagtccgaggaaatcttcagcccttctgagctggaaacgcccaacctcgcgggccgcgtgctggattggcttgagaaacacggggttgaaagactgaagcggatggccatttccggagacgactgtgtggtcaagccgatcgatgacagatttgctacagccctcaccgctctgaatgatatgggcaaagtgcgcaaggacatccctcagtgggagcccagcaaagggtggaacgattggcagcaggttcctttctgctctcaccattttcaccaacttattatgaaggacggccgggagatcgtggtcccctgtagaaatcaggatgaactggtgggacgcgcccgggtctcccagggcgctgggtggagcctcagagagacagcctgcctgggaaaatcctacgcgcagatgtggcaactgatgtatttccatcgccgggacctcagactggccgctaacgccatttgttctgccgtgcctgttgattgggtgcccaccagccgcacgacctggtccatccacgctcatcaccagtggatgacaaccgaagacatgcttagcgtctggaatcgggtgtggattgaggaaaacccgtggatggaggataagacacacatctcttcctggggcgacgttccttacctggggaagagagaggaccagtggtgcggaagcctcattggcctgaccgcccgcgcgacatgggctaccaatatccaagtggccatcaaccaggtccggagacttattgggaatgaaaactatctggattacatgacgtctatgaaacggtttaagaatgagagcgaccccgaaggcgccctctggtga

SEQ ID NO: 19035 - RNA, 9879 nt, synthetic construct
  misc_feature 1..9879: note = derived and/or modified CDS sequence (opt5) from DENV-1__GQ199790__SS-prME
  source 1..9879: mol_type = other RNA
agcgtgaccatgctgctcatgctgatgcccaccgcccttgctttccacctgacgacccggggcggggaacctcatatgatcgtcacaaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgtcattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataaacccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggattggcgtgctgcttacctggctgggactcaattctagatccacaagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgattggcaaggcctgggaggagggggtgtgcggcatcagaagcgctacgcgcctcgaaaacatcatgtggaaacagatttccaacgagctgaatcatatccttctggaaaacgacatgaagttcacagttgtggtcggagatgtggtgggcattctcgcccaggggaaaaagatgatccggccgcaacccatggagcacaaatactcttggaaaagctggggaaaggctaagattatcggcgccgacgtccagaataccacctttatcattgatgggcctaacacacccgaatgtcctgacgatcagagagcctggaatatctgggaggttgaggactatggattcggcatttttaccacgaacatctggctgaagctgcgcgattcccacacacaggtgtgcgaccatcggcttatgagcgctgcgattaaagattctaaggccgtgcacgctgacatgggctactggatcgaatccgagaaaaatgaaacctggaagctcgccagagccagcttcatcgaggtcaagacatgtatttggcccaaatctcataccctgtggtccaacggggtgctggaaagcgagatgatcattccgaagatctatggaggccctatttctcaacacaattaccgccccgggtatttcacacagaccgctggaccttggcacctcggcaaactggagcttgattttgacctgtgcgaagggacgaccgttgtggtcgatgagcattgcggaaaccggggccccagcctcagaacaaccacagtgaccggcaagatcatccacgaatggtgttgccggtcctgtacgctgcctcccctgcgcttcaaaggggaggacggatgctggtacggcatggagattagaccggttaaggaaaaggaggaaaatcttgtgaaaagcatggtctctgccgggtccggagaggtggacagcttttccctcggcctgctgtgtatctctattatgatcgaagaggttatgcggagcagatggtcccgcaagatgctcatgacagggaccctggcggtgttccttctgctcattatgggacagctgacatggaacgatctgatccggctttgcattatggtcggcgctaatgcctctgacagaatgggcatggggaccacctacctggccctcatggctacatttaaaatgcgccctatgttcgccgtgggactgctctttagacggctgacgagccgcgaggtgcttctgctcaccatcggcctgtccctggtcgcgtctgttgaacttcccaacagcctggaggaactcggggatggactggctatgggcatcatgattctcaagctgcttacagacttccaatcccatcagctgtgggccaccctcctgagcctgacatttatcaaaaccacgctttctctgcactatgcctggaagacaatggctatggtgctctccattgtgagcctgttccccctctgtctgtctaccacctcccagaagacaacctggcttcctgtcctgctggggagcctcggatgcaaaccgctggccatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttacgtgattagcggatctagcgccgacctctccctggagaaagctgccgaggtttcttgggaagaggaagccgagcatagcggcgcttcccacaatatccttgtggaagtccaggatgacgggacaatgaagattaaagatgaggagcgggacgatacgctgaccatcctcctgaaggcgacactcctggccgtgtctggagtctatcctcttagcatccccgctaccctgttcgtgtggtacttttggcaaaagaaaaagcagcgctccggcgttctgtgggacacaccttctcccccggaagtggagagagccgtcctcgatgacggcatttatcggatcatgcagcgcgggctgcttggaagaagccaggtgggcgttggggtgttccaagaaaacgtcttccacaccatgtggcatgtgacgcggggagccgtgctgatgtaccagggcaaacgcctcgagccttcctgggctagcgttaagaaagacctgatttcttatgggggaggctggagactccagggctcctggaataccggggaggaagtccaggtgatcgccgtggagcccggaaagaaccctaagaatgtccaaacagcgcccggcacctttaaaacaccggaaggggaggtgggagctattgccctggatttcaagcctggcaccagcgggtctcccatcgttaaccgggaaggaaaaattgtgggcctttacggcaatggggtcgtgacaacgtccggaacctacgttagcgccatcgctcaggccaaggcgtcccaggagggccctctgcccgagatcgaagacgaggtgtttagaaaacgcaacctgacaattatggatctccaccccgggtctggaaagacccggagatatctgcctgctatcgtccgcgaagccattaagcggaaacttagaaccctgatcctcgccccgacacgcgtggttgctagcgagatggccgaagctctgaagggcatgcccattcggtaccaaacgaccgccgtgaaatccgagcatacagggaaggagatcgtcgacctgatgtgccacgcgaccttcacaatgagactccttagccctgtgcgcgtgcccaattataacatgatcattatggatgaagcccattttaccgacccttcttccatcgctgcccggggctacattagcacgagagtcggaatgggcgaggctgccgccatcttcatgacagctacaccccctgggtctgttgaagcgtttccgcagagcaatgccgtgattcaggatgaggaacgggacatccccgagcgctcctggaactctggatatgagtggatcaccgatttccctggcaaaacagtgtggtttgtccccagcattaagtccgggaatgacatcgctaactgtctgagaaagaatggaaaacgggtgattcagctgtctcgcaagaccttcgatacagaataccagaagaccaagaacaacgactgggactatgttgtgacgacagatatcagcgagatgggcgccaattttagagccgaccgggtcattgatcctagacgctgcctcaaacccgtgatcctgaaggacgggccggaacgggttattcttgctggccctatgcccgtgaccgtcgcctccgcggctcagagacgcggacggatcggcagaaaccacaataaggagggggatcagtacatctacatgggacagcccctgaacaatgacgaggatcacgcccattggacagaagccaaaatgctcctggacaacattaatacccctgagggcatcattcccgctctgttcgaacctgagcgcgaaaagagcgccgcgatcgatggggagtatcggctcagaggagaggcccgcaaaacgttcgtggaacttatgagacggggcgacctgccggtctggctgtcttacaaggtggcttccgaggggtttcaatatagcgatcgcagatggtgcttcgacggcgaacggaacaatcaggttctcgaggaaaacatggatgtggagatttggaccaaagagggagaacgcaagaaactgagaccccggtggcttgacgccagaacatactccgaccctctggctctccgcgagtttaaggagttcgccgctggccggagatctgtgagcggggatctgatcctggagatcggaaagctcccccagcaccttacccagcgcgcccaaaatgcgctggacaacctggtcatgctccataattccgaacagggcgggcgggcctatagacacgctatggaggagctgcctgatacaattgaaacccttatgctgctcgccctgatcgctgttctgacaggaggcgtgaccctctttttcctttctggccgggggctgggaaaaacgagcattggcctgctctgtgtgatggcctccagcgtcctgctttggatggcctctgtggagccccactggatcgctgcgtccattatcctggaatttttcctcatggttctgctgatcccggagcctgaccgccagagaacaccccaggataaccaactcgcctacgtggtcattgggcttctgtttatgatcctgaccgtggctgccaatgagatgggactcctggaaaccacaaagaaagaccttggcattgggcatgtcgccgtggagaaccaccatcacgctaccatgctggatgttgacctccatcctgccagcgcgtggacactgtatgccgtggctacgaccatcattacacccatgatgcggcacaccatcgaaaacacaaccgccaatatttctctgacggctatcgccaaccaggcggccatcctcatgggacttgataagggctggcctatttccaaaatggacatcggcgtccccctgctggctctcgggtgctacagccaggtgaatccgctgacccttacagccgctgttctgatgctcgtggcccactacgctattatcggacctggcctgcaagccaaggcgacccgcgaggcccagaagagaacagctgccgggattatgaaaaaccccaccgtcgatggaatcgtggctatcgacctggatcccgtggtttatgacgccaagttcgaaaaacagctcggccagattatgcttctgatcctgtgtacgtctcaaattctcctgatgcggacaacctgggccctttgcgagagcatcacactggcgaccgggcctctcaccacactgtgggagggatccccgggcaagttttggaatacgaccattgctgtctctatggccaacatcttccgcggcagctacctggctggggccggactcgccttttcccttatgaaaagcctgggcgggggaagacggggcacaggggctcagggagaaaccctgggcgagaagtggaagcgccagctcaatcagctgtccaaatctgagttcaacatctataagagaagcggcattatggaggtggaccggtccgaagccaaagaggggcttaagagaggagagacaacccgccatgcggtgtctcggggcacggccaaactgagatggttcgtcgaacgcaatctcgttaagcccgaggggaaggtgatcgatctgggatgtggcagagggggatggagctactattgcgctggcctgaaaaaggtgacagaagtcaaaggctacaccaaagggggacctggccacgaggaacccattcctatggccacctatgggtggaacctcgtgaaacttcattccggaaaggacgtctttttcacaccccctgagaaatgtgataccctgctgtgcgacatcggcgagtctagcccgaatcccacaattgaagaggggagaacgctccgcgtgctgaagatggtcgaaccttggcttcggggaaaccaattttgtatcaagattctgaatccctacatgccttccgtggttgagaccctcgagcagatgcagagaaaacacggcggcatgctggtgcgcaaccccctgagcagaaattctacacacgaaatgtactgggtctcctgcgggaccggaaacatcgtgagcgctgtgaatatgacatctagaatgctcctgaaccgcttcaccatggcccatcggaagccgacgtatgagagagatgtcgaccttggcgcggggacccgccacgttgccgtggaacctgaggtggctaacctggatatcattggacagagaatcgaaaatattaaacatgagcacaagtccacatggcattacgacgaggataacccctataaaacctgggcctaccacggcagctatgaagtcaagccctctgggtccgctagctccatggtgaatggagttgtgaagctcctgacaaaaccttgggacgtcatccccatggtgacccaaattgccatgacagataccacgccttttggccagcagcgggttttcaaggagaaagtggacacacgcaccccgaaggctaaaagaggcaccgcccaaatcatggaagtcacagcgcggtggctttgggggtttctgagcagaaacaagaagccccggatctgtacgcgcgaggagttcaccagaaaagtgcggtctaatgccgctattggagccgtttttgtggacgagaaccagtggaatagcgctaaggaggccgtcgaagatgagcgcttctgggacctcgtgcagaaagaaagagagctgcacaagcagggcaaatgcgccacatgcgtctacaacatgatggggaagcgggaaaagaaactgggagagtttggcaaggcgaaagggtcccgcgctatctggtatatgtggctcggcgccagattcctggagtttgaagcccttggattcatgaatgaggatcattggttctctcgggaaaacagcctgtccggcgtggagggggagggactccacaagctgggctacattcttcgcgacatctctaaaattcctgggggaaatatgtacgctgatgacaccgccggctgggatacaagaatcaccgaagacgatctgcaaaacgaggctcggatcacagacattatggaacccgagcatgccctcctggcgaccagcatctttaagctgacgtatcagaataaagttgtgcgcgtccagagacctgccaagaacgggaccgtgatggatgtgatttcccggcgcgaccagagaggctctggacaagttggcacatacgggctcaataccttcacaaacatggaagctcagctgatccggcagatggagagcgagggaatttttcttccctccgaactggagacccagaacctcgccgaaagagtgctggattggcttgagaagtatggcgtcgaacgcctgaaacggatggctatcagcggggacgactgtgtggttaagccgatcgatgacagattcgccacggcgctcacagccctgaatgatatgggaaaagtgcgcaaggacattcctcaatgggagccctctaaaggctggaacgattggcagcaggtccctttttgctcccaccacttccatcagctgatcatgaaggacgggcgggagattgtggtcccctgtagaaatcaagatgaactcgtgggccgcgctcgggttagccagggagccggctggtctctgagagagaccgcttgccttgggaagtcctacgcccagatgtggcaactgatgtattttcaccgccgggacctcagactggctgccaacgcgatctgtagcgccgtgcctgtcgattgggtgcccacatcccgcaccacgtggtctattcatgctcaccatcagtggatgaccacagaagacatgcttagcgtttggaatcgggtgtggatcgaggaaaacccgtggatggaggataaaacccacgtctccagctggggagacgtgccttacctgggcaagagagaggaccagtggtgcgggtctctcattggactgacagcccgggccacctgggcttccaatatccaggtggccatcaaccaagttagacgcctgattggcaatgaaaactatctcgattacatgacaagcatgaaacggttcaagaatgagggggaccccgaaggcgcgctgtggtga

SEQ ID NO: 19036 - RNA, 9879 nt, synthetic construct
  misc_feature 1..9879: note = derived and/or modified CDS sequence (opt5) from DENV-1__GQ199791__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaagtcccttctgtttaagacctctgccggcgttaatatgtgcacccttattgccatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttcctgacccaagatgaaaagggggttacacagaacggacggcttatcacggctaatcccattgtgaccgacaaagagaagcctgtcaacatcgaagccgagccgccctttggcgagtcctatattgtgatcggggccggagaaaaagctctcaagctgagctggttcaagaaaggctctagcattgggaagatgtttgaggccacagctagaggcgcccgccggatggcgatcctgggagataccgcctgggacttcggctccatcgggggagtgtttacatctgttggcaaactcgtccatcagattttcgggaccgcttacggagtgctgtttagcggcgtgtcctggacgatgaagatcgggattggcgtccttctgacctggctcggactgaatagcagatctacatccctgagcatgacctgtatcgccgtgggccttgttacactctacctgggggtgatggtccaggctgattctggatgcgtgattaactggaaaggccgcgaactgaagtgtgggtccggaatcttcgttaccaatgaggtgcacacatggaccgaacaatataagtttcaggccgacagccctaaacggctctccgcggccattggcaaggcttgggaggagggggtctgcggcatcagatctgccacgcgcctggaaaacatcatgtggaaacagattagcaacgagcttaatcatatcctgctcgaaaacgacatgaagttcacagtggttgtgggagatgtcgtgggcattctggctcaggggaaaaagatgatccggccgcaacccatggagcacaaatactcctggaagtcttggggaaaggccaaaattatcggcgccgacgtgcagaataccacctttatcattgatgggcctaacacacccgaatgtcctgacgatcagagagcttggaatatctgggaggtcgaggactatggattcggcatttttaccacgaacatctggctgaaacttcgcgatagctacacacaggtttgcgaccaccggctcatgtccgcggccattaaagatagcaaggctgtgcatgccgacatgggctattggatcgaatctgagaaaaatgaaacctggaagctggccagagcttccttcatcgaggtgaagacatgtatttggcccaaaagccacaccctgtggtctaacggggtcctcgaatccgagatgatcattccgaagatctacggaggccctattagccaacataattatcgccccgggtacttcacacagaccgccggaccttggcacctgggcaaacttgagctggattttgacctctgcgaagggacgaccgtggttgtggatgagcactgcggaaaccggggcccctctctgagaacaaccacagtcaccggcaagatcatccatgaatggtgttgccggagctgtacgctgcctccccttcgcttcaaaggggaggacggatgctggtacggcatggagattagaccggtgaaggaaaaggaggaaaatctcgttaaatccatggtgagcgcggggtctggagaggtcgactcctttagcctgggcctgctctgtatctccattatgatcgaagaggtgatgcggtctagatggagccgcaagatgctgatgacagggacccttgctgttttcctgctcctgattatgggacagctgacatggaacgatcttatccggctgtgcattatggtgggcgccaatgcctccgacagaatgggcatggggaccacctatctcgctctgatggccacatttaaaatgcgccctatgttcgcggtcggactcctgtttagacggcttacgtctcgcgaggtgctgctcctgaccatcggcctgagccttgtggcttccgtcgaactgcccaactctctcgaggaactgggggatggactcgccatgggcatcatgattctgaaacttctgacagacttccaaagccaccagctctgggccaccctgctgtcccttacatttatcaaaaccacgctgagcctccattacgcttggaagacaatggccatggttctgtctattgtgtccctcttccccctgtgtcttagcaccacctctcagaagacaacctggctgcctgtgctgctcgggtccctgggatgcaaaccgcttacaatgtttctgatcgctgagaataagatttggggcagaaaaagctggcccctcaacgaaggcatcatggccgtcggggtggtttctatcctgctctccagcctgcttaagaacgatgtgcctctggcgggacccctgattgccggcgggatgctcatcgcttgttatgtcatttccggaagctctgccgacctgagccttgagaaagctgccgaggtgtcctgggaagaggaagccgagcactctggcgctagccataatatcctggttgaagtgcaggatgacgggacgatgaagattaaagatgaggagcgggacgataccctcacaatcctgctcaaggcgaccctgcttgccgtctccggagtgtaccctctgtctatccccgctacactgttcgtctggtatttttggcaaaagaaaaagcagcgcagcggcgtgctctgggacacccctagccctcccgaagttgagagagccgtgctggatgacggcatttaccggatcatgcagcgcgggcttctgggaagatctcaggtcggcgtgggggttttccaagaaaacgtgttccacacgatgtggcacgtcacccggggagccgtgctcatgtatcagggcaaacgcctggagcccagctgggcttccgtgaagaaagacctcattagctacgggggaggctggagactgcagggctcttggaatacaggggaggaagttcaggtcatcgccgtggagcccggaaagaaccctaagaatgtgcaaaccgcgcccggcacatttaaaaccccggaaggggaggtcggagctattgcccttgatttcaagcctggcacatccgggagccccatcgtgaaccgggaaggaaaaattgttggcctgtacggcaatggggtggtcacgacctctggaacatatgtgtccgccatcgctcaggccaaggcgagccaggagggccctctgcccgagatcgaagacgaggtttttagaaaacgcaacctcaccattatggatctgcatcccgggtccggaaagacccggagataccttcctgctatcgtgcgcgaagccattaagcggaaactgagaacactcatcctggccccgacgcgcgtcgtggcttctgagatggccgaagctctgaagggcatgcccattcggtatcaaaccacagccgttaaaagcgagcacaccgggaaggagatcgtggacctcatgtgccatgcgacattcaccatgagacttctgtcccctgtccgcgtgcccaattacaacatgatcattatggatgaagcccactttacggaccctagctctatcgctgcccggggctatatttccacaagagtgggaatgggcgaggctgccgccatcttcatgaccgctacaccccctgggagcgtcgaagcgtttccgcagtctaatgccgttattcaggatgaggaacgggacatccccgagcgcagctggaactccggatacgagtggatcacagatttccctggcaaaaccgtgtggtttgtgccctctattaagagcgggaatgacatcgctaactgtctgagaaagaatggaaaacgggtcattcagctctcccgcaagacattcgataccgaatatcagaagacgaagaacaacgactgggactacgtggttacaaccgatatctctgagatgggcgccaattttagagccgaccgggtgattgatcctagacgctgcctgaaacccgtcatccttaaggacgggccggaacgggtgattctggctggccctatgcccgttacagtggccagcgcggctcagagacgcggacggatcggcagaaaccataataaggagggggatcagtacatctatatgggacagcccctcaacaatgacgaggatcacgcccactggaccgaagccaaaatgctgctggacaacattaatacgcctgagggcatcattcccgctctcttcgaacctgagcgcgaaaagtccgccgcgatcgatggggagtaccggcttagaggagaggcccgcaaaaccttcgtcgaactgatgagacggggcgacctgccggtgtggctcagctataaggtcgcttctgaggggtttcaatactccgatcgcagatggtgcttcgacggcgaacggaacaatcaggtgctggaggaaaacatggatgttgagatttggacaaaagagggagaacgcaagaaacttagaccccggtggctggacgccagaacctatagcgaccctctcgctctgcgcgagtttaaggagttcgccgctggccggagatccgtgtctggggatctgatcctcgagatcggaaaacttccccagcatctgacacagcgcgcccaaaatgcgctggacaacctcgtgatgctgcacaatagcgaacagggcgggcgggcctacagacatgctatggaggagcttcctgataccattgaaacactgatgctcctggccctgatcgctgtcctcaccggaggcgttacgctctttttcctgtccggccgggggctgggaaaaacatctattggcgtgctctgtgtgatggccagctccgtcctgctttggatggccagcgtggagccccactggatcgctgcgtctattatcctggaatttttcctcatggttctgctgatcccggagcctgaccgccagagaacaccccaggataaccaactcgcctatgtggtcattgggcttctgtttatgatcctgaccgtggctgccaatgagatgggactcctggaaacaaccaagaaagaccttggcattgggcacgtcgccgtggagaaccatcaccatgctacaatgctggatgttgacctccaccctgcctccgcgtggacgctgtacgccgtggctaccacaatcattacccccatgatgcggcatacaatcgaaaacaccacggccaatattagcctgaccgctatcgccaaccaggcggccatcctcatgggacttgataagggctggcctatttctaaaatggacatcggcgtccccctgctggctctcgggtgctactcccaggtgaatccgctgacacttaccgccgctgttctgatgctcgtggcccactatgctattatcggacctggcctgcaagccaaggcgacacgcgaggcccagaagagaaccgctgccgggattatgaaaaaccccacggtcgatggaatcgtggctatcgacctggatcccgtggtttacgacgccaagttcgaaaaacagctcggccagattatgcttctgatcctgtgtacaagccaaattctcctgatgcggaccacatgggccctttgcgagtctatcaccctggcgaccgggcctctcacaacgctgtgggagggaagcccgggcaagttttggaataccacaattgctgtctccatggccaacatcttccgcggctcttatctggctggggccggactcgcctttagccttatgaaatccctgggcgggggaagacggggcaccggggctcagggagaaacactgggcgagaagtggaagcgccagctcaatcagctgagcaaatccgagttcaacatctacaagagatctggcattatggaggtggaccggagcgaagccaaagaggggcttaagagaggagagaccacgcgccacgcggtgtcccggggcacagccaaactgagatggttcgtcgaacgcaatctcgttaagcccgaggggaaggtgatcgatctgggatgtggcagagggggatggtcttattactgcgctggcctgaaaaaggtgaccgaagtcaaaggctataccaaagggggacctggccatgaggaacccattcctatggccacatacgggtggaacctcgtgaaacttcacagcggaaaggacgtgtttttcacaccccctgagaaatgtgataccctgctgtgcgacatcggcgagtcctctccgaatcccacgattgaagaggggagaaccctccgcgttctgaagatggtcgaaccttggcttcggggaaaccaattttgtatcaagattctgaatccctacatgcctagcgtggttgagacactcgagcagatgcagagaaaacatggcggcatgctggtgcgcaaccccctgtcccggaatagcacccacgaaatgtattgggtctcttgcgggacaggaaacatcgtgtccgctgtgaatatgaccagcagaatgctcctgaaccgcttcacgatggcccaccggaagccgacctacgagagagatgtcgaccttggcgcggggacacgccatgttgccgtggaacctgaggtggctaacctggatatcattggacagagaatcgaaaatattaaacacgagcataagtctacctggcactatgacgaggataacccctacaaaacatgggcctatcatggctcctacgaagtcaagcccagcgggtctgcttccagcatggtgaatggagttgtgaagctcctgaccaaaccttgggacgtcatccccatggtgacacaaattgccatgaccgatacgacaccttttggccagcagcgggttttcaaggagaaagtggacacccgcaccccgaaggctaaaagaggcacagcccaaatcatggaagtcacggcgcggtggctttgggggtttctgtccagaaacaagaagccccggatctgtacccgcgaggagttcacaagaaaagtgcggagcaatgccgctattggagccgtttttgtggacgagaaccagtggaactctgctaaggaggccgtcgaagatgagcgcttctgggacctcgtgcagaaagaaagagagctgcacaagcagggcaaatgcgcgacctgcgtctataacatgatggggaagcgggaaaagaaactgggagagtttggcaaggcgaaagggagccgcgctatctggtacatgtggctcggcgccagattcctggagtttgaagcccttggattcatgaatgaggatcactggttctcccgggaaaactctctgagcggcgtggagggggagggactccataagctgggctacattcttcgcgacatctccaaaattcctgggggaaatatgtatgctgatgacacagccggctgggataccagaatcacagaagacgatctgcaaaacgaggctaagatcaccgacattatggaacccgagcacgccctcctggcgacgtctatctttaaactgacctaccagaataaggttgtgcgggtccagcgccctgccaagaacgggacagtgatggatgtgattagcagacgggaccagcgcggctccggacaagttggcacctatgggctcaatacattcaccaacatggaagctcagctgatcagacagatggagtctgagggaatttttcttcccagcgaactggagacgccgaacctcgccgaacgggtgctggattggcttgagaaatacggcgtcgaaagactgaagcgcatggctatctccggggacgactgtgtggttaaacctatcgatgaccggttcgccacagcgctcaccgccctgaatgatatgggaaaggtgagaaaagacattccccagtgggagcctagcaagggctggaacgattggcaacaggtccccttttgctctcatcacttccaccagctgatcatgaaggacgggcgcgagattgtggtcccttgtcggaatcaggatgaactcgtgggcagagctcgcgtttcccaaggagccggctggagcctgcgggagacagcttgccttgggaaatcttatgcccagatgtggcagctgatgtactttcatagacgcgacctccggctggctgccaacgcgatctgttccgccgtgcccgtcgattgggtgccgaccagcagaacgacctggtccattcacgctcatcaccaatggatgacaaccgaagacatgctttctgtttggaatcgcgtgtggatcgaggaaaacccttggatggaggataagacacatgtcagctcctggggagacgtgccctatctgggcaaacgggaggaccagtggtgcgggagcctcattggactgaccgccagagccacatgggcttctaatatccaggtggccatcaaccaggttcggagactgattggcaatgaaaactacctcgattacatgacctccatgaagcgcttcaaaaatgagggggaccccgaaggcgcgttttggtga

SEQ ID NO: 19037 - RNA, 9879 nt, synthetic construct
  misc_feature 1..9879: note = derived and/or modified CDS sequence (opt5) from DENV-1__GQ199792__SS-prME
  source 1..9879: mol_type = other RNA
agcgtgaccatgctgctcatgctgatgcccacagcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagaagctgaacccgacgatgtggactgttggtgcaatgccaccgatgcctgggtgacgtatggaacctgttcccagacaggcgagcacagacgggacaagcgctctgtggctctggcccctcatgtggggctgggactcgagaccagaacagaaacctggatgagctccgagggcgcttggaaacagattcagcgggttgaaacgtgggccctgcgccaccccggcttcacagtgatcgcgctttttctggcccatgctattgggacctctatcacacagaagggaatcattttcatcctcctgatgcttgtcacccctagcatggccatgagatgcgtgggcattgggtcccgggattttgttgagggactgagcggcgctacctgggtggacgtcgtgctcgagcacgggtcttgtgtgacaacgatggccaaggataaacccaccctggacatcgaactgctcaagacagaggtcaccaaccctgcggttctgcgcaaactttgcattgaagccaagatctccaatacaaccacggatagcagatgtccgacacaaggagaggctaccctggtggaagaacaggacgccaacttcgtgtgccggcgcacctttgtcgatagaggctggggcaatgggtgtggactcttcggcaaagggtctctgattacatgcgctaagtttaagtgcgtgaccaaacttgagggaaagatcgttcagtacgaaaacctgaaatattccgtgatcgtcacagtgcacacgggcgaccagcatcaagttgggaatgagagcaccgaacacggaacaaccgccacaattacaccccaggcccctacgaccgagatccagctcacagactacggcgctctgaccctggattgttctccccggacaggcctcgacttcaacgaaatggtgctgcttaccatgaaggagaaatcctggctggtccataagcagtggtttctcgatctgcctcttccctggacgagcggggcgtccacatctcaagagacctggaatcgccaggacctgctcgtgacattcaaaaccgcccacgctaagaagcaggaagtcgtggttctgggaagccaagagggcgccatgcacaccgccctgacaggggctacggaaattcagacctccggaacaaccacaatctttgccggccatctcaaatgcagactgaagatggataaacttaccctgaaggggatgagctatgtgatgtgtacgggctctttcaaactcgagaaggaagtcgcggagacacagcacggaaccgtgctggttcagattaagtacgagggcaccgacgctccgtgcaaaatccctttctccacacaagatgaaaagggggtgacccagaacggacggctgatcacagccaatcccattgtcacggacaaagagaagcctgtgaacatcgaagccgagccgccctttggcgagagctatattgtgatcggggctggagaaaaagcccttaagctctcttggttcaagaaaggcagctccattgggaagatgtttgaggctaccgccagaggcgcgcgccggatggccatcctgggagatacagcttgggacttcggctctatcgggggagtttttaccagcgtcggcaaactggtgcatcagattttcgggacagcctacggagtgctcttttccggcgtcagctggaccatgaagatcgggattggcgtgctgcttacgtggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacagaacaatataagtttcaggcggactcccctaaacggctgtctgccgctattggcaaggcctgggaggagggggtgtgcggcatcagaagcgctacccgcctcgaaaacatcatgtggaaacagatttccaacgagctgaatcatatccttctggaaaacgacatgaagctcacggttgtggtcggagatgtggccggcattctggggcagggcaagaagatgatccggccgcaacccatggagtacaaatattcttggaaaagctggggcaaggccaagattatcggggctgacgcgcagaatacaaccttcatcattgatggacctaacacccccgaatgtcctgacgatcagagagcctggaatatctgggaggtggaggactacggctttggcattttcacaaccaacatctggctgaaacttcgcgattcctatacgcaggtctgcgaccaccggctcatgagcgctgccattaaagattctaaggccgttcacgctgacatggggtactggatcgaatccgagaaaaatgaaacatggaagctggccagagcgagctttatcgaggtgaagacctgtatttggcccaaatctcatacactgtggtccaacggagtgctcgaaagcgagatgatcattccgaagatctatggcgggcctatttctcaacacaattaccgccccggatacttcacccagacagctggcccttggcatctggggaaacttgagctggatttcgacctctgcgaaggaaccacggtcgtggttgatgagcactgcggcaaccggggccccagcctgagaaccacaaccgtgacagggaagatcatccacgaatggtgttgccggtcctgtaccctgcctccccttcgctttagaggagaggacggctgctggtatgggatggagattcggccggtcaaagaaaaggaggaaaatctcgtcaagagcatggtttctgccggatccggcgaggtggacagcttctccctggggctgctctgtatctctattatgatcgaagaggtcatgagaagccgctggtcccggaaaatgctgatgacgggaacacttgccgtgtttttcctgctcattatgggccagctgacctggaacgatctgatcagactttgcattatggttggcgctaatgcctctgaccgcatggggatgggaacaacctacctggcgctcatggctacctttaagatgagacctatgttcgccgtgggcctgctctttcggcgcctgacaagcagagaggtccttctgctcacgatcgggctgtccctggtggcctctgtggaacttcccaacagcctggaggaactcggagatggcctggctatggggatcatgattctcaaactgcttaccgacttccaatcccatcagctgtgggccacactcctgagcctgacctttatcaagacaaccttctctcttcactatgcttggaaaacgatggccatggtcctgtccattgttagcctctttcccctgtgtctctctacaacctcccagaagaccacatggctgcctgtgcttctgggaagcctgggctgcaagccgctcaccatgttcctgatcgcggagaataaaatttggggccggaagtcttggccccttaacgaagggatcatggccgtgggaatcgtctccattctgctcagctccctgctcaaaaacgatgtgcctctggctggcccccttatcgccgggggaatgctgattgcttgttacgttatcagcggctctagcgccgacctgtccctcgagaaggccgctgaggtgtcttgggaagaggaagcggagcatagcggggcctcccacaatattctggtcgaagtgcaggatgacggaacaatgaaaatcaaggatgaggagcgcgacgatacgcttaccatcctgctcaaagctacactgctcgccgtttctggcgtgtatcctctgagcattcccgccaccctttttgtctggtacttctggcaaaagaagaaacagagatccggcgtgctgtgggacacaccttctcccccggaagtcgagcgggctgtgctggatgacgggatctatcgcattatgcagagaggactcctgggccggagccaggttggggtgggagtcttccaagaaaacgtgtttcataccatgtggcacgttacgcgcggcgccgtgcttatgtaccaggggaagagactggagccttcctgggcgagcgtcaaaaaggacctcatctcttacggaggcggctggcggctgagagggtcctggaatatgggagaggaagtccaggtgattgctgttgagcccggcaaaaaccctaagaatgtccagaccgcccccgggacattcaagaccccggaaggagaggtgggcgccatcgctctcgattttaaacctgggacaagcggatctcccattgtgaaccgcgaaggcaagatcgtcggcctgtatgggaatggagtggttaccacatccggcacgtacgtgagcgccatcgcgcaagctaaagcctcccaggaggggcctcttcccgagattgaagacgaggtcttccggaagagaaacctgaccatcatggatctgcaccccggatctggcaaaacacgccggtatctccctgccattgtgagagaagctatcaagcgcaagctgcggacccttattctggccccgaccagagttgtggctagcgagatggccgaagcgctcaaagggatgcccatccgctaccagacaacggccgtcaagtccgagcataccggcaaagagatcgtggacctgatgtgccacgctacatttaccatgcggctgctcagccctgttagagtgcccaattataacatgattatcatggatgaagcccatttcacagacccttcttccattgctgcccggggatacatcagcacccgcgtcggcatgggggaggccgctgcgatttttatgacggccacaccccctggatctgtggaggctttcccgcaaagcaatgccgtgatccaggatgaggaaagagacatccccgagcggtcctggaactctggctatgagtggattaccgattttcctgggaagaccgtctggttcgttcccagcatcaaatccggaaatgacattgccaactgtcttcgcaagaatggcaagagagtgatccagctgtctcggaaaacatttgataccgaataccagaagaccaagaacaacgactgggactacgtggtcaccacggatattagcgagatgggggctaatttcagagccgaccgcgtgatcgatcctcggagatgcctgaagcccgttattctcaaagacggcccggaacgcgtgatcctggcgggacctatgcccgtcacagtggcttccgccgcccaacggagaggccgcatcgggcggaaccacaataaggagggagatcagtatatttacatgggccagccccttaacaatgacgaggatcatgctcactggaccgaagccaagatgctgctcgacaacatcaatacacctgaggggattatccccgcgctgttcgaacctgagagagagaaaagcgccgctgttgatggagagtatcgcctgagaggcgaggcccggaagacctttgtggaactcatgcgcagaggggaccttccggtctggctgtcttacaaagtggcttccgagggcttccagtatagcgatcggcgctggtgctttgacggagaaagaaacaatcaagtcctggaggaaaacatggatgtggagatttggacgaaggagggcgaacggaaaaagctcagaccccgctggctggacgcccggacctactccgaccctcttgctctgagagagttcaaagaatttgccgcggggcgccggtctgttagcggagatctcatcctggagatcggcaagctgccccagcacctcacacagagagcccagaatgctcttgacaacctggtgatgctgcataattccgaacaagggggacgggcctatcgccacgctatggaggagctccctgataccattgaaacactgatgcttctggccctcatcgccgtgctgaccggcggcgtcacactgttctttctctctgggagaggacttggcaagaccagcattgggctgctgtgtgttatggcttccagcgtgctcctgtggatggcgtctgtggagccccattggatcgccgcttccattatccttgagttctttctgatggtcctcctgatcccggagcctgaccggcagcgcacgccccaggataaccagctggcctacgtggttattggactccttttcatgatcctgacagtggccgctaatgagatgggcctgctcgaaaccaccaaaaaggacctggggattggacacgtcgccgtggagaaccaccatcacgcggccatgcttgatgtcgacctgcatcctgctagcgcctggacactctacgctgtggccaccacaatcattacgcccatgatgagacacaccatcgaaaacacaaccgcgaatatttctctgacagccatcgctaaccaagccgctatcctgatgggcctcgataaaggctggcctatttccaagatggacatcggggttccccttctggccctgggatgctatagccaggtgaatccgctcaccctgacggctgccgtccttatgctggtggcgcattacgccattatcggccctgggctccaggctaaagccacccgggaggctcaaaagcgcacagccgccggaattatgaagaaccccaccgttgatggcatcgtggcgatcgacctggatcccgtcgtgtatgacgctaaatttgaaaagcagctggggcagattatgctccttatcctgtgtacatctcagattctgctcatgagaaccacgtgggccctgtgcgagagcatcacacttgctaccggacctctgacaaccctctgggagggctccccgggcaaattctggaataccacaattgccgtgtctatggccaacatctttcgggggagctacctggctggagccggcctggcgttctccctcatgaaaagccttgggggaggccgcagagggacgggagcccaaggcgaaaccctgggcgagaaatggaagcggcagctgaatcagctctccaagtctgagttcaacacatataaaagaagcgggatcatggaggttgaccgctccgaagctaaggagggactgaaacggggcgagaccacaaagcacgccgtctctagagggaccgctaaacttcgctggtttgtggaacggaatctggtgaagcccgagggaaaggtcattgatctcggctgtgggagaggaggctggagctactattgcgccggcctgaaaaaggttacggaagtgaaagggtacacaaagggaggccctgggcacgaggaacccatccctatggcgacctacggatggaacctggtgaaactccattccggcaaggacgtcttctttattccccctgagaaatgtgatacccttctgtgcgacatcggggagtctagcccgaatcccacaattgaagagggacgcaccctgcgggtgctcaagatggttgaaccttggctgagaggcaaccagttctgtatcaagattcttaatccctatatgccttccgtggtcgagacactggagcaaatgcagcgcaaacacggcgggatgctcgtgcggaaccccctgagcagaaattctacgcatgaaatgtactgggtttcctgcggaaccggcaacatcgtgagcgccgtcaatatgacatctcgcatgctgctcaaccggtttaccatggctcacagaaagccgacatatgagcgcgatgtggacctggggaccggaacgagacacgtggccgtcgaacctgaggttgctaaccttgatatcattggccagcggatcgaaaatattaaacatgagcacaagtccacctggcattacgacgaggataacccctataaaacatgggcctaccacgggagctatgaagtgaagccctctggatccgctagctccatggtgaatggcgtcgtgaagctgctcaccaaaccttgggacgttatccccatggtgacacagattgccatgaccgatacaacccctttcggccaacagcgcgtctttaaggagaaagtggacacgagaacaccgaaggcgaaacgggggaccgcccagatcatggaagttaccgctagatggctgtggggattccttagccggaacaagaagccccgcatctgtacaagagaggaatttacgcggaaagtgcgctctaatgccgctattggcgccgtcttcgtggacgagaaccaatggaatagcgccaaggaggcggttgaagatgagagattttgggacctggtgcatcgggaacgcgagctccacaaacaggggaagtgcgctacctgcgtctacaacatgatgggaaaaagagaaaagaagctgggcgagttcgggaaagccaagggctcccgggccatctggtacatgtggctgggagctcgctttctcgagttcgaagccctgggcttcatgaatgaggatcactggttttctagagaaaacagcctttccggggtggagggagagggcctgcataaactcgggtatattctgcgggacatctctaagattcctggaggcaatatgtacgctgatgacacagccgggtgggatacccgcatcacagaagacgatcttcagaacgaggcgaaaatcaccgacattatggaacccgagcacgccctgctcgctaaggccatcttcaaactgacatatcagaataaggtcgtgagagttcaacggcctgctaagaacggcaccgtgatggatgtcattagccgcagagaccagcggggatccggccaggtggggacgtacggactgaatacctttacaaacatggaagcccagctcatcagacaaatggagtctgagggcattttcagcccctccgaactggagaccccgaaccttgcggaacgcgccctggattggctcgagaaatatggggtggaacggctgaagagaatggctatcagcggagacgactgtgttgtgaaacctatcgatgaccgctttgccacagctcttaccgccctgaatgatatgggcaaggtccggaaagacattccccagtgggagccttctaaggggtggaacgattggcaacaggtgcccttctgctcccatcactttcaccaactcatcatgaaggacggcagagagattgttgtgccttgtcgcaatcaggatgaactggtcggacgggctagagtgagccagggcgccgggtggtctctgcgcgagacggcgtgcctcggaaaatcctacgcccagatgtggcaactgatgtatttccatcggagagaccttcgcctggctgccaacgccatctgtagcgctgtccccggcgattgggtgccgacatcccggaccacatggtctattcacgcccatcaccagtggatgaccacggaagacatgctcagcgtttggaatagagtgtggatcgaggaaaacccttggatggaggataagacccatatttccagctgggaggacgtcccctacctggggaaacgggaagaccagtggtgcggatctcttatcggcctgacagcgagagctacctgggccacaaatatccaagtggccattaaccaggttcgccggctcatcgggaatgagaactacctggattatatgacctccatgaagagatttaaaaatgaaagcgaccccgagggcgctctgtggtga

SEQ ID NO: 19038 - RNA, 9879 nt, synthetic construct
  misc_feature 1..9879: note = derived and/or modified CDS sequence (opt5) from DENV-1__GQ199793__SS-prME
  source 1..9879: mol_type = other RNA
tccgtgaccatgctgctcatgctgatgcccaccgcccttgctttccacctgacgaccagaggcggggaacctcatatgatcgtcacaaagcaggaacggggaaaatccctcctgtttaagacctctgccggcgttaatatgtgcacacttattgcgatggacctgggggaactctgtgaagataccatgacatacaaatgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggctaccacatcccaagagacctggaatcgccaggacctgctcgtcaccttcaaaacagcgcacgccaagaagcaggaagtggtcgtgctgggatctcaagagggcgctatgcacacggccctgaccggggccacagaaattcagaccagcggaacaaccacgatctttgctggccatctcaaatgcagactgaagatggataaacttacactgaaggggatgtcctatgttatgtgtaccggcagcttcaaactcgagaaggaagtggccgagacccagcacggaacagtcctggtgcagattaagtacgagggcaccgacgcgccgtgcaaaatccctttctctacacaagatgaaaagggggttacgcagaacggacggctgatcaccgctaatcccattgtgacagacaaagagaagcctgtcaacatcgaagccgagccgccctttggcgagtcctatattgtgatcggggccggagaaaaagctcttaagctcagctggttcaagaaaggctctagcattgggaagatgtttgaggccaccgctagaggcgcccgccggatggcgatcctgggagatacagcctgggacttcggctccatcgggggagtgtttacctctgttggcaaactggtccatcagattttcgggacggcttacggagtgctctttagcggcgtgtcctggaccatgaagatcgggattggcgtcctgcttacatggctgggactcaatagcagatctacctccctgagcatgacatgtatcgccgtgggcctggttaccctttacctcggggtgatggtccaggctgattctggatgcgtgattaactggaaaggccgcgaactgaagtgtgggtccggaatcttcgttacaaatgaggtgcacacctggacggaacaatataagtttcaggccgacagccctaaacggctgtccgcggccattggcaaggcttgggaggagggggtctgcggcatcagatctgccacacgcctcgaaaacatcatgtggaaacagattagcaacgagctgaatcatatccttctggaaaacgacatgaagttcaccgtggttgtgggagatgtcgtgggcattctcgctcaggggaaaaagatgatccggccgcaacccatggagcacaaatactcctggaagtcttggggaaaggccaaaattatcggcgccgacgtgcagaataccacatttatcattgatgggcctaacacccccgaatgtcctgacgatcagagagcttggaatatctgggaggtcgaggactatggattcggcatttttacgacaaacatctggctgaagctgcgcgatagctacacccagatgtgcgaccaccggcttatgtccgcggccattaaagatagcaaggctgttcatgccgacatgggctattggatcgaatctgagaaaaatgaaacatggaagctcgccagagcttccttcatcgaggtgaagacctgtatttggcccaaaagccacacactgtggtctaacggggtgctggaatccgagatgatcattccgaagatctacggaggccctattagccaacataattatcgccccgggtacttcacccagacggccggaccttggcacctcggcaaactggagcttgattttgacctgtgcgaagggaccacagtcgtggttgatgagcactgcggaaaccggggcccctctctcagaaccacaaccgtgacgggcaagatcatccatgaatggtgttgccggagctgtacactgcctcccctgcgcttcaaaggggaggacggatgctggtacggcatggagattagaccggtcaaggaaaaggaggaaaatcttgtgaaatccatggttagcgcggggtctggagaggtggactcctttagcctcggcctgctgtgtatctccattatgatcgaagaggtcatgcggtctagatggagccgcaagatgctcatgaccgggacactggctgtgttccttctgctcattatgggacagctgacctggaacgatctgatccggctttgcattatggttggcgccaatgcctccgacagaatgggcatggggaccacatatctggctctcatggccacgtttaaaatgcgccctatgttcgcggtgggactgctctttagacggctgacctctcgcgaggtccttctgctcacaatcggcctgagcctggtggcttccgtggaacttcccaactctctggaggaactcggggatggactggccatgggcatcatgattctcaagctgcttaccgacttccaaagccaccagctgtgggccacactcctgtccctgacctttatcaaaacgacacttagcctgcattacgcttggaagaccatggccatggtcctctctattgtttccctgttccccctctgtctgagcaccacatctcagaagaccacatggcttcctgtgctgctggggtccctcggatgcaaaccgctgacgatgtttcttatcaccgagaataagatttggggcagaaaaagctggcccctgaacgaaggcatcatggctgtgggggtcgtgtctatcctcctgtccagcctcctgaagaacgatgttcctcttgccggacccctgattgcgggcgggatgctgatcgcctgttatgtgatttccggaagctctgctgacctcagcctggagaaagccgctgaggtctcctgggaagaggaagccgagcactctggcgccagccataatatccttgtggaagttcaggatgacgggacaatgaagattaaagatgaggagcgggacgataccctgacaatcctcctgaaggctaccctcctggcggtgtccggagtctaccctctttctatccccgccacgctgttcgtgtggtatttttggcaaaagaaaaagcagcgcagcggcgtcctgtgggacacccctagccctcccgaagtggagagagctgttctcgatgacggcatttaccggatcatgcagcgcgggctgcttggaagatctcaggtgggcgtcggggtgttccaagaaaacgttttccacacaatgtggcacgtgacccggggagccgtcctgatgtatcagggcaaacgcctcgagcccagctgggcctccgtgaagaaagacctgattagctacgggggaggctggagactccagggctcttggaatgctggggaggaagtgcaggttatcgccgtcgagcccggaaagaaccctaagaatgtgcaaacagcgcccggcacctttaaaacaccggaaggggaggtgggagctattgccctggatttcaagcctggcacgtccgggagccccatcgtcaaccgggaaggaaaaattgtgggcctttacggcaatggggttgtgaccacatctggaacctatgtctccgccatcgctcaggccaaggcgagccaggagggccctctgcccgagatcgaagacgaggtgtttagaaaacgcaacctgaccattatggatctccatcccgggtccggaaagacacggagatacctgcctgctatcgttcgcgaagccattaagcggaaacttagaacgctgatcctcgccccgacccgcgtggtcgcttctgagatggccgaagctctgaagggcatgcccattcggtatcaaacaaccgccgtgaaaagcgagcacacagggaaggagatcgttgacctgatgtgccatgcgaccttcacgatgagactcctttcccctgtgcgcgtccccaattacaacatgatcattatggatgaagcccactttacagaccctagctctatcgctgcccggggctatatttccaccagagtgggaatgggcgaggctgccgccatcttcatgaccgctacaccccctgggagcgtggaagcgtttccgcagtctaatgccgtcattcaggatgaggaacgggacatccccgagcgcagctggaactccggacatgagtggatcaccgatttccctggcaaaacagtttggtttgtgccctctattaagagcgggaatgacatcgctaactgtctgagaaagaatggaaaacgggtgattcagctgtcccgcaagaccttcgatacggaataccagaagaccaagaacaacgactgggactatgtcgtgaccacagatatctctgagatgggcgccaattttagagccgaccgggttattgatcctagacgctgcctcaaacccgtgatcctgaaggacgggccggaacgggtcattcttgctggccctatgcccgtgaccgttgccagcgcggctcagagacgcggacggatcggcagaaaccacaataaggagggggatcagtacatctacatgggacagcccctgaacaatgacgaggatcacgcccattggacggaagccaaaatgctcctggacaacattaatacccctgagggcatcattcccgctctgttcgaacctgagcgcgaaaagtccgccgcgatcgatggggagtatcggctcagaggagaggcccgcaaaacattcgtggaacttatgagacggggcgacctgccggtctggctgagctacaaggtggcttctgaggggtttcaatattccgatcgcagatggtgcttcgacggcgaacggaacaatcaggtcctcgaggaaaacatggatgtggagatttggaccaaagagggagaacgcaagaaactgagaccccggtggcttgacgccagaacatacagcgaccctctggctctccgcgagtttaaggagttcgccgctggccggagatccgtttctggggatctgatcctggagatcggaaagctcccccagcaccttacccagcgcgcccaaaatgcgctggacaacctggtgatgctccataatagcgaacagggcgggcgggcctatagacacgctatggaggagctgcctgatacaattgaaacccttatgctgctcgccctgatcgctgtgctgacgggaggcgtcacactctttttcctttccggccgggggctgggaaaaacctctattggcctgctctgtgttatggccagctccgtgctgctttggatggccagcgtggagccccactggatcgctgcgtctattatcctggaatttttcctcatggtcctgctgatcccggagcctgaccgccagagaacaccccaggataaccaactcgcctacgtggttattgggcttctgtttatgatcctgacagtggctgccaatgagatgggactcctggaaaccacaaagaaagaccttggcattgggcatgtcgccgtggagaaccaccatcacgctacgatgctggatgtcgacctccatcctgcctccgcgtggaccctgtatgccgtggctacaaccatcattacacccatgatgcggcacaccatcgaaaacacgaccgccaatattagcctgacagctatcgccaaccaggcggccatcctcatgggacttgataagggctggcctatttctaaaatggacatcggcgttcccctgctggctctcgggtgctactcccaggtgaatccgctgacccttacagccgctgtcctgatgctcgtggcccactacgctattatcggacctggcctgcaagccaaggcgacccgcgaggcccagaagagaacggctgccgggattatgaaaaaccccacagttgatggaatcgtggctatcgacctggatcccgtcgtgtatgacgccaagttcgaaaaacagctcggccagattatgcttctgatcctgtgtaccagccaaattctcctgatgcggacaacctgggccctttgcgagtctatcaccctggcgacagggcctctcacgaccctgtgggagggaagcccgggcaagttttggaatacaaccattgctgtgtccatggccaacatcttccgcggctcttacctggctggggccggactcgcctttagccttatgaaatccctgggcgggggaagacggggcacaggggctcagggagaaaccctgggcgagaagtggaagcgccagctcaatcagctgagcaaatccgagttcaacatctataagagatctggcattatggaggttgaccggagcgaagccaaagaggggcttaagagaggagagacgacacgccatgcggtctcccggggcaccgccaaactgagatggttcgtggaacgcaatctcgtgaagcccgaggggaaggtcatcgatctgggatgtggcagagggggatggtcttactattgcgctggcctgaaaaaggttaccgaagtgaaaggctacacaaaagggggacctggccacgaggaacccattcctatggccacctatgggtggaacctcgtgaaacttcatagcggaaaggacgtctttttcacaccccctgagaaatgtgatacgctgctgtgcgacatcggcgagtcctctccgaatcccaccattgaagaggggagaacactccgcgtgctgaagatggttgaaccttggcttcggggaaaccaattttgtatcaagattctgaatccctacatgcctagcgtggtcgagaccctcgagcagatgcagagaaaatacggcggcatgctggtgcgcaaccccctgtcccggaatagcacacacgaaatgtattgggtttcttgcgggaccggaaacatcgtgtccgctgtcaatatgacgagcagaatgctcctgaaccgcttcaccatggcccaccggaagccgacatacgagagagatgtggaccttggcgcggggacccgccatgtggccgtcgaacctgaggttgctaacctggatatcattggacagagaatcgaaaatattaaacacgagcataagtctacatggcactatgacgaggataacccctacaaaacctgggcctatcatggctcctacgaagtgaagcccagcgggtctgcttccagcatggtgaatggagtcgtgaagctcctgacaaaaccttgggacgttatccccatggtgacccaaattgccatgacggatacaaccccttttggccagcagcgggtcttcaaggagaaagtggacacccgcacaccgaaggctaaaagaggcacggcccaaatcatggaagttaccgcgcggtggctttgggggtttctgtccagaaacaagaagccccggatctgtacacgcgaggagttcaccagaaaagtgcggagcaatgccgctattggagccgtctttgtggacgagaaccagtggaactctgctaaggaggccgttgaagatgagcgcttctgggacctcgtgcagaaagaaagagagctgcacaagcagggcaaatgcgccacatgcgtctataacatgatggggaagcgggaaaagaaactgggagagtttggcaaggcgaaagggagccgcgctatctggtacatgtggctcggcgccagattcctggagtttgaagcccttggattcatgaatgaggatcactggttctcccgggaaaactctctgagcggcgtggagggggagggactccataagctgggctacattcttcgcgacatctccaaaattcctgggggaaatatgtatgctgatgacaccgccggctgggatacaagaatcaccgaagacgatctgcaaaacgaggctaagatcacggacattatggaacccgagcacgccctcctggcgacctctatctttaaactgacataccagaataaggtcgtgcgggttcagcgccctgccaagaacgggaccgtgatggatgtcattagcagacgggaccagcgcggctccggacaagtgggcacatatgggctcaataccttcacgaacatggaagctcagctgatcagacagatggagtctgagggaatttttcttcccagcgaactggagacaccgaacctcgccgaacgggtgctggattggcttgagaaatacggcgttgaaagactgaagcgcatggctatctccggggacgactgtgtggtcaaacctatcgatgaccggttcgccaccgcgctcacagccctgaatgatatgggaaaggtgagaaaagacattccccagtgggagcctagcaagggctggaacgattggcaacaggttcccttttgctctcatcacttccaccagctgatcatgaaggacgggcgcgagattgtggtcccttgtcggaatcaggatgaactcgtgggcagagctcgcgtctcccaaggagccggctggagcctgcgggagaccgcttgccttgggaaatcttatgcccagatgtggcagctgatgtactttcatagacgcgacctccggctggctgccaacgcgatctgttccgccgtgcccgttgattgggtgccgacgagcagaaccacatggtccattcacgctcatcaccaatggatgaccacagaagacatgctttctgtctggaatcgcgtgtggatcgaggaaaacccttggatggaggataagacccatgttagctcctggggagacgtgccctatctgggcaaacgggaggaccagtggtgcgggagcctcattggactgacagccagagccacctgggcttctaatatccaggtcgccatcaaccaggtgcggagactgattggcaatgaaaactacctcgattacatgacgtccatgaagcgcttcaaaaatgagggggaccccgaaggcgcgctgtggtga

SEQ ID NO: 19039 - RNA, 9879 nt, synthetic construct
  misc_feature 1..9879: note = derived and/or modified CDS sequence (opt5) from DENV-1__GQ199795__SS-prME
  source 1..9879: mol_type = other RNA
agcgtgaccatgctgctcatgctgatgcccaccgcccttgctttccacctgacgaccagaggaggggagcctcatatgatcgtctccaagcaggaacggggaaaatctctcctgtttaagaccagcgccggcgttaacatgtgcacccttatcgcgatggacctgggggagctctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatgggactggataaaggctggcctatctccaagatggacattggcgttcccctccttgctctggggtgctatagccaggtgaatccgctgaccctcacagccgctgtcctgatgcttgtggcccattacgcgatcattggacctggcctgcaagccaaagctacccgcgaggcccagaagagaacagctgccgggatcatgaaaaaccccaccgttgatggaatcgtggccattgacctcgatcccgtcgtgtatgacgcgaagttcgaaaagcagctgggccagatcatgctgctcattctttgtacgtctcaaatcctgctgatgcggacaacctgggctctctgcgagagcattacactggccaccgggcctcttaccacactgtgggagggatccccgggcaaattttggaatacgaccatcgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcattatggaggttgaccggtccgaagccaaggaggggctcaaaagaggagagaccacgaagcacgctgtctctcgcggcacagccaaactgcggtggttcgtggaaagaaatcttgtgaagcccgaggggaaagtcatcgatctgggatgtggccgcgggggatggagctactattgcgctggcctcaagaaggttaccgaagtgaaaggctacaccaaaggcgggcctgggcacgaggaccccattcctatggccacatacgggtggaacctggtgaaactgcattccggaaaggatgtctttttcattccccctgaaaaatgtgacaccctcctttgcgatattggcgagtctagcccgaatcccacaatcgaggaagggcggacgctgagagtgctgaagatggttgagccttggctccgcggaaaccaattttgtattaaaatcctgaatccctatatgccttccgtggtcgaaacccttgagcagatgcagcggaagcacggcggcatgctggtgagaaaccccctcagccgcaattctacacatgagatgtactgggtttcctgcgggaccggaaacatcgtgagcgcggtcaatatgacatctcggatgctgctgaacagattcaccatggcccaccgcaagccgacgtatgaaagagacgtggatctcggcgctgggacccggcacgtggccgtcgagcctgaagttgctaacctggacattatcggacagcgcattgagaatatcaaacatgaacacaagtccacatggcattacgatgaggacaacccctataaaacctgggcctaccacggcagctatgaggtgaagccctctgggtccgctagctccatggtgaatggagtcgtgaaacttctgacaaagccttgggatgttattcccatggtgacccaaatcgccatgacagacaccacgccttttggccagcagagagtcttcaaggaaaaagtggacacacggaccccgaaggcgaaaagaggcaccgcccaaatcatggaggttacagctaagtggctctgggggtttctgagccggaacaaaaagccccgcatttgtacgagagaagagttcacccggaaggtgcgctctaatgccgctatcggagccgtctttgtggatgaaaaccagtggaatagcgccaaagaggcggttgaggacgaaagattctgggatcttgtgcatcgggagcgcgaactgcacaagcagggcaaatgcgctacatgcgtctacaacatgatggggaagagagagaaaaagctcggagaatttggcaaggccaaagggtcccgggccatttggtacatgtggctgggcgctcgcttcctggagttcgaggccctcggatttatgaatgaagaccactggttctctagagagaacagcctgtccggcgtggaaggggagggacttcataagctgggctatatcctccgggatatttctaaaatccctgggggaaatatgtacgctgacgataccgccggctgggacacacgcatcaccgaggatgacctgcagaacgaagcgagaattacagatatcatggagcccgaacacgcccttctggctaagagcatttttaaactcacctatcaaaataaggtcgtgcgggttcagcgccctgccaaaaacgggacggtgatggacgtcatctccagacgggatcagagaggctctggacaggtgggcacctacgggctgaatacattcaccaacatggaggctcaactgattcgccagatggaaagcgagggaatcttttcccccagcgagctcgaaacaccgaacctggccgagcgggtgcttgactggctggaaaagtatggcgttgagagactcaagcgcatggcgatctctggggacgattgtgtggtcaaacctattgacgatcggttcgccaccgctctgacggcccttaatgacatgggaaaggtgagaaaagatatcccccagtgggaaccttccaagggctggaacgactggcagcaagttcccttttgcagccatcacttccaccagctgattatgaaagatgggcgcgagatcgtggtcccttgtcggaatcaggacgagctcgtgggcagagctcgcgtctctcagggagccggctggtccctgcgggaaacagcttgcctgggaaagagctacgcccaaatgtggcagctcatgtattttcatagacgcgatctgcggcttgcggccaacgctatttgttccgccgtgcccgttgactggatcccgacctctagaacaacctggagcattcacgcccatcaccagtggatgacgaccgaggatatgctgtccgtgtggaatcgggtctggatcgaagagaacccttggatggaagacaagacacatatcagctcttggggagacgtgccctacctcggcaaaagagaggatcaatggtgcgggtccctgattggacttaccgctcgcgccacatgggcgaccaatatccaggttgctattaaccaggtgcggagactgatcggcaatgagaactacctcgactatatgacaagcatgaagcgcttcaaaaatgaatctgatcccgagggggccctgtggtga

SEQ ID NO: 19040 - RNA, 9873 nt, synthetic construct
  misc_feature 1..9873: note = derived and/or modified CDS sequence (opt5) from DENV-1__FJ882547__SS-prME
  source 1..9873: mol_type = other RNA
agcgtgaccatgctgctcatgctgatgcccaccgcccttgctttccacctgacgacccggggaggggaacctcatatgattgtgtccaagcaggaacggggaaaatctctcctgtttaagaccagcgccggcgttaatatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctgtatctctattatgatcgaagaggtcatgagaagccgctggtcccggaaaatgctgatgacaggaacccttgccgtgtttttcctgctcattatgggccagctgacatggaacgatctgatcagactttgcattatggttggcgccaatgcttctgaccgcatggggatcggaaccacctacctggccctcatggcgacatttaagatgagacctatgttcgctgtgggcctgctctttcggcgcctgacgagcagagaggtccttctgctcaccatcgggctgtccctggtggcctctgtggaacttcccaacagcctggaggaactcggagatggcctggccatggggattatgatgctcaaactgcttacagacttccaatcccatcagctgtgggctaccctcctgagcctgacatttatcaagaccacgttctctcttcactatgcctggaaaacaatggctatggtcctgtccattgttagcctctttcccctgtgtctctctaccacctcccagaagacaacctggctgcctgtgcttctgggaagcctgggctgcaagccgctcacaatgttcctgatcgccgagaataaaatttggggccggaagtcttggccccttaacgaagggatcatggcggtgggaatcgtctccattctgctcagctccctgctcaaaaacgatgtgcctctggccggcccccttatcgctgggggaatgctgattgcctgttacgttatcagcggctctagcgctgacctgtccctcgagaaggccgccgaggtgtcttgggaagaggaagctgagcatagcggggcgtcccacaatattctggtcgaagtgcaggatgacggaacgatgaaaatcaaggatgaggagcgcgacgatacccttacaatcctgctcaaagccaccctgctcgctgtttctggcgtgtatcctctgagcattcccgccacactttttgtctggtacttctggcaaaagaagaaacagagatccggcgtgctgtgggacaccccttctcccccggaagtcgagcgggccgtgctggatgacgggatctatcgcattatgcagagaggactcctgggccggagccaggttggggtgggagtcttccaagaaaacgtgtttcatacgatgtggcacgttacccgcggcgctgtgcttatgtaccaggggaagagactggagccttcctgggccagcgtcaaaaaggacctcatctcttacggaggcggctggcggctgagagggtcctggaatacaggagaggaagtccaggtgattgcggttgagcccggcaaaaaccctaagaatgtccagaccgctcccgggacattcaagaccccggaaggagaggtgggcgccatcgccctcgattttaaacctgggacaagcggatctcccattgtgaaccgcgaaggcaagatcgtcggcctgtatgggaatggagtggttacgacctccggcacatacgtgagcgctatcgcccaagcgaaggcttcccaggaggggcctcttcccgagattgaagacgaggtcttccggaagagaaacctgaccatcatggatctgcaccccggatctggcaaaacccgccggtatctccctgccattgtgagagaagccatcaagcgcaagctgcggacacttattctggctccgacgagagttgtggccagcgagatggctgaagccctcaaagggatgcccatccgctaccagaccacagcggtcaagtccgagcataccggcaaagagatcgtggacctgatgtgccacgccacatttaccatgcggctgctcagccctgttagagtgcccaattataacatgattatcatggatgaagctcatttcacggacccttcttccattgccgctcggggatacatcagcacacgcgtcggcatgggggaggccgccgctatttttatgaccgcgacaccccctggatctgtggaagccttcccgcaaagcaatgctgtgatccaggatgaggaaagagacatccccgagcggtcctggaactctggctatgagtggattacagattttcctgggaagaccgtctggttcgttcccagcatcaaatccggaaatgacattgccaactgtcttcgcaagaatggcaagagagtgatccagctgtctcggaaaacatttgataccgaataccagaagacgaaaaacaacgactgggactacgtggtcacaaccgatattagcgagatgggggccaatttcagagctgaccgcgtgatcgatcctcggagatgcctgaagcccgttattctcaaagacggcccggaacgcgtgatcctggccggacctatgcccgtcacagtggcgtccgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaagagcgcggccgttgatggagagtatcgcctgagaggcgaggctcggaagacctttgtggagctcatgcgcagaggggaccttccggtctggctgtcttacaaagtggcctccgagggcttccagtatagcgatcggcgctggtgctttgacggagaaagaaacaatcaagtcctggaggaaaacatggatgtggagatttggacaaaggagggcgaagggaaaaagctccggcccagatggctggacgctcgcacctactccgaccctcttgccctgcgggagttcaaagaatttgctgccggaagacgctctgttagcggcgatctcatcctggagatcgggaagctgccccagcacctcacacagcgggcgcagaatgcccttgacaacctggtgatgctgcataattccgaacaaggaggcagagcttatcggcacgccatggaggagctccctgataccattgaaacactgatgcttctggctctcatcgccgtgctgaccggcggggtcacgctgttctttctctctggacgcggccttgggaagacaagcattggactgctgtgtgttatggcctccagcgtgctcctgtggatggcttctgtggagccccattggatcgcggcctccattatccttgagttctttctgatggtcctcctgatcccggagcctgacagacagcggacaccccaggataaccagctggcttacgtggttattggcctccttttcatgatcctgaccgtggccgccaatgagatggggctgctcgaaacaaccaaaaaggacctgggaattggccacgtcgctgtggagaaccaccatcacgccgcgatgcttgatgtcgacctgcatcctgccagcgcttggacactctacgccgtggctacgaccatcattacacccatgatgcgccacaccatcgaaaacacaaccgccaatatttctctgacggcgatcgccaaccaagctgccatcctgatgggcctcgataaagggtggcctatttccaagatggacatcggagttccccttctggctctgggctgctatagccaggtgaatccgctcaccctgacagccgctgtccttatgctggtggcccattacgcgattatcgggcctggactccaggccaaagctaccagagaggcccaaaagcggacagctgccggcattatgaagaaccccaccgttgatgggatcgtggccatcgacctggatcccgtcgtgtatgacgcgaaatttgaaaagcagctgggacagattatgctccttatcctgtgtacgtctcagattctgctcatgcgcacaacctgggctctgtgcgagagcatcacacttgccaccggccctctgaccacactctgggagggctccccggggaaattctggaatacgaccattgctgtgtctatggccaacatctttagaggaagctacctggccggcgctgggctggccttctccctcatgaaaagccttggaggcgggcggcgcggaacaggcgcgcaaggcgaaaccctgggggagaaatggaagagacagctgaatcagctctccaagtctgagttcaacacatataaacggagcggaatcatggaggttgacagatccgaagccaaggagggcctgaaacgcggggagaccacgaagcacgctgtctctcggggaacagccaaacttagatggtttgtggaacgcaatctggtgaagcccgagggcaaggtcattgatctcgggtgtggacggggcggctggagctactattgcgctgggctgaaaaaggttaccgaagtgaaaggatacaccaagggcgggcctggacacgaggaacccatccctatggccacatacggctggaacctggtgaaactccattccgggaaggacgtcttctttattccccctgagaaatgtgatacccttctgtgcgacatcggagagtctagcccgaatcccacaattgaagagggcagaacgctgcgcgtgctcaagatggttgaaccttggctgcggggcaaccagttctgtatcaagattcttaatccctatatgccttccgtggtcgagaccctggagcaaatgcagagaaaacacgggggaatgctcgtgcgcaaccccctgagcagaaattctacacatgaaatgtactgggtttcctgcggcaccgggaacatcgtgagcgcggtcaatatgacatctagaatgctgctcaaccgctttaccatggcccaccggaagccgacgtatgagagagatgtggacctgggaaccggcacacgccacgtggctgtcgaacctgaggttgccaaccttgatatcattgggcagagaatcgaaaatattaaacatgagcacaagtccacctggcattacgacgaggataacccctataaaacatgggcttaccacggaagctatgaagtgaagccctctggctccgccagctccatggtgaatggcgtcgtgaagctgctcaccaaaccttgggacgttatccccatgagccctattgctatgacagataccacgccgctggcccagcgggtgttcaaggagaaagtcgacacacgcacccccaaggcgaaaagagggaccgcccaaatcatggaagtgacagctcggtggctttggggatttctgtctagaaacaagaagcctcggatctgtacgcgcgaggagttcaccagaaaagttcggagcaatgccgctattggcgccgtgtttgtcgacgagaaccagtggaactccgccaaggaggcggtggaagatgagcgcttctgggacctcgttcatagagaacgggagctgcacaaacaggggaagtgcgctacatgcgtgtacaacatgatgggaaaacgcgaaaagaagctgggcgagtttgggaaagccaagggctctagagccatctggtacatgtggctcggagctcggttcctggagtttgaagcccttggcttcatgaatgaggatcactggttcagccgcgaaaactccctgtctggggtcgagggagagggcctccataaactggggtatattcttagagacatcagcaagattcccggaggcaatatgtacgctgatgacaccgccgggtgggatacacggatcaccgaagacgatctgcaaaacgaggcgaaaatcacagacattatggaacctgagcacgccctcctggctaaggccatctttaaactgacctatcagaataaggtggtccgcgtgcagagacccgctaagaacggcacggttatggatgtgatttcccggcgcgaccagagaggatctggccaagtcgggacctacggactcaatacattcaccaacatggaagcccagctgatccggcagatggagagcgaggaaatcttttccccgagcgagcttgaaacacctaacctggcggagagagccctcgattggctggaaaaatatggcgtggagcgccttaagcggatggctatctctggggacgactgtgtggttaaacccatcgatgacagattcgccaccgctctgacggccctcaatgatatgggaaaggtgcgcaaagacattcctcagtgggagccctccaagggctggaacgattggcaacaggtccctttttgcagccatcacttccaccagctgatcatgaaggacgggcgggaaattgtggttccctgtagaaatcaggatgagctggtgggccgcgctcgggtctctcaaggagccggctggtccctcagagaaacagcgtgcctggggaaaagctacgcccagatgtggcagcttatgtattttcatcgccgggacctgagactcgctgccaacgccatctgttccgctgtgccggtcgattgggtgcctacctctcgcacaacctggagcattcacgcccatcaccagtggatgacgaccgaggacatgctgtccgtttggaatcgggtgtggatcgaagagaacccctggatggaggataagacacatattagctcttgggaagacgtcccctaccttggaaaaagagaggaccaatggtgcggctccctgatcgggctcaccgcgcgggctacatgggccaccaatatccaggtggccattaaccaggttagacgcctgatcggaaatgaaaactacctggattatatgacaagcatgaagcggttcaaaaatgagtctgaccctgagggcgctctctggtga

SEQ ID NO: 19041 - RNA, 9879 nt, synthetic construct
  misc_feature 1..9879: note = derived and/or modified CDS sequence (opt5) from DENV-1__GQ199797__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacaatgatgctgctcgctctgatcgccgtgcttaccggaggcgtcacgctgttctttctctccggccgggggctgggaaagacaagcattggcctgctctgtgttatggcctcttccgtgcttctgtggatggctagcgtggagcctcattggatcgcggcctctattatcctggagttctttctcatggtcctgcttatccccgagccggaccgccagagaacccctcaggataaccagctggcttacgtggttattgggctcctgttcatgatcctgaccgtggccgccaatgagatgggactccttgaaacaaccaaaaaggacctgggcattgggcacgtcgctgtggagaaccaccatcacgccgcgatgctggatgtcgacctccatcccgcctccgcttggacactgtacgccgtggctacgaccatcattacacctatgatgcggcacaccatcgaaaacacaaccgccaatattagccttacggcgatcgccaaccaagctgccatcctgatgggactcgataaaggctggcccatttctaagatggacatcggcgttcctctgctggctctcgggtgctatagccaggtgaatccccttaccctgacagccgctgtcctgatgctcgtggcccattacgcgattatcggaccgggcctgcaggccaaggctacccgcgaggcccagaagagaacagctgccgggattatgaagaaccctaccgttgatggaatcgtggccatcgaccttgatcccgtcgtgtatgacgcgaaatttgaaaagcagctgggccagattatgctcctgatcctgtgtacgtcccagattctccttatgcggacaacctgggctctgtgcgagtctatcacactggccaccgggcccctcaccacactgtgggagggaagccctggcaaattctggaatacgaccattgctgtgtccatggccaacatcttccgcggcagctaccttgccggggctggactggccttttccctcatgaagtctctgggcgggggaagacggggcacaggggcgcaaggagaaaccctgggcgagaagtggaaacgccagctcaatcagcttagcaagtccgagttcaacacatataaaagatctggcatcatggaggttgaccggagcgaagccaaggaggggctgaaaagaggagagaccacgaagcacgctgtctcccgcggcacagccaagctgcggtggtttgtggaaagaaatctcgtgaaaccggaggggaaggtcattgatctgggatgtggccgcgggggatggtcttactattgcgctggccttaaaaaggttaccgaagtgaaaggctacaccaaagggggacccggccacgaggaacctatccccatggccacatacgggtggaacctggtgaaactccatagcggaaaggacgtcttctttattcctcccgagaagtgtgataccctgctgtgcgacatcggcgagtccagccctaatccgacaattgaagaggggcggacgctcagagtgcttaaaatggttgaaccctggctgcgcggaaaccagttctgtatcaagattctgaatccttatatgccctctgtggtcgagaccctcgagcaaatgcagcggaaacacggcggcatgctggtgagaaaccctctttcccgcaatagcacacatgaaatgtactgggtttcttgcgggaccggaaacatcgtgtccgcggtcaatatgacaagccggatgctgctcaacagatttaccatggcccaccgcaagcccacgtatgagcgggatgtggacctgggcgctgggaccagacacgtggccgtcgaaccggaggttgctaacctggatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctcctgacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctttgggggttcctgagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctcgtgcatcgggaacgcgagctgcacaagcagggcaagtgcgctacatgcgtctacaacatgatggggaaaagagaaaagaaacttggagagttcggcaaggccaaagggagccgggccatctggtacatgtggctgggcgctcgcttcctcgagtttgaagccctgggattcatgaatgaggatcactggttttccagagaaaactctctgagcggcgtggagggggagggactccataagctgggctatattcttcgggacatctccaaaattcccgggggaaatatgtacgctgatgacaccgccggctgggatacacgcatcaccgaagacgatctgcagaacgaggcgaagatcacagacattatggaacctgagcacgccctcctggctaagtctatcttcaaacttacctatcagaataaggtcgtgagagttcaacggcccgccaaaaacgggacggtgatggatgtcattagccgcagagaccagcggggctccggacaggtgggcacctacgggctgaatacatttaccaacatggaagctcagctcatccgccaaatggagagcgagggaattttctctccttccgaactggagacacccaacctggccagacgggtgctcgattggctggaaaagcatggcgttgagagacttaaacgcatggcgatcagcggggacgactgtgtggtcaagccgatcgatgaccggtttgccaccgctctgacggccctcaatgatatgggaaaggtgagaaaagacattcctcagtgggaaccctctaagggctggaacgattggcagcaggttcctttctgctcccaccactttcatcaactgatcatgaaagacgggcgcgagattgtggtcccctgtcggaatcaggatgagcttgtgggcagagctcgcgtcagccagggagccggctggtccctgcgggaaacagcttgcctcgggaagtcttatgcccagatgtggcaactgatgtacttccacagacgcgacctgcggctcgcggccaacgctatctgtagcgccgtgcctgttgattgggtgcccacctccagaacaacctggagcattcatgcccaccatcagtggatgacgaccgaggacatgctgtctgtctggaatcgcgtgtggatcgaagagaacccgtggatggaagataaaacacacatttccagctggggagacgttccttatcttggcaagcgggaggaccagtggtgcgggtctctgatcggactcaccgctagagccacatgggcgaccaatatccaagtggctattaaccaggtccggagactgatcggcaatgagaactaccttgattacatgacaagcatgaagcgctttaaaaatgaatccgaccccgagggggccctgtggtga

SEQ ID NO: 19042 - RNA, 9879 nt, synthetic construct
  misc_feature 1..9879: note = derived and/or modified CDS sequence (opt5) from DENV-1__GQ199799__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactgaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaccccatcagctttgggctacactgctcagcctgaccttcatcagaacaaccttttctctgcactatgcctggaaaacgatggctatggttctttccattgtgagcctgttccctctctgtctgtctacaacctcccagaagaccacatggctcccggtgctgcttgggagcctgggatgcaagcccctgaccatgtttctcatcgccgagaataaaatttggggccggaagtcttggcctctgaacgaaggcatcatggcggtcgggatcgtgtccattcttctgagctccctcctgaaaaacgatgttcccctcgccggacctctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacaatgaaaatcaaggatgaggagcgcgacgatacgctgaccatccttctgaaagccacactcctggctgtgtctggagtctatcccctcagcattcctgccaccctgttcgtgtggtacttctggcaaaagaagaaacagagatccggcgtcctttgggacacaccctctccgcctgaagtggagcgggccgttctggatgacggcatctatcgcattatgcagagagggctgctcggacggagccaggtgggcgtcggggtgtttcaagaaaacgttttccataccatgtggcacgtgacgcgcggagctgtcctgatgtaccagggcaagagacttgagccctcctgggccagcgtgaaaaaggacctgatctcttacgggggaggctggcggctccagggctcctggaataccggggaggaagtgcaggttattgcggtcgagcctggaaaaaaccccaagaatgtgcaaacagctccgggcacctttaagacaagcgaaggggaggtgggagccatcgccctggatttcaaacctggcacctctgggtcccccattgtcaacagagaaggaaagatcgtgggcctctatggcaatggggttgtgacaacgagcggaacctacgtctccgctatcgcccaggcgaaagcttctcaggagggccctctgcccgagattgaagacgaggtgtttcgcaagcggaaccttacaatcatggatctgcaccccgggagcggaaaaaccagacgctatctgcctgccattgttcgggaagccatcaagagacgcctccggaccctgattcttgctccgacaagagtggtcgcctccgagatggctgaagccctgaagggcatgcccatccgctaccaaacgaccgcggtgaaaagcgagcatacagggaaggagatcgttgacctcatgtgccacgccaccttcacaatgcggctgctgtctcctgtgagagtccccaattataacatgattatcatggatgaagctcattttaccgacccttccagcattgccgctcggggctacatctctacgcgcgtgggaatgggcgaggccgccgctattttcatgacagcgaccccccctgggagcgtggaagcctttccgcagtccaatgctgtcatccaggatgaggaaagagacatccccgagcggtcttggaacagcggatatgagtggattaccgatttccctggcaaaacagtttggtttgtgccctccatcaagtctgggaatgacattgccaactgtctccgcaaaaatggaaagagagtgatccagcttagccggaagaccttcgatacagaataccaaaaaaccaagaacaacgactgggactacgtcgtgacgacagatatttccgagatgggcgccaatttcagagctgaccgcgttatcgatcctcggagatgcctgaaacccgtgattctgaaggacgggccggaacgcgtcatcctcgccggccctatgcccgtgaccgttgcgagcgctgcccagcggagaggacgcatcggccggaaccacaataaagagggggatcagtatatttacatgggacagcccctgaacaatgacgaggatcatgcccactggacagaagctaagatgcttctggacaacatcaatacccctgagggcattatccccgccctctttgaacctgagagagaaaagtctgcggccattgatggggagtatcgcctgagaggagaggctcggaaaacgttcgtggaactgatgcgcagaggcgacctcccggtctggctttcctacaaggtggccagcgaggggtttcaatattccgatcggcgctggtgcttcgacggcgaaagaaacaatcaggtcctggaggaaaacatggatgtggagatctggaccaaagagggagaacggaagaaactgagaccccgctggctcgacgctcggacatactctgaccctctggcccttagagagtttaaggaattcgctgccggccgccggagcgtttccggggatctgatcctcgagattggaaaactgccccagcacctgacccagagagcgcaaaatgccctcgacaaccttgtgatgctgcataattctgaacagggcgggcgggcttatcgccacgccatggaggagctgcctgatacaatcgaaaccctcatgctgcttgctctgattgccgtgctcacaggaggcgtcaccctgtttttcctgagcggcagagggctcggaaagacgtccatcggccttctgtgtgttatggccagctctgtgctgctctggatggcttccgtggagccccattggattgcggccagcatcatcctggaatttttccttatggtcctgctcattccggagcctgaccggcagcgcacaccccaggataaccaactggcttacgtggttatcgggctgctctttatgattcttaccgtggccgccaatgagatgggactgctggaaaccacaaagaaagacctcggcatcgggcacgtcgctgtggagaaccaccatcacgccgcgatgctggatgtcgaccttcatcctgcctctgcttggaccctgtacgccgtggctacaacgattatcacccccatgatgagacacacaattgaaaacaccacagccaatatctccctcaccgcgatcgccaaccaggctgccattctgatgggactggataagggctggcctatcagcaaaatggacattggcgttcccctccttgctctggggtgctattctcaggtgaatccgctgacgctcaccgccgctgtcctgatgcttgtggcccattacgcgatcattggacctggcctgcaagccaaggctacacgggaggcccagaaacgcaccgctgccgggatcatgaagaaccccacagttgatggaatcgtggccattgacctcgatcccgtcgtgtatgacgcgaagttcgaaaaacagctgggccagatcatgctgctcattctttgtaccagccaaatcctgctgatgagaacgacatgggctctctgcgagtccattaccctggccacagggcctcttaccaccctgtgggagggatctccgggcaagttttggaatacaacgatcgctgtgagcatggccaacatcttccggggctcctacctcgccggggctggactggccttcagcctgatgaaatccctcggcgggggacgcagaggcaccggggcgcagggagaaacacttggcgagaagtggaaacggcagctgaatcagctgtctaagagcgaatttaacacctataagagatccggcattatggaggttgaccgctctgaagccaaagaggggctcaagcggggagagacaaccaaacacgctgtcagcagaggcacggccaagctgcgctggttcgtggaacggaatcttgtgaaacccgaggggaaggtcatcgatctgggatgtggcagagggggatggtcctactattgcgctggcctcaagaaagttacagaagtgaagggctacaccaaagggggacctggccacgaggaacccattcctatggccacctacgggtggaacctggtgaagctgcattctggaaaagacgtctttttcatcccccctgagaagtgtgatacactcctttgcgacattggcgagagctccccgaatcccaccatcgaagaggggcgcacactgcgggtgctgaaaatggttgaaccttggctcagaggaaaccaattttgtattaagatcctgaatccctatatgcctagcgtggtcgagacgcttgagcagatgcagcgcaagcacggcggcatgctggtgcggaaccccctctctagaaattccacccatgaaatgtactgggttagctgcgggacaggaaacatcgtgtctgcggtcaatatgacctcccgcatgctgctgaaccggttcacaatggcccacagaaaaccgacctatgagcgcgatgtggacctcggcgctgggacgagacacgtggccgtcgaacctgaggttgctaacctggatattatcggacagcggattgaaaatatcaagcatgagcacaaaagcacctggcattacgacgaggataacccctataagacatgggcctaccacggctcttatgaagtgaaaccctccgggagcgcttccagcatggtgaatggagtcgtgaagcttctgaccaagccttgggacgttattcccatggtgacacaaatcgccatgaccgatacaaccccttttggccagcagcgcgtcttcaaagagaaggtggacacgagaacaccgaaagcgaagcggggcaccgcccaaatcatggaagttaccgctaaatggctctgggggtttctgtctagaaacaagaagccccggatttgtacacgcgaggaattcacgagaaaagtgcggagcaatgccgctatcggagccgtctttgtggacgagaaccagtggaattccgccaaggaggcggttgaagatgagcgcttctgggaccttgtgcatagagaacgggagctgcacaaacagggcaagtgcgctacctgcgtctacaacatgatggggaaacgcgaaaagaagctcggagagtttggcaaagccaaggggtctagagccatttggtacatgtggctgggcgctcggttcctggagttcgaagccctcggatttatgaatgaggatcactggttcagccgcgaaaactccctgtctggcgtggagggggagggacttcataaactgggctatatcctcagagacattagcaagatccctgggggaaatatgtacgctgatgacacagccggctgggatacccggatcacagaagacgatctgcagaacgaggcgaaaattaccgacatcatggaacccgagcacgcccttctggctaagtccatttttaaactcacatatcaaaataaggtcgtgcgcgttcagagacctgccaagaacgggaccgtgatggatgtcatctctcggcgcgaccagagaggcagcggacaggtgggcacgtacgggctgaataccttcacaaacatggaagctcaactgattcggcagatggagtccgagggaatctttagcccctctgaactcgagaccccgaacctggccggcagagtgcttgattggctggaaaaacatggggttgagcgcctcaagcggatggcgatctccggagacgactgtgtggtcaaacctattgatgacagattcgccacagctctgaccgcccttaatgatatgggcaaggtgcgcaaagacatcccccagtgggaacctagcaaggggtggaacgattggcagcaagttcccttttgctctcaccacttccatcagctgattatgaaggacggccgggagatcgtggtcccttgtagaaatcaggatgagctcgtgggacgcgctcgggtctcccagggcgccgggtggagcctgagagaaacggcttgcctgggaaaatcctatgcccaaatgtggcagctcatgtactttcaccgccgggacctgagacttgcggccaacgctatttgttctgccgtgcccgttgattgggtgccgacaagccgcaccacatggtccatccatgcccaccatcagtggatgaccacggaggacatgctgagcgtctggaatcgggtgtggattgaagagaacccttggatggaagataagacccacgtttcttcctggggcgacgtgccctatctcgggaaaagagaggaccaatggtgcggaagcctgatcggccttacagctcgggccacctgggcgacaaatatccaggtcgctattaaccaggtgagacgcctgctcgggaatgagaactacctggattacatgacctctatgaagcggttcaaaaatgaaagcgaccccgagggcgccctgtggtga

SEQ ID NO: 19043 - RNA, 9879 nt, synthetic construct
  misc_feature 1..9879: note = derived and/or modified CDS sequence (opt5) from DENV-1__GQ199800__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagttctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttctgacacaagatgaaaagggggtgacccagaacggacggctgatcacagctaatcccattgtcacggacaaagagaagcctgtgaacatcgaagccgagccgcccttcggcgagagctatattgtgatcggggccggagaaaaagctcttaagctctcttggtttaagaaaggcagctccattgggaagatgttcgaggccaccgctagaggcgcccgccggatggcgatcctgggagatacagcctgggactttggctctatcgggggagttttcaccagcgtcggcaaactggtgcatcagatttttgggacagcttacggagtcctgttctccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatctttgtgacaaatgaggtccacacctggacagaacaatataagttccaggccgactcccctaaacggctgtctgcggccattggcaaggcttgggaggagggggtgtgcggcatcagaagcgccacccgcctcgaaaacatcatgtggaaacagatttccaacgagctgaatcatatccttctggaaaacgacatgaagtttacggttgtggtcggagatgtggctggcattctcgcccaggggaaaaagatgatccggccgcaacccatggagtacaaatattcttggaaaagctggggaaaggccaagattatcggcgctgacgtgcagaatacaaccttcatcattgatgggcctaacacccccgaatgtcctgacgatcagagagcgtggaatatctgggaggtcgaggactacggatttggcattttcacaaccaacatctggctgaagctgcgcgattcctatacgcaggtttgcgaccaccggcttatgagcgccgctattaaagattctaaggccgtgcacgccgacatgggctactggatcgaatccgagaaaaatgaaacatggaagctcgctagagccagcttcatcgaggtgaagacctgtatttggcccaaatctcatacactgtggtccaacggggtcctggaaagcgagatgatcattccgaagatctatggaggccctatttctcaacacaattaccgccccgggtactttacccagacagcgggaccttggcatctcggcaaactggagcttgatttcgacctgtgcgaagggaccacggtggttgtggatgagcactgcggaaaccggggccccagcctcagaaccacaaccgtcacaggcaagatcatccacgaatggtgttgccggtcctgtaccctgcctcccctgcgctttaaaggggaggacggatgctggtatggcatggagattagaccggtgaaggaaaaggaggaaaatcttgttaaaagcatggtgtctgctgggtccggagaggtcgacagcttctccctcggcctgctgtgtatctctattatgatcgaagaggtgatgcggagcagatggtcccgcaagatgctcatgacggggacactggccgtctttttccttctgattatgggacagctcacctggaacgatctgatccggctgtgcattatggtgggcgccaatgcttctgacagaatgggcatggggacaacctaccttgccctgatggcgacctttaaaatgcgccctatgttcgctgtcggactcctgtttagacggctcacaagccgcgaggtgctgcttctgacgatcggcctctccctggtggcctctgtcgaactgcccaacagccttgaggaactgggggatggactcgccatgggcatcatgattctgaagctcctgaccgacttccaatcccatcagctttgggctacactgctcagcctgacctttatcaaaacaaccttctctctgcactatgcctggaagacgatggctatggttctttccattgtgagcctgtttcccctctgtctgtctacaacctcccagaagaccacatggctccctgtgctgcttgggagcctgggatgcaaaccgctgaccatgttcctcatcgccgagaataagatttggggcagaaaatcttggcccctgaacgaaggcatcatggcggtcgggatcgtgtccattcttctgagctccctcctgaagaacgatgttcctctcgccggacccctgatcgctggcgggatgcttattgcctgttacgtgatcagcggatctagcgctgacctgtccctggagaaagccgccgaggtctcttgggaagaggaagctgagcatagcggcgcgtcccacaatattctcgtggaagttcaggatgacgggacaatgaagatcaaagatgaggagcgggacgatacgctgaccatccttctgaaggccacactcctggctgtgtctggagtctatcctctcagcattcccgccaccctgttcgtgtggtacttttggcaaaagaaaaagcagcgctccggcgtcctttgggacacaccttctcccccggaagtggagagagccgttctggatgacggcatctatcggattatgcagcgcgggctgctcggaagaagccaggtgggcgtcggggtgttccaagaaaacgtttttcataccatgtggcacgtgacgcggggagctgtcctgatgtaccagggcaaacgccttgagccttcctgggccagcgtgaagaaagacctgatctcttacgggggaggctggagactccagggctcctggaataccggggaggaagtgcaggttattgcggtcgagcccggaaagaaccctaagaatgtgcaaacagctcccggcaccttcaaaacaagcgaaggggaggtgggagccatcgccctggattttaagccgggcacctctgggtcccctattgtcaaccgggaaggaaaaatcgtgggcctctatggcaatggggttgtgacaacgagcggaacctacgtctccgctatcgcccaggcgaaggcttctcaggagggccccctgcctgagattgaagacgaggtgttcagaaaacgcaaccttacaatcatggatctgcaccccgggagcggaaagacccggagatatctgcccgccattgttcgcgaagccatcaagcggaaactcagaaccctgattcttgctcctacacgcgtggtcgcctccgagatggctgaagccctgaagggcatgccgatccggtaccaaacgaccgcggtgaaaagcgagcatacagggaaggagatcgttgacctcatgtgccacgccacctttacaatgagactgctgtctcccgtgcgcgtccctaattataacatgattatcatggatgaagctcatttcaccgacccctccagcattgccgctcggggctacatctctacgagagtgggaatgggcgaggccgccgctatttttatgacagcgacccctcccgggagcgtggaagccttccctcagtccaatgctgtcatccaggatgaggaacgggacatcccggagcgctcttggaacagcggatatgagtggattaccgattttcccggcaaaacagtttggttcgtgccttccatcaagtctgggaatgacattgccaactgtctcagaaagaatggaaaacgggtgatccagcttagccgcaagaccttcgatacagaataccagaaaaccaagaacaacgactgggactacgtcgtgacgacagatatttccgagatgggcgccaattttagagctgaccgggttatcgatcccagacgctgcctgaaacctgtgattctgaaggacgggcccgaacgggtcatcctcgccggcccgatgcctgtgaccgttgcgagcgctgcccagagacgcggacggatcggcagaaaccacaataaggagggggatcagtatatttacatgggacagcccctgaacaatgacgaggatcatgcccactggacagaagctaaaatgcttctggacaacatcaatacccccgagggcattatccctgccctcttcgaacccgagcgcgaaaagtctgcggccattgatggggagtatcggctgagaggagaggctcgcaaaacgtttgtggaactgatgagacggggcgacctccctgtctggctttcctacaaggtggccagcgaggggttccaatattccgatcgcagatggtgctttgacggcgaacggaacaatcaggtcctggaggaaaacatggatgtggagatctggaccaaagagggagaacgcaagaaactgagaccgcggtggctcgacgctagaacatactctgaccccctggcccttcgcgagttcaaggaatttgctgccggccggagaagcgtttccggggatctgatcctcgagattggaaagctgcctcagcacctgacccagcgcgcgcaaaatgccctcgacaaccttgtgatgctgcataattctgaacagggcgggcgggcttatagacacgccatggaggagctgcccgatacaatcgaaaccctcatgctgcttgctctgattgccgtgctcacaggaggcgtcaccctgttctttctgagcggccgggggctcggaaaaacgtccatcggccttctgtgtgttatggccagctctgtgctgctctggatggcttccgtggagcctcattggattgcggccagcatcatcctggagttctttcttatggtcctgctcattcccgagccggaccgccagagaacacctcaggataaccaactggcttacgtggttatcgggctcctcttcatgattcttaccgtggccgccaatgagatgggactgctggaaaccacaaagaaagacctcggcatcgggcacgtcgctgtggagaaccaccatcacgccgcgatgctggatgtcgaccttcatcccgcctctgcttggaccctgtacgccgtggctacaacgattatcacccctatgatgcggcacacaattgaaaacaccacagccaatatctccctcaccgcgatcgccaaccaggctgccattctgatgggactggataagggctggcccatcagcaaaatggacattggcgttcctctccttgctctggggtgctattctcaggtgaatcccctgacgctcaccgccgctgtcctgatgcttgtggcccattacgcgatcattggaccgggcctgcaagccaaggctacacgcgaggcccagaagagaaccgctgccgggatcatgaaaaaccctacagttgatggaatcgtggccattgacctcgatcccgtcgtgtatgacgcgaagtttgaaaaacagctgggccagatcatgctgctcattctttgtaccagccaaatcctgctgatgcggacgacatgggctctctgcgagtccattaccctggccacagggccccttaccaccctgtgggagggatctcctggcaagttctggaatacaacgatcgctgtgagcatggccaacatcttccgcggctcctacctcgccggggctggactggcctttagcctgatgaaatccctcggcgggggaagacggggcaccggggcgcagggagaaacacttggcgagaagtggaagcgccagctgaatcagctgtctaaaagcgagttcaacacctataagagatccggcattatggaggttgaccggtctgaagccaaagaggggctcaagagaggagagacaaccaaacacgctgtcagccgcggcacggccaagctgcggtggtttgtggaaagaaatcttgtgaagccggaggggaaagtcatcgatctgggatgtggccgcgggggatggtcctactattgcgctggcctcaagaaagttacagaagtgaagggctacaccaaagggggacccggccacgaggaacctattcccatggccacctacgggtggaacctggtgaagctgcattctggaaaagacgtcttctttatccctcccgagaagtgtgatacactcctttgcgacattggcgagagctcccctaatccgaccatcgaagaggggcggacactgagagtgctgaagatggttgaaccctggctccgcggaaaccaattctgtattaaaatcctgaatccttatatgcccagcgtggtcgagacgcttgagcagatgcagcggaagcacggcggcatgctggtgagaaaccctctctctcgcaattccacccatgaaatgtactgggttagctgcgggacaggaaacatcgtgtctgcggtcaatatgacctcccggatgctgctgaacagatttacaatggcccaccgcaaacccacctatgagcgggatgtggacctcggcgctgggacgagacacgtggccgtcgaaccggaggttgctaacctggatattatcggacagcgcattgaaaatatcaagcatgagcacaaaagcacctggcattacgacgaggataacccttataagacatgggcctaccacggctcttatgaagtgaagccctccgggagcgcttccagcatggtgaatggagtcgtgaaacttctgaccaagccctgggacgttattcctatggtgacacaaatcgccatgaccgatacaacccccttcggccagcagagagtctttaaagagaaggtggacacgcggacacctaaagcgaagcgcggcaccgcccaaatcatggaagttaccgctaagtggctctgggggttcctgtctagaaacaaaaagccgcggatttgtacaagagaggaatttacgcggaaagtgcgcagcaatgccgctatcggagccgtcttcgtggacgagaaccagtggaactccgccaaggaggcggttgaagatgagagattttgggaccttgtgcatcgggaacgcgagctgcacaaacagggcaagtgcgctacctgcgtctacaacatgatggggaagagagagaaaaagctcggagagttcggcaaagccaaggggtctcgggccatttggtacatgtggctgggcgctcgcttcctggagtttgaagccctcggattcatgaatgaggatcactggtttagcagagaaaactccctgtctggcgtggagggggagggacttcataaactgggctatatcctccgggacattagcaagatccccgggggaaatatgtacgctgatgacacagccggctgggatacccgcatcacagaagacgatctgcagaacgaggcgaaaattaccgacatcatggaacctgagcacgcccttctggctaagtccattttcaagctcacatatcaaaataaagtcgtgagagttcagcggcccgccaagaacgggaccgtgatggatgtcatctctcgcagagaccagcggggcagcggacaggtgggcacgtacgggctgaatacctttacaaacatggaagctcaactgattcgccagatggagtccgagggaatcttcagcccttctgaactcgagacccccaacctggccggcagagtgcttgattggctggaaaaacatggggttgagcggctcaagagaatggcgatctccggagacgactgtgtggtcaaaccgattgatgaccgctttgccacagctctgaccgcccttaatgatatgggcaaggtgcggaaggacatccctcagtgggaacccagcaaagggtggaacgattggcagcaagttcctttctgctctcaccactttcatcagctgattatgaaggacggcagagagatcgtggtcccctgtcgcaatcaggatgagctcgtgggacgggctagagtctcccagggcgccgggtggagcctgcgcgaaacggcttgcctgggaaaatcctatgcccaaatgtggcagctcatgtacttccaccggagagacctgcgccttgcggccaacgctatttgttctgccgtgcctgttgattgggtgcccacaagccggaccacatggtccatccatgcccaccatcagtggatgaccacggaggacatgctgagcgtctggaatagagtgtggattgaagagaacccgtggatggaagataagacccacatctcttcctggggcgacgttccttatctcgggaaacgcgaggaccaatggtgcggaagcctgatcggccttacagctcgggccacctgggcgacaaatattcaggtggctatcaaccaggtcagacggctgattgggaatgagaactacctcgattacatgacctctatgaagagatttaagaatgaaagcgaccccgagggcgccctgtggtga

SEQ ID NO: 19044 - RNA, 9879 nt, synthetic construct
  misc_feature 1..9879: note = derived and/or modified CDS sequence (opt5) from DENV-1__FJ882548__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagaccagcgccggcgttaatatgtgcacccttattgcgatggacctgggggagctctgtgaagatacgatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctgctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcctgcccctctgtctgagcaccacctctcagaagacaacctggcttcctgttctgctgggatccctcggctgcaagccgctgacaatgttccttattgccgagaataaaatctggggccggaagtcctggcccctgaacgaagggatcatggcggtgggaattgtgtctatcctcctgtccagcctcctgaaaaacgatgtccctcttgccggccccctgattgctgggggaatgctgatcgcctgttacgtgatttccggcagctctgctgacctcagcctggagaaggccgccgaggtttcctgggaagaggaagctgagcattctggggcgagccacaatatccttgtggaagtccaggatgacggaacgatgaaaatcaaggatgaggagcgcgacgataccctgacaattctcctgaaagccaccctcctggctgtgtccggcgtttatcctctttctatccccgccacactgtttgtgtggtacttctggcaaaagaagaaacagagaagcggcgtcctgtgggacacccctagccctcccgaagtggagcgggccgtcctcgatgacgggatttatcgcatcatgcagagaggactgcttggccggtctcaggtgggggttggagtgttccaagaaaacgtctttcatacgatgtggcacgtgacccgcggcgctgttctgatgtaccaggggaagagactcgagcccagctgggcctccgtgaaaaaggacctgattagctacggaggcggctggcggctcagagggtcttggaatacaggagaggaagtccaggtgatcgcggtggagcccggcaaaaaccctaagaatgttcagaccgctcccgggacattcaagaccccggaaggagaggtcggcgccattgccctggattttaaacctgggacatccggaagccccatcgtgaaccgcgaaggcaagatcgtgggcctttatgggaatggagtcgtgacgacctctggcacatacgtttccgctattgcccaagcgaaagctagccaggaggggcctctgcccgagatcgaagacgaggtgttccggaagagaaacctgaccattatggatctccaccccggatccggcaaaacccgccggtatctgcctgccatcgtcagagaagccattaagcgcaaacttcggacactgatcctcgctccgacgagagtggttgcctctgagatggctgaagccctgaaagggatgcccatccgctaccagaccacagcggtcaagagcgagcataccggcaaagagattgtcgacctgatgtgccacgccacatttaccatgcggctcctttcccctgtgagagttcccaattataacatgatcattatggatgaagctcatttcacggaccctagctctatcgccgctcggggatacatttccacacgcgtgggcatgggggaggccgccgctatctttatgaccgcgacaccccctggaagcgtcgaagccttcccgcaatctaatgctgtgatccaggatgaggaaagagacattcccgagcggagctggaactccggccacgagtggatcacagattttcctgggaagaccgtgtggttcgtcccctctattaaaagcggaaatgacatcgccaactgtctgcgcaagaatggcaagagagttattcagctgtcccggaaaacatttgataccgaatatcagaagacgaaaaacaacgactgggactacgtggtgacaaccgatatctctgagatgggggccaatttcagagctgaccgcgtcattgatcctcggagatgcctcaagcccgtgatcctgaaagacggcccggaacgcgttatccttgccggacctatgcccgtgacagtcgcgagcgctgcccaacggagaggccgcattgggcggaaccataataaggagggagatcagtacatctatatgggccagcccctgaacaatgacgaggatcacgcccactggaccgaagctaagatgctcctggacaacattaatacgcctgaggggatcattcccgccctgttcgaacctgagagagaaaaatccgcggccgtggatggagagtaccgcctcagaggcgaggctcggaagacctttgttgaacttatgcgcagaggggacctgccggtgtggctgagctataaagtcgcctctgagggcttccagtactccgatcggcgctggtgctttgacggagaaagaaacaatcaagtgctcgaggaaaacatggatgtcgagatctggacaaaggagggcgaacggaaaaagctgagaccccgctggcttgacgctcggacctatagcgaccctctggccctcagagagttcaaagaatttgctgccgggcgccggtccgtgtctggagatctgatcctggagattggcaagctcccccagcatcttacacagagagcgcagaatgccctggacaacctggttatgctccacaatagcgaacaagggggacgggcttaccgccatgccatggaggagctgcctgataccatcgaaacacttatgctgctcgctctgattgccgtgctgaccggcggcgtgacactcttctttctttccgggagaggactgggcaagacatctatcgggctgctctgtgtcatggccagctccgttctgctttggatggctagcgtggagccccactggattgcggcctctatcatcctggagttctttctcatggtgctgctgattccggagcctgaccggcagcgcacaccccaggataaccagctcgcttatgtcgtgatcggacttctgttcatgattctgaccgttgccgccaatgagatgggcctcctggaaacaaccaaaaaggaccttgggatcggacacgtggctgtcgagaaccatcaccatgccgcgatgctggatgtggacctccaccctgcctccgcttggacactgtacgccgtcgctacgaccattatcacacccatgatgagacataccattgaaaacacaaccgccaatatcagcctgacggcgatcgccaaccaagctgccattctcatgggccttgataaaggctggcctatctctaagatggacattggggtgcccctgctggctctcggatgctactcccaggttaatccgctgacccttacagccgctgtgctgatgctcgtcgcccactatgcgatcattggccctgggctgcaggccaaagctacccgggaggcccaaaagcgcacagctgccggaatcatgaagaaccccaccgtggatggcatcgttgccattgacctggatcccgtggtctacgacgcgaaatttgaaaagcagctcgggcagatcatgcttctgattctgtgtacgagccagatcctcctgatgagaacaacctgggctctttgcgagtctattacactggccaccggacctctcaccacactgtgggagggcagcccgggcaaattctggaatacgaccatcgctgtgtccatggccaacatctttcgggggtcttatctggccggagctggcctcgccttcagccttatgaagtccctcgggggaggccgcagagggacaggagcgcaaggcgaaaccctgggcgagaaatggaagcggcagctcaatcagctgagcaagtccgagttcaacacatacaaaagatctgggattatggaggtggaccgcagcgaagccaaggagggacttaaacggggcgagaccacgaagcacgctgtttccagagggacagccaaactgcgctggtttgtcgaacggaatctcgtgaagcccgagggaaaggtgatcgatctgggctgtgggagaggaggctggtcttattactgcgctggcctgaaaaaggtcaccgaagttaaagggtataccaagggaggccctgggcatgaggaacccattcctatggccacatacggatggaacctcgtgaaacttcacagcggcaaggacgtgttctttattccccctgagaaatgtgataccctgctgtgcgacatcggggagtcctctccgaatcccacaatcgaagagggacgcacgctccgggtcctgaagatggtggaaccttggcttagaggcaaccagttctgtattaagatcctgaatccctacatgcctagcgttgtggagaccctcgagcaaatgcagcgcaaacatggcgggatgctggtccggaaccccctgtccagaaatagcacacacgaaatgtattgggtgtcttgcggaaccggcaacatcgtttccgcggtgaatatgacaagccgcatgctcctgaaccggtttaccatggcccacagaaagccgacgtacgagcgcgatgtcgaccttgggaccggaacaagacatgtggctgtggaacctgaggtcgccaacctggatattatcggccagcggattgaaaatatcaaacacgagcataagtctacctggcactatgacgaggataacccctacaaaacatgggcttatcatgggtcctacgaagttaagcccagcggatctgcctccagcatggtgaatggcgtggtcaagctcctgaccaaaccttgggacgtgattcccatggttacacagatcgctatgaccgatacgacacctttcggccaacagcgcgtgtttaaggagaaagtcgacaccagaaccccgaaggccaaacgggggacagcgcagatcatggaagtgacggccagatggctttggggattcctgtcccggaacaagaagccccgcatttgtaccagagaggaatttacacggaaagttcgcagcaatgctgccatcggcgctgtgttcgtcgacgagaaccaatggaactctgccaaggaggccgtggaagatgagagattttgggacctcgttcaccgggaacgcgagctgcacaaacaggggaagtgcgcgacctgcgtgtataacatgatgggaaaaagagaaaagaagctgggcgagttcgggaaagctaagggcagccgggccatttggtacatgtggctcggagcccgctttctggagttcgaagctcttggcttcatgaatgaggatcattggttttccagagaaaactctctgagcggggtcgagggagagggcctccacaaactggggtacatccttcgggacatttccaagatccctggaggcaatatgtatgccgatgacacagctgggtgggatacccgcatcacagaagacgatctgcagaacgaggccaaaattaccgacatcatggaacccgagcatgcgctcctggccaaggctattttcaaactgacgtaccagaataaggtggtcagagtgcaacggcctgccaagaacggcaccgttatggatgtgatctctcgcagagaccagcggggaagcggccaggtcgggacatatggactcaatacctttacaaacatggaagctcagctgattagacaaatggagtccgagggcatcttctctcccagcgaacttgagaccccgaacctggccgaacgcgcgctcgattggctggagaaatacggggtggaacggcttaagagaatggccatctccggagacgactgtgtggttaaacctattgatgaccgctttgctacggccctgacagctctcaatgatatgggcaaggtgcggaaagacatcccccagtgggagcctagcaaggggtggaacgattggcagcaggtccccttctgctctcaccactttcatcaactgattatgaaggacggcagagagatcgtggttccttgtcgcaatcaggatgaactggtgggacgggccagagtctcccagggcgctgggtggagcctccgcgagaccgcctgcctgggaaaatcttatgcgcagatgtggcaacttatgtacttccaccggagagacctgcgcctcgccgctaacgccatttgttccgccgtgcccgtcgattgggtgccgacaagccggaccacgtggtccatccatgctcaccatcagtggatgaccacagaagacatgctgtctgtttggaatagagtgtggattgaggaaaacccttggatggaggataagacccacatcagctcctgggaggacgtcccctatcttggcaaacgggaagaccagtggtgcgggagcctgatcggactcacagccagagcgacctgggctacaaatattcaagtggccatcaaccaggttcgccggctgattggcaatgagaactacctggattacatgacctctatgaagagatttaaaaatgaatccgaccccgagggggccctctggtga

SEQ ID NO: 19045 - RNA, 9879 nt, synthetic construct
  misc_feature 1..9879: note = derived and/or modified CDS sequence (opt5) from DENV-1__GQ199801__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggaactctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacacggcttgagggaaaaatcgttcagtacgaaaacctgaagtattccgtgatcgtcacggtgcacaccggcgaccagcatcaagttgggaatgagagcacagaacacggaaccacagctaccattacgccccaggccccttctaccgagatccagctcacagactacggcgccctgaccctggattgtagcccccgcacaggcctcgacttcaacgaaatggtgctgcttaccatgaaagaaaagtcctggctggtccataaacagtggtttctcgatctgcctcttccctggacgtccggggcttctacaagccaagagacctggaatagacaggacctgctcgtgacattcaagaccgcgcacgccaaaaagcaggaagtcgtggttctgggatcccaagagggcgctatgcacaccgccctgacaggggccacggaaattcagaccagcggaacaaccacaatctttgctggccatctcaagtgccggctgaaaatggataaacttaccctgaaagggatgtcttatgtgatgtgtacgggctccttcaagctcgagaaagaagtcgccgagacacagcacggaaccgtgctggttcagattaagtacgagggcaccgacgcgccgtgcaagatccctttcagcacacaagatgaaaaaggggtgacccagaacggaagactgatcacagctaatcccattgtcacggacaaggagaaacctgtgaacatcgaagccgagccgccctttggcgagtcttatattgtgatcggggccggagaaaaggctcttaaactcagctggttcaagaagggctcctctattgggaaaatgtttgaggccaccgctcgcggcgcccggagaatggcgatcctgggagatacagcctgggacttcggcagcatcgggggagtttttacctccgtcggcaagctggtgcatcagattttcgggacagcttacggagtgctctttagcggcgtctcttggaccatgaaaatcgggattggcgtgctgcttacgtggctgggactcaattcccgcagcacctctctgtccatgacatgtatcgccgttggcctggtgaccctttacctcggggtcatggtgcaggctgatagcggatgcgttattaactggaagggccgggaactgaaatgtgggtccggaatcttcgtgacaaatgaggtccacacctggacagaacaatataagtttcaggccgactctcctaagagactgagcgcggccattggcaaggcttgggaggagggggtgtgcggcatccgctccgccacccggctcgaaaacatcatgtggaagcagatttctaacgagctgaatcatatccttctggaaaacgacatgaaattcacggttgtggtcggagatgtggctggcattctcgcccaggggaagaaaatgatcagaccgcaacccatggagtacaagtatagctggaaatcctggggaaaggccaagattatcggcgctgacgtgcagaatacaacctttatcattgatgggcctaacacccccgaatgtcctgacgatcagcgcgcgtggaatatctgggaggtcgaggactacggattcggcatttttacaaccaacatctggctgaaactgcgggatagctatacgcaggtttgcgaccacagacttatgtctgccgctattaaggattccaaagccgtgcacgccgacatgggctactggatcgaaagcgagaagaatgaaacatggaaactcgctcgcgcctctttcatcgaggtgaagacctgtatttggcccaagtcccatacactgtggagcaacggggtcctggaatctgagatgatcattccgaaaatctatggaggccctattagccaacacaattaccggcccgggtacttcacccagacagcgggaccttggcatctcggcaagctggagcttgattttaacctgtgcgaagggaccacggtggttgtggacgagcactgcggaaatagaggcccctccctccggaccacaaccgtcacaggcaaaatcatccacgaatggtgttgccgcagctgtaccctgcctcccctgagattcaagggggaggatggatgctggtatggcatggagattcggccggtgaaagaaaaggaggaaaaccttgttaagtctatggtgtccgctgggagcggagaggtcgactccttttctctcggcctgctgtgtatcagcattatgatcgaagaggtgatgagatcccgctggtctaaaaagatgctcatgacggggacactggccgttttctttcttctgattatgggacagctcacctggaatgacctgatccggctgtgcattatggtgggcgccaacgctagcgatagaatgggcatggggacaacctaccttgccctgatggcgaccttcaaaatgcgccctatgctcgctgtcggactgctctttagacggctgacatcccgcgaggtgcttctgctcacgatcggcctgtctctggtggccagcgtcgaacttcccaattccctggaggaactcggggacggactggccatgggcatcatgattctcaagctgcttaccgatttccaaagccatcagctgtgggctacactcctgtctctgacctttatcaaaacaacctattcccttcactacgcctggaagacgatggctatggttctgagcattgtgtctctcttccccctgtgtctctccacaaccagccagaagaccacatggctgcctgtgcttctggggtctctgggatgcaaaccgctcaccatgtttctgatcgccgagaacaagatttggggcagaaaatcctggccccttaacgaaggcatcatggcggtcgggatcgtgagcattctgctctccagcctgctcaagaatgacgttcctctggccggaccccttatcgctggcgggatgctgattgcctgttatgtgatctctggaagctccgctgatctgtctctcgagaaagccgccgaggtcagctgggaagaggaagctgagcattccggcgcgtctcacaacattctggtggaagttcaggacgatgggacaatgaagatcaaagacgaggagcgggatgacacgcttaccatcctgctcaaggccacactgctcgctgtgagcggagtctaccctctgtccattcccgccacccttttcgtgtggtatttttggcaaaagaaaaagcagcgctctggcgtcctgtgggatacacctagccctcccgaagtggagagagccgttctggacgatggcatctaccggattatgcagcgcgggctcctgggaagatcccaggtgggcgtcggggtgttccaagaaaatgttttccataccatgtggcacgtgacgcggggagctgtccttatgtaccagggcaaacgcctggagcccagctgggcctctgtgaagaaagacctcatctcctatgggggaggctggagactgcagggcagctggaacaccggggaggaagtgcaggttattgcggtcgagcccggaaagaatcctaagaacgtgcaaacagctcccggcacctttaaaacatctgaaggggaggtgggagccatcgccctcgacttcaagccgggcacctccgggagccctattgtcaatcgggaaggaaaaatcgtgggcctgtacggcaacggggttgtgacaacgtccggaacctatgtctctgctatcgcccaggcgaaggctagccaggagggcccccttcctgagattgaaaatgaggtgtttagaaaacgcaacctgacaatcatggatctgcaccccgggtccggaaagacccggagatacctccccgccattgttcgcgaagccatcaagcggaaactgagaacccttattctggctcctacacgcgtggtcgccagcgagatggctgaagccctcaagggcatcccgatccggtatcaaacgaccgcggtgaaatctgagcatacagggaaggagattgttgacctgatgtgccacgccaccttcacaatgagactgctctcccccgtgcgcgtccctaattacaacatgatcattatggatgaagctcattttaccgaccccagctctatcgccgctcggggctatattagcacgagagtgggaatgggcgaggccgccgctatcttcatgacagcgacccctcccgggtccgtggaagcctttcctcagtctaatgctgtcatccaggatgaggaacgggacattccggagcgcagctggaactccggatacgagtggatcaccgatttccccggcaaaacagtttggtttgtgccttctattaagagcgggaatgacatcgccaactgtcttagaaagaacggaaaacgggtgattcagctgtcccgcaagaccttcgatacagaataccagaagaccaagaataacgactgggattatgtcgtgacgacagacatcagcgagatgggcgccaattttagagctgaccgggttattgatcccagacgctgcctgaaacctgtgatcctcaaggacgggcccgaacgggtcatcctggccggcccgatgcctgtgaccgttgcgtctgctgcccagagacgcggacggattggcagaaaccacaataaggagggggatcagtacatctatatgggacagccccttaacaatgacgaggatcatgcccactggacagaagctaaaatgctgctcgacaacattaatacccccgagggcatcattcctgccctgttcgaacccgagcgcgaaaagtccgcggccatcgatggggagtaccggctgagaggagaggctcgcaaaacgttcgtggaactcatgagacggggcgaccttcctgtctggctgagctataaggtggcctccgaggggtttcaatactctgatcgcagatggtgcttcgacggcgaacggaacaatcaggtcctggaggaaaacatggatgtggagatctggaccaaagagggagaacgcaagaaactcagaccgcggtggctggacgctagaacatatagcgatccccttgccctgcgcgagtttaaggagttcgctgccggccggagatccgtttctggggacctcattctggagatcggaaagctgcctcagcacctcacccagcgcgcgcaaaatgcccttgacaacctggtgatgctgcataatagcgaacagggcgggcgggcttacagacacgccatggaggagctccccgatacaattgaaaccctgatgcttctggctctcatcgccgtgctgacaggaggcgtcaccctgtttttcctctccggccgggggcttggaaaaacgagcattggcctgctgtgtgttatggcctcttccgtgctcctgtggatggctagcgtggagcctcattggatcgcggcctctatcattcttgaatttttcctgatggtcctcctgatccccgagccggaccgccagagaacacctcaggataaccaactggcttacgtggttattgggctcctttttatgatcctgaccgtggccgccaacgagatgggactgctcgaaaccacaaagaaagacctgggcattgggcacgtcgctgtggagaatcaccatcacgccgcgatgcttgatgtcgacctgcatcccgcctccgcttggaccctctatgccgtggctacaacgatcattacccctatgatgcggcacacaatcgaaaacaccacagccaatatcagcctgaccgcgattgccaaccaggctgccatcctgatgggactcgataagggctggcccatttctaaaatggacatcggcgttcctcttctggctctggggtgctacagccaggtgaatcccctcacgctgaccgccgctgtccttatgctggtggcccattatgcgattatcggaccgggcctccaagccaaggctacacgcgaggcccagaagagaaccgctgccgggatcatgaaaaaccctacagttgatggaattgtggccatcgacctggatcccgtcgtgtacgacgcgaagttcgaaaaacagctgggccagattatgctccttatcctgtgtacctcccaaattctgctcatgcggacgacatgggctctgtgcgagtctatcacccttgccacagggcccctgaccaccctctgggagggaagccctggcaagttttggaatacaacgatcgctgtgtccatggccaacattttccgcggcagctatctggccggggctggactggccttttccctcatgaaatctcttggcgggggaagacggggcaccggggcgcagggagaaacactgggcgagaagtggaagcgccagctgaatcagctcagcaaatccgagttcaacacctacaagagatctggcatcatggaggttgatcggagcgaagccaaagaggggctgaagagaggagagacaaccaaacacgctgtctcccgcggcacggccaaacttcggtggttcgtggaaagaaatctggtgaagccggaggggaaagtcattgacctcggatgtggccgcgggggatggtcttattactgcgctggcctgaagaaagttacagaagtgaagggctacaccaaagggggacccggccacgaggaacctatccccatggccacctatgggtggaacctggtgaagctccatagcggaaaagacgtctttttcattcctcccgagaagtgtgatacacttctgtgcgacatcggcgagtccagccctaatccgaccattgaagaggggcggacactgagagtgctcaagatggttgaaccctggctgcgcggaaaccaattttgtatcaaaatccttaatccttacatgccctctgtggtcgagacgctggagcagatgcagcggaagcacggcggcatgctcgtgagaaaccctctgtcccgcaatagcacccatgaaatgtattgggtttcttgcgggacaggaaacattgtgtccgcggtcaacatgaccagccggatgctgctcaatagattcacaatggcccaccgcaaacccacctacgagcgggatgtggacctgggcgctgggacgagacacgtggccgtcgaaccggaggttgctaaccttgatatcattggacagcgcatcgaaaatattaagcatgagcacaaatctacctggcattatgacgaggataacccttacaagacatgggcctatcacggctcctacgaagtgaagcccagcgggtccgctagctctatggtgaatggagtcgtgaaactgctcaccaagccctgggacgttatccctatggtgacacaaatcgccatgaccgatacaaccccctttggccagcagagagtcttcaaagagaaggtggacacgcggacacctaaagcgaagcgcggcaccgcccaaattatggaagttaccgctaagtggctgtgggggtttcttagcagaaacaaaaagccgcggatctgtacaagagaggagttcacgcggaaagtgcgctccaatgccgctattggagccgtctttgtggatgagaaccagtggaactctgccaaggaggcggttgaagacgagagattctgggacctggtgcatcgggaacgcgagctccacaaacagggcaagtgcgctacctgcgtctacaacatgatggggaagagagagaaaaagctgggagagtttggcaaagccaaggggagccgggccatctggtatatgtggctgggcgctcgcttcctcgagtttgaagccctgggattcatgaatgaggatcactggttctccagagaaaactctcttagcggcgtggagggggagggactgcataaactcggctacattctgcgggacatctccaagatccccgggggaaatatgtatgctgatgacacagccggctgggatacccgcattacagaagacgatcttcagaacgaggcgaaaatcaccgacattatggaacctgagcacgccctgctcgctaagtctatctttaagctgacataccaaaataaagtcgtgagagttcagcggcccgccaagaacgggaccgtgatggatgtcattagccgcagagaccagcggggctccggacaggtgggcacgtatgggctgaacaccttcacaaatatggaagctcaactcatccgccagatggagagcgagggaatcttttctccttccgaactggagacccccaaccttgccggcagagtgctggattggctcgaaaaacatggggttgagcggctgaagagaatggcgattagcggagacgattgtgtggtcaaaccgatcgacgaccgcttcgccacagctcttaccgccctgaatgatatgggcaaggtgcggaaggacattcctcagtgggaaccctctaaagggtggaacgattggcagcaagttcctttttgctcccaccacttccatcagctcatcatgaaggacggcagagagattgtggtcccctgtcgcaatcaggatgagctggtgggacgggctagagtcagccagggcgccgggtggtccctgcgcgaaacggcttgcctcggaaaatcttacgcccaaatgtggcagctgatgtattttcaccggagagaccttcgcctggcggccaacgctatctgtagcgccgtgcctgttgattgggtgcccacatcccggaccacatggagcattcatgcccaccatcagtggatgaccacggaggacatgctctctgtctggaatagagtgtggatcgaagagaacccgtggatggaagataagacccacatctccagctggggcgacgttccttacctggggaaacgcgaggatcaatggtgcggatctcttattggcctgacagctcgggccacctgggcgacaaatatccaggtggctattaaccaggtcagacggctcatcgggaatgagaactacctggactatatgaccagcatgaagagattcaagaatgaatccgaccccgagggcgccctgtggtga

SEQ ID NO: 19046 - RNA, 9879 nt, synthetic construct
  misc_feature 1..9879: note = derived and/or modified CDS sequence (opt5) from DENV-1__GQ199802__SS-prME
  source 1..9879: mol_type = other RNA
agcgtgaccatgctgctcatgctgatgcccaccgcccttgctttccacctgacgaccagaggcggggaacctcatatgatcgtctccaagcaggaacgggggaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcaaaggggaggacggatgctggtatggcatggagattagaccggtgaaggaaaaggaggaaaatcttgttaaaagcatggtgtctgctgggtccggagaggtcgacagcttttccctcggcctgctgtgtatctctattatgatcgaagaggtgatgcggagcagatggtcccgccggatgctcatgacagggaccctggccgttttctttcttctgattatgggacagctcacatggaacgatctgatcagactgtgcattatggtgggcgccaatgcttctgaccgcatgggcatggggaccacctaccttgccctgatggcgacattcaagatgagacctatgtttgctgtcggactcctgttccggcgcctcacgagcagagaggtgctgcttctgaccatcggcctctccctggtggcctctgtcgaactgcccaacagccttgaggaactgggggatggactcgccatgggcatcatgattctgaaactcctgacagactttcaatcccatcagctttgggctaccctgctcagcctgacattcatcaagaccacgttttctctgcactatgcctggaaaacaatggctatggttctttccattgtgagcctgttccccctctgtctgtctaccacctcccagaagacaacctggctccctgtgctgcttgggagcctgggatgcaagccgctgacaatgtttctcatcgccgagaataaaatttggggccggcgctcttggcccctgaacgaaggcatcatggcggtcgggatcgtgtccattcttctgagctccctcctgaagaacgatgttcctctcgccggacccctgatcgctggcgggatgcttattgcctgttacgtgatcagcggatctagcgctgacctgtccctggagaaagccgccgaggtctcttgggaagaggaagctgagcatagcggcgcgtcccacaatattctcgtggaagttcaggatgacgggacgatgaagatcaaagatgaggagagagacgataccctgacaatccttctgaaggccaccctcctggctgtgtctggagtctatcctctcagcattcccgccacactgttcgtgtggtacttctggcagaagaagaagcagcggtccggcgtcctttgggacaccccttctcccccggaagtggagcgcgccgttctggatgacggcatctatagaattatgcagcgggggctgctcggacgcagccaggtgggcgtcggggtgtttcaagaaaacgttttccatacgatgtggcacgtgaccagaggagctgtcctgatgtaccagggcaaacggcttgagccttcctgggccagcgtgaagaaagacctgatctcttacgggggaggctggagactccagggctcctggaatacaggggaggaagtgcaggttattgcggtcgagcccggaaagaaccctaaaaatgtgcaaaccgctcccggcacatttaagaccccggaaggggaggtgggagccatcgccctggatttcaagcctggcacaagcgggtctcccattgtcaaccgcgaaggaaaaatcgtgggcctctatggcaatggggttgtgacgacctccggaacatacgtcagcgctatcgcccaggcgaaggcttcccaggagggccctctgcccgagattgaagacgaggtgtttcggaaaagaaaccttaccatcatggatctgcaccccgggtctggaaagacccgccggtatctgcctgccattgttagagaagccatcaaacgcaagctccggacactgattcttgctccgacgagagtggtcgccagcgagatggctgaagccctgaagggcatgcccatccgctaccaaaccacagcggtgaaatccgagcataccgggaaggagatcgttgacctcatgtgccacgccacattcaccatgcggctgctgagccctgtgagagtccccaattataacatgattatcatggatgaagctcattttacggacccttcttccattgccgctcggggctacatcagcacacgcgtgggaatgggcgaggccgccgctattttcatgaccgcgacaccccctgggtctgtggaagcctttccgcagagcaatgctgtcatccaggatgaggaaagagacatccccgagcggtcctggaactctggatatgagtggattacagatttccctggcaaaaccgtttggtttgtgcccagcatcaagtccgggaatgacattgccaactgtctccgcaaaaatggaaagagagtgatccagctttctcggaagacattcgataccgaataccagaaaacgaagaacaacgactgggactacgtcgtgacaaccgatattagcgagatgggcgccaatttcagagctgaccgcgttatcgatcctcggagatgcctgaaacccgtgattctgaaggacgggccggaacgcgtcatcctcgccggccctatgcccgtgacagttgcgtccgctgcccagcggagaggacgcatcggccggaaccacaataaagagggggatcagtatatttacatgggacagcccctgaacaatgacgaggatcatgcccactggaccgaagctaagatgcttctggacaacatcaatacgcctgagggcattatccccgccctctttgaacctgagagagaaaagagcgcggccattgatggggagtatcgcctgagaggagaggctcggaaaaccttcgtggaactgatgcgcagaggcgacctcccggtctggctttcttacaaggtggcctccgaggggtttcaatatagcgatcggcgctggtgcttcgacggcgaaagaaacaatcaggtcctggaggaaaacatggatgtggagatctggacaaaagagggagaacggaagaaactgagaccccgctggctcgacgctcggacctactccgaccctctggcccttagagagtttaaggagttcgctgccggccgccggtctgttagcggggatctgatcctcgagattggaaaactgccccagcacctgacacagagagcgcaaaatgccctcgacaaccttgtgatgctgcataattccgaacagggcgggcgggcttatcgccacgccatggaggagctgcctgataccatcgaaacactcatgctgcttgctctgattgccgtgctcaccggaggcgtcacgctgtttttcctgtctggcagagggctcggaaagacaagcatcggccttctgtgtgttatggcctccagcgtgctgctctggatggcttctgtggagccccattggattgcggcctccatcatcctggaatttttccttatggtcctgctcattccggagcctgaccggcagcgcacaccccaggataaccaactggcttacgtggttatcgggctgctctttatgattcttaccgtggccgccaatgagatgggactgctggaaacaaccaagaaagacctcggcatcgggcacgtcgctgtggagaaccaccatcacgccgcgatgctggatgtcgaccttcatcctgccagcgcttggacactgtacgccgtggctacgaccattatcacacccatgatgagacacaccattgaaaacacaaccgccaatatctctctcacggcgatcgccaaccaggctgccattctgatgggactggataagggctggcctatctccaaaatggacattggcgttcccctccttgctctggggtgctatagccaggtgaatccgctgaccctcacagccgctgtcctgatgcttgtggcccattacgcgatcattggacctggcctgcaagccaaggctacccgggaggcccagaaacgcacagctgccgggatcatgaagaaccccaccgttgatggaatcgtggccattgacctcgatcccgtcgtgtatgacgcgaagttcgaaaaacagctgggccagatcatgctgctcattctttgtacgtctcaaatcctgctgatgagaacaacctgggctctctgcgagagcattacactggccaccgggcctcttaccacactgtgggagggatccccgggcaagttttggaatacgaccatcgctgtgtctatggccaacatcttccggggcagctacctcgccggggctggactggccttctccctgatgaaaagcctcggcgggggacgcagaggcacaggggcgcagggagaaacccttggcgagaagtggaaacggcagctgaatcagctgtccaagtctgaatttaacacatataagagaagcggcattatggaggttgaccgctccgaagccaaagaggggctcaagcggggagagaccacgaaacacgctgtctctagaggcacagccaagctgcgctggttcgtggaacggaatcttgtgaaacccgaggggaaggtcatcgatctgggatgtggcagagggggatggagctactattgcgctggcctcaagaaagttaccgaagtgaagggctacaccaaagggggacctggccacgaggaacccattcctatggccacatacgggtggaacctggtgaagctgcattccggaaaagacgtctttttcattccccctgagaagtgtgataccctcctttgcgacattggcgagtctagcccgaatcccacaatcgaagaggggcgcacgctgcgggtgctgaaaatggttgaaccttggctcagaggaaaccaattttgtattaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacatcgtgagcgcggtcaatatgacatctcgcatgctgctgaaccggttcaccatggcccacagaaaaccgacgtatgagcgcgatgtggacctcggcgctgggaccagacacgtggccgtcgaacctgaggttgctaacctggatattatcggacagcggattgaaaatatcaagcatgagcacaaatccacatggcattacgacgaggataacccctataagacctgggcctaccacggcagctatgaagtgaaaccctctgggtccgctagctccatggtgaatggagtcgtgaaacttctgacaaagccttgggacgttattcccatggtgacccaaatcgccatgacagataccacgccttttggccagcagcgcgtcttcaaagagaaggtggacacaagaaccccgaaagcgaagcggggcaccgcccaaatcatggaagttacagctaaatggctctgggtgtttctgagcagaaacaagaagccccggatttgtacgcgcgaggagttcaccagaaaagtccggtctaatgccgctatcggggccgtgtttgttgacgagaaccagtggaatagcgccaaggaggcggtggaagatgagcgcttctgggaccttgtccatagagaacgggagctgcacaaacagggaaagtgcgctacatgcgtgtacaacatgatgggcaaacgcgaaaagaagctcggggagtttggaaaagccaagggctccagagccatttggtacatgtggctgggggctcggttcctggagttcgaagccctcggctttatgaatgaggatcactggttctctcgcgaaaacagcctgtccggagtcgagggcgaggggcttcataaactgggatatatcctcagagacatttctaagatccctggcgggaatatgtacgctgatgacaccgccggatgggatacacggatcaccgaagacgatctgcagaacgaggcgcgcattacagacatcatggaacccgagcacgcccttctggctaaaagcatttttaagctcacctatcaaaataaagtggttagagtgcagcggcctgccaagaacggcacggtcatggatgtgatctcccgcagagaccagcgggggtctggccaggtgggaacctacggcctgaatacattcaccaacatggaagctcaactgattagacagatggagagcgaggggatcttttcccccagcgaactcgagacaccgaacctggccgaacgcgttcttgattggctggagaagtatggagtggaacggctcaaaagaatggcgatctctggcgacgactgtgtcgtgaagcctattgatgaccgcttcgccaccgctctgacggcccttaatgatatggggaaagttcggaaggacatcccccagtgggagccttccaaaggatggaacgattggcagcaagtgcccttttgcagccatcacttccaccagctgattatgaaggacggcagagagatcgtcgtgccttgtcgcaatcaggatgaactcgtcgggcgggctagagtgtctcagggcgccggatggtccctgcgcgagacagcttgcctgggcaagagctacgcccaaatgtggcagctcatgtattttcatcggagagacctgcgccttgcggccaacgctatttgttccgccgttcccgtggattggatcccgacctctcggacaacctggagcattcacgcccatcaccagtggatgacgaccgaagacatgctgtccgtctggaatagagtgtggatcgaggaaaacccttggatggaggataaaacacatatcagctcttggggagacgttccctacctcggaaagcgggaggaccaatggtgcggctccctgattgggcttaccgctagagccacatgggcgaccaatatccaggtggctattaaccaggtccgccggctgatcggaaatgaaaactacctcgattatatgacaagcatgaaaagattcaagaatgagtctgaccccgaaggcgccctgtggtga

SEQ ID NO: 19047 - RNA, 9879 nt, synthetic construct
  misc_feature 1..9879: note = derived and/or modified CDS sequence (opt5) from DENV-1__JF937597__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggctatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagctcacagtggttgtgggagatgtcgccggcattctggggcagggcaagaagatgatccggccgcaacccatggagtacaaatattcttggaaaagctggggcaaggccaagattatcggggctgacgcgcagaataccaccttcatcattgatggacctaacacacccgaatgtcctgacgatcagagagcctggaatatctgggaggtggaggactacggctttggcattttcaccacgaacatctggctgaaacttcgcgattcctatacacaggtgtgcgaccaccggctcatgagcgctgccattaaagattctaaggccgtccacgctgacatggggtactggatcgaatccgagaaaaatgaaacctggaagctggccagagcgagctttatcgaggttaagacatgtatttggcccaaatctcataccctgtggtccaacggagtgctcgaaagcgagatgatcattccgaagatctatggcgggcctatttctcaacacaattaccgccccggatacttcacacagaccgctggcccttggcatctggggaaacttgagctggatttcgacctctgcgaaggaacgaccgtggtcgtggatgagcactgcggcaaccggggccccagcctgagaacaaccacagttaccgggaagatcatccacgaatggtgttgccggtcctgtacgctgcctccccttcgctttagaggagaggacggctgctggtatgggatggagattcggccggtgaaagaaaaggaggaaaatctcgtcaagagcatggtgtctgccggatccggcgaggttgacagcttctccctggggctgctctgtatctctattatgatcgaagaggtgatgagaagccgctggtcccggaaaatgctgatgacaggaacccttgccgtctttttcctgctcattatgggccagctgacatggaacgatctgatcagactttgcattatggtgggcgctaatgcctctgaccgcatggggatgggaaccacctacctggcgctcatggctacatttaagatgagacctatgttcgccgttggcctgctctttcggcgcctgacgagcagagaggtgcttctgctcaccatcgggctgtccctggtcgcctctgtggaacttcccaacagcctggaggaactcggagatggcctggctatggggatcatgattctcaaactgcttacagacttccaatcccatcagctgtgggccaccctcctgagcctgacatttatcaagaccacgttctctcttcactatgcttggaaaacaatggccatggtgctgtccattgtcagcctctttcccctgtgtctctctaccacctcccagaagacaacctggctgcctgttcttctgggaagcctgggctgcaagccgctcacaatgttcctgatcgcggagaataaaatttggggccggaagtcttggccccttaacgaagggatcatggccgtgggaatcgtgtccattctgctcagctccctgctcaaaaacgatgtccctctggctggcccccttatcgccgggggaatgctgattgcttgttacgtgatcagcggctctagcgccgacctgtccctcgagaaggccgctgaggtttcttgggaagaggaagcggagcatagcggggcctcccacaatattctggtggaagtccaggatgacggaacgatgaaaatcaaggatgaggagcgcgacgatacccttacaatcctgctcaaagctaccctgctcgccgtgtctggcgtttatcctctgagcattcccgccacactttttgtgtggtacttctggcaaaagaagaaacagagatccggcgtcctgtgggacaccccttctcccccggaagtggagcgggctgtcctggatgacgggatctatcgcattatgcagagaggactcctgggccggagccaggtgggggttggagtgttccaagaaaacgtctttcatacgatgtggcacgtgacccgcggcgccgttcttatgtaccaggggaagagactggagccttcctgggcgagcgtgaaaaaggacctcatctcttacggaggcggctggcggctgagagggtcctggaatacaggagaggaagtccaggtgattgctgtggagcccggcaaaaaccctaagaatgttcagaccgcccccgggacattcaagaccccggaaggagaggtcggcgccatcgctctcgattttaaacctgggacaagcggatctcccattgtgaaccgcgaaggcaagatcgtgggcctgtatgggaatggagtcgtgacgacctccggcacatacgttagcgccatcgcgcaagctaaagcctcccaggaggggcctcttcccgagattgaagacgaggtgttccggaagagaaacctgaccatcatggatctgcaccccggatctggcaaaacccgccggtatctccctgccattgtcagagaagctatcaagcgcaagctgcggacacttattctggccccgacgagagtggttgctagcgagatggccgaagcgctcaaagggatgcccatccgctaccagaccacagccgtgaagtccgagcataccggcaaagagatcgtcgacctgatgtgccacgctacatttaccatgcggctgctcagccctgtgagagttcccaattataacatgattatcatggatgaagcccatttcacggacccttcttccattgctgcccggggatacatcagcacacgcgtgggcatgggggaggccgctgcgatttttatgaccgccacaccccctggatctgtcgaggctttcccgcaaagcaatgccgtgatccaggatgaggaaagagacatccccgagcggtcctggaactctggctatgagtggattacagattttcctgggaagaccgtgtggttcgtccccagcatcaaatccggaaatgacattgccaactgtcttcgcaagaatggcaagagagttatccagctgtctcggaaaacatttgataccgaataccagaagacgaaaaacaacgactgggactacgtggtgacaaccgatattagcgagatgggggctaatttcagagccgaccgcgtcatcgatcctcggagatgcctgaagcccgtgattctcaaagacggcccggaacgcgttatcctggcgggacctatgcccgtgacagtcgcttccgccgcccaacggagaggccgcatcgggcggaaccacaataaggagggagatcagtatatttacatgggccagccccttaacaatgacgaggatcatgctcactggaccgaagccaagatgctgctcgacaacatcaatacgcctgaggggattatccccgcgctgttcgaacctgagagagaaaagagcgccgctgtggatggagagtatcgcctgagaggcgaggcccggaagacctttgttgagctcatgcgcagaggggaccttccggtgtggctgtcttacaaagtcgcttccgagggcttccagtatagcgatcggcgctggtgctttgacggagaaagaaacaatcaagtgctggaggaaaacatggatgtcgagatttggacaaaggagggcgaacggaaaaagctcagaccccgctggctggacgcccggacctactccgaccctcttgctctgagagagttcaaagaatttgccgcggggcgccggtctgtgagcggagatctcatcctggagatcggcaagctgccccagcacctcacacagagagcccagaatgctcttgacaacctggttatgctgcataattccgaacaagggggacgggcctatcgccacgctatggaggagctccctgataccattgaaacactgatgcttctggccctcatcgccgtgctgaccggcggcgtgacgctgttctttctctctgggagaggacttggcaagacaagcattgggctgctgtgtgtcatggcttccagcgttctcctgtggatggcgtctgtggagccccattggatcgccgcttccattatccttgagttctttctgatggtgctcctgatcccggagcctgaccggcagcgcacaccccaggataaccagctggcctacgtcgtgattggactccttttcatgatcctgaccgttgccgctaatgagatgggcctgctcgaaacaaccaaaaaggacctggggattggacacgtggccgtcgagaaccaccatcacgcggccatgcttgatgtggacctgcatcctgctagcgcctggacactctacgctgtcgccacgaccatcattacacccatgatgagacacaccatcgaaaacacaaccgcgaatatttctctgacggccatcgctaaccaagccgctatcctgatgggcctcgataaaggctggcctatttccaagatggacatcggggtgccccttctggccctgggatgctatagccaggttaatccgctcaccctgacagctgccgtgcttatgctggtcgcgcattacgccattatcggccctgggctccaggctaaagccacccgggaggctcaaaagcgcacagccgccggaattatgaagaaccccaccgtggatggcatcgttgcgatcgacctggatcccgtggtctatgacgctaaatttgaaaagcagctggggcagattatgctccttatcctgtgtacgtctcagattctgctcatgagaacaacctgggccctgtgcgagagcatcacacttgctaccggacctctgaccacactctgggagggctccccgggcaaattctggaatacgaccattgccgtgtctatggccaacatctttcgggggagctacctggctggagccggcctggcgttctccctcatgaaaagccttgggggaggccgcagagggacaggagcccaaggcgaaaccctgggcgagaaatggaagcggcagctgaatcagctctccaagtctgagttcaacacatataaaagaagcgggatcatggaggtggaccgctccgaagctaaggagggactgaaacggggcgagaccacgaagcacgccgtttctagagggacagctaaacttcgctggtttgtcgaacggaatctggtgaagcccgagggaaaggtgattgatctcggctgtgggagaggaggctggagctactattgcgccggcctgaaaaaggtcaccgaagttaaagggtacaccaagggaggccctgggcacgaggaacccatccctatggcgacatacggatggaacctggtgaaactccattccggcaaggacgtgttctttattccccctgagaaatgtgatacccttctgtgcgacatcggggagtctagcccgaatcccacaattgaagagggacgcacgctgcgggtcctcaagatggtggaaccttggctgagaggcaaccagttctgtatcaagattcttaatccctatatgccttccgttgtggagaccctggagcaaatgcagcgcaaacacggcgggatgctcgtccggaaccccctgagcagaaattctacacatgaaatgtactgggtgtcctgcggaaccggcaacatcgttagcgccgtgaatatgacatctcgcatgctgctcaaccggtttaccatggctcacagaaagccgacgtatgagcgcgatgtcgacctggggaccggaacaagacacgtggccgtggaacctgaggtcgctaaccttgatatcattggccagcggatcgaaaatattaaacatgagcacaagtccacctggcattacgacgaggataacccctataaaacatgggcctaccacgggagctatgaagttaagccctctggatccgctagctccatggtgaatggcgtggtcaagctgctcaccaaaccttgggacgtgatccccatggttacacagattgccatgaccgatacgacacctttcggccaacagcgcgtgtttaaggagaaagtcgacaccagaaccccgaaggcgaaacgggggacagcccagatcatggaagtgacggctagatggctgtggggattccttagccggaacaagaagccccgcatctgtaccagagaggaatttacacggaaagttcgctctaatgccgctattggcgccgtgttcgtcgacgagaaccaatggaatagcgccaaggaggcggtggaagatgagagattttgggacctggttcatcgggaacgcgagctccacaaacaggggaagtgcgctacctgcgtgtacaacatgatgggaaaaagagaaaagaagctgggcgagttcgggaaagccaagggctcccgggccatctggtacatgtggctgggagctcgctttctcgagttcgaagccctgggcttcatgaatgaggatcactggttttctagagaaaacagcctttccggggtcgagggagagggcctgcataaactcgggtatattctgcgggacatctctaagattcctggaggcaatatgtacgctgatgacacagccgggtgggatacccgcatcacagaagacgatcttcagaacgaggcgaaaatcaccgacattatggaacccgagcacgccctgctcgctaaggccatcttcaaactgacgtatcagaataaggtggtcagagtgcaacggcctgctaagaacggcaccgttatggatgtgattagccgcagagaccagcggggatccggccaggtcgggacatacggactgaatacctttacaaacatggaagcccagctcatcagacaaatggagtctgagggcattttcagcccctccgaactggagaccccgaaccttgcggaacgcgccctgaattggctcgagaaatatggggtggaacggctgaagagaatggctatcagcggagatgactgtgtggttaaacctatcgacgatcgctttgccacggctcttacagccctgaacgacatgggcaaggtgcggaaagatattccccagtgggagccttctaaggggtggaatgactggcagcaggtccccttctgctcccatcactttcaccaactcatcatgaaggatggcagagagattgtggttccttgtcgcaaccaggacgaactggtgggacgggctagagtcagccagggcgccgggtggtctctgcgcgagaccgcgtgcctcggaaaatcctacgcccagatgtggcaactgatgtatttccatcggagagatcttcgcctggctgccaatgccatctgtagcgctgtgcccgtcgactgggtgccgacatcccggaccacgtggtctattcacgcccatcaccagtggatgaccacagaagatatgctcagcgtttggaacagagtgtggatcgaggaaaatccttggatggaggacaagacccatatttccagctgggaggatgtcccctacctgggcaaacgggaagaccagtggtgcgggtctcttatcggactgacagcgagagctacctgggccacaaacatccaagtggccattaatcaggttcgccggctcatcggcaacgagaattacctggactatatgacctccatgaagagatttaaaaacgaaagcgatcccgagggggctctgtggtga

SEQ ID NO: 19048 - RNA, 9879 nt, synthetic construct
  misc_feature 1..9879: note = derived and/or modified CDS sequence (opt5) from DENV-1__GQ868609__SS-prME
  source 1..9879: mol_type = other RNA
agcgtgaccatgctgctcatgctgatgcccacagcccttgctttccacctgacgaccagaggaggggaacctcatatgatcgtgacaaagcaggaacggggaaaatccctcctgtttaagacctctgccggcgttaacatgtgcacacttattgcgatggacctgggggaactctgtgaagataccatgacatacaaatgccccagaatcaccgaagctgaacccgacgatgtggactgttggtgcaatgccacggatacctgggtgacatatggaacctgtagccaaacaggcgaacacagacgggacaagcgctccgtggccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgcgcctgcgggattcctacacacaggtgtgcgaccacagacttatgagcgcggccatcaaggattctaaagctgtgcatgccgacatgggctattggattgaatccgagaagaatgaaacctggaaactcgcccgcgctagcttcatcgaggtcaagacatgtatctggcccaagtctcacaccctgtggtccaacggggtgctggaaagcgagatgattatcccgaaaatttacggaggccctatctctcaacataattatcggcccgggtacttcacacagaccgccggaccttggcacctcggcaagctggagcttgattttgacctgtgcgaagggacgaccgttgtggtcgatgagcactgcggaaacagaggccccagcctccggacaaccacagtgaccggcaaaattatccatgaatggtgttgccgctcctgtacgctgcctcccctgagattcaagggggaggacggatgctggtacggcatggagatccggccggttaaagaaaaggaggaaaatcttgtcaagagcatggtctctgcggggtccggagaggtggacagcttttccctcggcctgctgtgtatttctatcatgattgaagaggttatgagaagccgctggtcccggaaaatgctcatgacagggaccctggctgtgttccttctgctcatcatgggacagctgacatggaacgatctgattagactttgcatcatggtcggcgccaatgcctctgaccgcatgggcatggggaccacctatctggctctcatggccacatttaagatgagacctatgttcgcggtgggactgctctttcggcgcctgacgagcagagaggtgcttctgctcaccattggcctgtccctggtcgcttctgttgaacttcccaacagcctggaggaactcggggatggactggccatgggcatcatgatcctcaaactgcttacagacttccaatcccaccagctgtgggccaccctcctgagcctgacatttattaagaccacgctttctctgcattacgcttggaaaacaatggccatggtgctctccatcgtgagcctgttccccctctgtctgtctaccacctcccagaagacaacctggcttcctgtcctgctggggagcctcggatgcaagccgctgacaatgtttcttattacggagaataaaatctggggccggaagtcttggcccctgaacgaaggcattatggctgtgggggttgtgtccatcctcctgagctccctcctgaaaaacgatgtccctcttgccggacccctgatcgcgggcgggatgctgattgcctgttatgtgatcagcggatctagcgctgacctctccctggagaaggccgctgaggtttcttgggaagaggaagccgagcacagcggcgcctcccataatattcttgtggaagtccaggatgacgggaccatgaaaatcaaggatgaggagcgcgacgatacactgaccattctcctgaaagctacactcctggcggtgtctggagtctaccctcttagcatccccgccaccctgttcgtgtggtatttttggcaaaagaagaaacagagatccggcgttctgtgggacacgccttctcccccggaagtggagcgggctgtcctcgatgacggcatctaccgcattatgcagagagggctgcttggacggagccaggtgggcgttggggtgttccaagaaaacgtcttccacaccatgtggcacgtgacacgcggagccgtgctgatgtatcagggcaagagactcgagccttcctgggccagcgttaaaaaggacctgatctcttacgggggaggctggcggctccagggctcctggaataccggggaggaagtccaggtgattgctgtggagcccggcaagaaccctaagaatgtccaaacagcccccggcacctttaagacaccggaaggggaggtgggagcgatcgctctggatttcaaacctggcacgagcgggtctcccattgttaacagagaaggaaagatcgtgggcctttacggcaatggggtcgtgaccacatccggaacctatgttagcgccattgcccaggctaaagcctcccaggagggccctctgcccgagatcgaagacgaggtgtttcgcaagcggaacctgaccatcatggatctccatcccgggtctggaaaaacaagacgctacctgcctgcgattgtccgggaagctatcaagagaaaacttcgcacgctgattctcgccccgacccgggtggttgccagcgagatggctgaagccctgaaaggcatgcccatcagatatcaaacaaccgctgtgaagtccgagcacacagggaaagagattgtcgacctgatgtgccatgccaccttcacgatgcgcctccttagccctgtgcgggtgcccaattacaacatgatcatcatggatgaagcgcactttacagacccttcttccattgccgctagaggctatatcagcacccgggtcggaatgggcgaggccgctgccattttcatgaccgccacaccccctgggtctgttgaggcttttccgcagagcaatgcggtgatccaggatgaggaacgcgacattcccgagagatcctggaactctggatacgagtggatcaccgatttccctggcaagacagtgtggtttgtccccagcatcaaatccgggaatgacattgccaactgtctgcggaagaatggaaagcgcgtgatccagctgtctagaaaaaccttcgatacggaatatcaaaagaccaagaacaacgactgggactacgttgtgaccacagatattagcgagatgggcgctaattttcgggccgacagagtcatcgatcctcgccggtgcctcaagcccgtgattctgaaagacgggccggaaagagttatccttgccggccctatgcccgtgaccgtcgcttccgccgcgcagcgccggggaagaattggccgcaaccataataaggagggggatcagtacatctatatgggacagcccctgaacaatgacgaggatcacgctcactggacggaagccaagatgctcctggacaacatcaatacccctgagggcattatccccgccctgttcgaacctgagcgggaaaagagcgctgccattgatggggagtacagactccgcggagaggcgagaaagacattcgtggagcttatgcggcgcggcgacctgccggtctggctgtcttataaagtggcctccgaggggtttcaatacagcgatagacggtggtgcttcgacggcgaacgcaacaatcaggttctcgaggaaaacatggatgtggagatctggaccaaggagggagaacgcaaaaagctgcggcccagatggcttgacgctcgcacatattccgaccctctggccctccgggagtttaaagagttcgctgccggcagacgctctgtgagcggggatctgattctggagatcggaaagctcccccagcatcttacccagcgggctcaaaatgccctggacaacctggtcatgctccacaattccgaacagggcgggagagcgtaccggcatgccatggaggagctgcctgatacaatcgaaacccttatgctgctcgctctgattgccgttctgacgggaggcgtgacactctttttcctttctggccgcgggctgggaaagaccagcatcggcctgctctgtgtgatggcttccagcgtcctgctttggatggcctctgtggagccccactggattgccgcttccatcattctggaatttttcctcatggttctgctgatcccggagcctgacagacagcggacaccccaggataaccaactcgcgtatgtggtcatcgggcttctgtttatgattctgacagtggccgctaatgagatgggactcctggaaaccaccaaaaaggaccttggcatcgggcacgtcgccgtggagaaccatcaccatgccacgatgctggatgttgacctccaccctgctagcgcctggaccctgtacgcggtggccacaaccattatcacacccatgatgcgccataccattgaaaacacgaccgctaatatctctctgacagccattgctaaccaggccgcgatcctcatgggacttgataaaggctggcctatctccaagatggacattggcgtccccctgctggccctcgggtgctacagccaggtgaatccgctgacccttacagctgccgttctgatgctcgtggctcactatgccatcattggacctggcctgcaagctaaagccaccagagaggcgcagaagcggacggccgctgggatcatgaagaaccccacagtcgatggaattgtggccatcgacctggatcccgtggtttacgacgctaaattcgaaaagcagctcggccagatcatgcttctgattctgtgtacctctcaaatcctcctgatgcgcacaacctgggccctttgcgagagcattaccctggccacagggcctctcacgaccctgtgggagggatccccgggcaaattttggaatacaaccatcgcggtctctatggctaacattttcagaggcagctatctggccggggctggactcgccttttcccttatgaaaagcctgggcgggggacggcgcggcacaggggcccagggagaaaccctgggcgagaaatggaagagacagctcaatcagctgtccaagtctgagttcaacatctacaaacggagcggcatcatggaggtggacagatccgaagctaaggaggggcttaaacgcggagagacgacacggcacgccgtgtctagaggcaccgcgaagctgcgctggttcgtcgaacggaatctcgttaaacccgaggggaaggtgattgatctgggatgtggcagagggggatggagctattactgcgccggcctgaagaaagtgaccgaagtcaagggctatacaaaagggggacctggccatgaggaacccatccctatggctacctacgggtggaacctcgtgaaacttcactccggaaaagacgtctttttcacaccccctgagaagtgtgatacgctgctgtgcgacattggcgagtctagcccgaatcccaccatcgaagaggggcgcacactccgggtgctgaaaatggtcgaaccttggcttagaggaaaccaattttgtattaagatcctgaatccctacatgccttccgtggttgagaccctcgagcagatgcagcgcaagcatggcggcatgctggtgcggaaccccctgagcagaaattctacacacgaaatgtattgggtctcctgcgggaccggaaacattgtgagcgccgtgaatatgacgtctcgcatgctcctgaaccggttcaccatggctcacagaaaaccgacatacgagaaggatgtcgaccttggcgccgggacccgccatgttgcggtggaacctgaggtggccaacctggatatcatcggacagagaattgaaaatatcaaacacgagcataagtccacatggcactatgacgaggataacccctacaaaacctgggcttatcatggcagctacgaagtcaagccctctgggtccgccagctccatggtgaatggagttgtgaagctcctgacaaaaccttgggacgtcattcccatggtgacccaaatcgctatgacggatacaaccccttttggccagcagcgggttttcaaggagaaagtggacacccgcacaccgaaggccaaaagaggcacggctcaaattatggaagtcaccgcccggtggctttgggggtttctgagcagaaacaagaagccccggatctgtacacgcgaggagttcaccagaaaagtgcggtctaatgcggccatcggagctgtttttgtggacgagaaccagtggaatagcgccaaggaggctgtcgaagatgagcgcttctgggacctcgtgcagaaagaaagagagctgcacaagcagggcaaatgcgccacatgcgtctataacatgatggggaagcgggaaaagaaactgggagagtttggcaaggccaaagggtcccgcgcgatttggtacatgtggctcggcgctagattcctggagtttgaagcccttggattcatgaatgaggatcactggttctctcgggaaaacagcctgtccggcgtggagggggagggactccataagctgggctacatccttcgcgacatttctaaaatccctgggggaaatatgtatgccgatgacaccgctggctgggatacaagaattaccgaagacgatctgcaaaacgaggccaagatcacggacatcatggaacccgagcacgctctcctggccaccagcatttttaaactgacataccagaataaggttgtgcgggtccagcgccctgcgaagaacgggaccgtgatggatgtgatctccagacgggaccagcgcggctctggacaagttggcacatatgggctcaataccttcacgaacatggaagcccagctgattagacagatggagagcgagggaatctttcttccctccgaactggagacaccgaacctcgctgaacgggtgctggattggcttgagaaatacggcgtcgaaagactgaagcgcatggccattagcggggacgactgtgtggttaaacctatcgatgaccggttcgctaccgccctcacagcgctgaatgatatgggaaaggtgagaaaagacatcccccagtgggagccttctaagggctggaacgattggcaacaggtccccttttgctcccatcacttccaccagctgattatgaaggacgggcgcgagatcgtggtcccttgtcggaatcaggatgaactcgtgggcagagcccgcgttagccaaggagctggctggtctctgcgggagaccgcctgccttgggaaatcctatgctcagatgtggcagctgatgtactttcatagacgcgacctccggctggccgctaacgccatttgtagcgcggtgcccgtcgattgggtgccgacgtccagaaccacatggtctatccacgcccatcaccaatggatgaccacagaagacatgcttagcgtttggaatcgcgtgtggattgaggaaaacccttggatggaggataagacccatgtctccagctggggagacgtgccctatctgggcaaacgggaggaccagtggtgcgggtctctcatcggactgacagctagagccacctgggcctccaatattcaggtggctatcaaccaggttcggagactgatcggcaatgaaaactacctcgattacatgacgagcatgaagcgcttcaaaaatgagggggaccccgaaggcgccctgtggtga

SEQ ID NO: 19049 - RNA, 9879 nt, synthetic construct
  misc_feature 1..9879: note = derived and/or modified CDS sequence (opt5) from DENV-1__GQ199803__SS-prME
  source 1..9879: mol_type = other RNA
agcgtgaccatgctgctcatgctgatgcccacagcccttgctttccacctgacgatcagaggaggggagcctcatatgattgtgtccaagcaggaacggggaaaatctctcctgtttaagaccagcgccggcgttaacatgtgcacacttatcgcgatggacctgggggagctctgtgaagataccatgacatacaaatgcccgcgcattaccgaggctgaacccgacgatgtggactgttggtgcaatgccacagatacctgggtgacgtatggaacctgttcccagacaggcgagcacagacgggacaagcgctctgtggccctggctcctcatgtggggctgggactcgagaccagaacagaaacctggatgagctccgagggcgcctggaaacagatccagcgggttgaaacgtgggctctgcgccaccccggcttcacagtgattgccctttttctggcgcatgccatcgggacctctatcacacagaagggaattatcttcattctcctgatgcttgtcacccctagcatggctatgagatgcgtgggcatcgggtcccgggattttgttgagggactgagcggcgccacctgggtggacgtcgtgctcgagcacgggtcttgtgtgacaacgatggctaaggataaacccaccctggacattgaactgctcaagacagaggtcaccaaccctgccgttctgcgcaaactttgcatcgaagcgaagatttccaatacaaccacggatagcagatgtccgacacaaggagaggccaccctggtggaggaacaggacgctaacttcgtgtgccggcgcacctttgtcgatagaggctggggcaatgggtgtggactcttcggcaaagggtctctgatcacatgcgccaagtttaagtgcgtgaccaaacttgagggaaagatcgttcagtacgaaaacctgaaatattccgtgattgtcacagtgcacacgggcgaccagcatcaagttgggaatgagagcaccgaacacggaacaaccgctacaatcacaccccaggcccctacgaccgagattcagctcacagactacggcgccctgaccctggattgttctccccggacaggcctcgacttcaacgaaatggtgctgcttaccatgaaggagaaatcctggctggtccataagcagtggtttctcgatctgcctcttccctggacgagcggggcttccacatctcaagagacctggaatcgccaggacctgctcgtgacattcaaaaccgcgcacgccaagaagcaggaagtcgtggttctgggaagccaagagggcgctatgcacaccgccctgacaggggccacggaaatccagacctccggaacaaccacaatttttgctggccatctcaaatgcagactgaagatggataaacttaccctgaaggggatgagctatgtgatgtgtacgggctctttcaaactcgagaaggaagtcgccgagacacagcacggaaccgtgctggttcagatcaagtacgagggcaccgacgcgccgtgcaaaatccctttctccacacaagatgaaaagggggtgacccagaacggacggctgattacagctaatcccatcgtcacggacaaagagaagcctgtgaacattgaagccgagccgccctttggcgagagctatatcgtgattggggccggagaaaaagctcttaagctctcttggttcaagaaaggcagctccatcgggaagatgtttgaggccaccgctagaggcgcccgccggatggcgatcctgggagatacagcctgggacttcggctctattgggggagtttttaccagcgtcggcaaactggtgcatcagatcttcgggacagcttacggagtgctcttttccggcgtcagctggaccatgaagattgggatcggcgtgctgcttacgtggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacaaatgaggtccacacctggacagaacaatataagtttcaggccgactcccctaaacggctgtctgcggccatcggcaaggcttgggaggagggggtgtgcggcatcagaagcgccacccgcctcgaaaacattatgtggaaacagatctccaacgagctgaatcatattcttctggaaaacgacatgaagctcacggttgtggtcggagatgtggctggcatcctggggcagggcaagaagatgattcggccgcaacccatggagtacaaatattcttggaaaagctggggcaaggccaagatcatcggggccgacgctcagaatacaaccttcattatcgatggacctaacacccccgaatgtcctgacgatcagagagcgtggaatatttgggaggtggaggactacggctttggcatcttcacaaccaacatttggctgaaacttcgcgattcctatacgcaggtctgcgaccaccggctcatgagcgccgctatcaaagattctaaggccgttcacgccgacatggggtactggatcgaatccgagaaaaatgaaacatggaagctggctagagccagctttattgaggtgaagacctgtatctggcccaaatctcatacactgtggtccaacggagtgctcgaaagcgagatgattatcccgaagatttatggcgggcctatctctcaacacaattaccgccccggatacttcacccagacagcgggcccttggcatctggggaaacttgagctggatttcgacctctgcgaaggaaccacggtcgtggttgatgagcactgcggcaaccggggccccagcctgagaaccacaaccgtgacagggaagatcattcacgaatggtgttgccggtcctgtaccctgcctccccttcgctttagaggagaggacggctgctggtatgggatggagatccggccggtcaaagaaaaggaggaaaatctcgtcaagagcatggtttctgctggatccggcgaggtggacagcttctccctggggctgctctgtatttctatcatgattgaagaggtcatgagaagccgctggtcccggaaaatgctgatgacgggaacacttgccgtgtttttcctgctcatcatgggccagctgacctggaacgatctgattagactttgcatcatggttggcgccaatgcttctgaccgcatggggatgggaacaacctacctggccctcatggcgacctttaagatgagacctatgttcgctgtgggcctgctctttcggcgcctgacaagcagagaggtccttctgctcacgatcgggctgtccctggtggcctctgtggaacttcccagctccctggaggaactcggagatggcctggccatggggattatgatcctcaaactgcttaccgacttccaaagccatcagctgtgggctacactcctgtctctgacctttattaagacagccttctcccttcactatgcttggaaaaccatggccatggtcctgagcatcgtttctctctttcccctgtgtctctccacgacaagccagaagaccacctggctgcctgtgcttctgggatctctgggctgcaagccgctcacaatgttcctgattgcggagaacaaaatctggggccggaagtcctggccccttaatgaagggatcatggccgtgggaattgtcagcatcctgctctccagcctgctcaaaaacgatgtgcctctggctggcccccttattgccgggggaatgctgatcgcttgttacgttatttctggcagctccgccgacctgtctctcgagaaggccgctgaggtgagctgggaagaggaagcggagcattccggggcctctcacaacatcctggtcgaagtgcaggatgacggaaccatgaaaatcaaggatgaggagcgcgacgatacacttacgattctgctcaaagctaccctgctcgccgttagcggcgtgtatcctctgtccatccccgccacactttttgtctggtacttctggcaaaagaagaaacagagatctggcgtgctgtgggacacccctagccctcccgaagtcgagcgggctgtgctggatgacgggatttatcgcatcatgcagagaggactcctgggccggtcccaggttggggtgggagtcttccaagaaaatgtgtttcatacaatgtggcacgttacccgcggcgccgtgcttatgtaccaggggaagagactggagcccagctgggcgtctgtcaaaaaggacctcatttcctacggaggcggctggcggctgagagggagctggaacacgggagaggaagtccaggtgatcgctgttgagcccggcaaaaatcctaagaacgtccagaccgcccccgggacattcaagaccccggaaggagaggtgggcgccattgctctcgattttaaacctgggacatctggatcccccatcgtgaatcgcgaaggcaagatcgtcggcctgtatgggaacggagtggttaccacaagcggcacgtacgtgtccgccattgcgcaagctaaagcctctcaggaggggcctcttcccgagatcgaagacgaggtcttccggaagagaaatctgaccattatggatctgcaccccggaagcggcaaaacacgccggtatctccctgccatcgtgagagaagctattaagcgcaagctgcggacccttatcctggccccgaccagagttgtggcttccgagatggccgaagcgctcaaagggatgcccatccgctaccagacaacggccgtcaagagcgagcataccggcaaagagattgtggacctgatgtgccacgctacatttaccatgcggctgctctctcctgttagagtgcccaactataatatgatcattatggatgaagcccatttcacagacccttccagcatcgctgcccggggatacatttctacccgcgtcggcatgggggaggccgctgcgatctttatgacggccacaccccctggaagcgtggaggctttcccgcaatccaacgccgtgatccaggatgaggaaagagacattcccgagcggtcttggaatagcggctatgagtggatcaccgattttcctgggaagaccgtctggttcgttccctccattaaatctggaaacgacatcgccaattgtcttcgcaagaacggcaagagagtgattcagctgagccggaaaacatttgataccgaataccagaagaccaaaaataacgactgggactacgtggtcaccacggatatctccgagatgggggctaacttcagagccgaccgcgtgattgatcctcggagatgcctgaagcccgttatcctcaaagacggcccggaacgcgtgatcctggcgggacctatgcccgtcacagtggctagcgccgcccaacggagaggccgcattgggcggaatcacaacaaggagggagatcagtatatctacatgggccagccccttaataacgacgaggatcatgctcactggaccgaagccaagatgctgctcgacaatattaacacacctgaggggatcattcccgcgctgttcgaacctgagagagaaaaatctgccgctgttgatggagagtatcgcctgagaggcgaggcccggaagacctttgtggaactcatgcgcagaggggaccttccggtctggctgtcctacaaagtggctagcgagggcttccagtattccgatcggcgctggtgctttgacggagaaagaaataaccaagtcctggaggaaaatatggatgtggagatctggacgaaggagggcgaccggaaaaagctcagaccccgctggctggacgcccggacctactctgatcctcttgctctgagagagttcaaagagtttgccgcggggcgccggagcgtttccggagacctcatcctggaaattggcaagctgccccagcacctcacacagagagcccagaacgctcttgataatctggtgatgctgcataactctgagcaagggggacgggcctatcgccacgctatggaagaactccctgacaccatcgagacactgatgcttctggccctcattgccgtgctgaccggcggcgtcacactgttctttctcagcgggagaggacttggcaagacctccatcgggctgctgtgtgttatggctagctctgtgctcctgtggatggcgtccgtggaaccccattggattgccgctagcatcatccttgagttctttctgatggtcctcctgattccggaacctgatcggcagcgcacgccccaggacaatcagctggcctacgtggttatcggactccttttcatgattctgacagtggccgctaacgagatgggcctgctcgagaccaccaaaaaggatctggggatcggacacgtcgccgtggaaaatcaccatcacgcggccatgcttgacgtcgatctgcatcctgcttctgcctggacactctacgctgtggccaccacaattatcacgcccatgatgagacacaccattgagaacacaaccgcgaacatctccctgacagccatcgctaatcaagccgctattctgatgggcctcgacaaaggctggcctatcagcaagatggatattggggttccccttctggccctgggatgctattctcaggtgaacccgctcaccctgacggctgccgtccttatgctggtggcgcattacgccatcattggccctgggctccaggctaaagccacccgggaagctcaaaagcgcacagccgccggaatcatgaagaatcccaccgttgacggcatcgtggcgattgatctggaccccgtcgtgtatgacgctaaatttgagaagcagctggggcagatcatgctccttattctgtgtacaagccagatcctgctcatgagaaccacgtgggccctgtgcgaatccattacacttgctaccggacctctgacaaccctctgggagggctctccgggcaaattctggaacaccacaatcgccgtgagcatggccaatatctttcgggggtcctacctggctggagccggcctggcgttcagcctcatgaagtcccttgggggaggccgcagagggacgggagcccaaggcgagaccctgggcgaaaaatggaagcggcagctgaaccagctctctaagagcgagttcaatacatataaaagatccgggattatggaagttgatcgctctgaggctaaggaaggactgaaacggggcgagaccacaaagcacgccgtcagcagagggaccgctaaacttcgctggtttgtggagcggaacctggtgaagcccgaaggaaaggtcatcgacctcggctgtgggagaggaggctggtcctactattgcgccggcctgaaaaaggttacggaggtgaaagggtacacaaagggaggccctgggcacgaagaacccattcctatggcgacctacggatggaatctggtgaaactccattctggcaaggatgtcttctttattccccctgaaaaatgtgacacccttctgtgcgatatcggggagagctccccgaaccccacaatcgaggaaggacgcaccctgcgggtgctcaagatggttgagccttggctgagaggcaatcagttctgtattaagatccttaacccctatatgcctagcgtggtcgaaacactggagcaaatgcagcgcaaacacggcgggatgctcgtgcggaatcccctgtctagaaactccacgcatgagatgtactgggttagctgcggaaccggcaatatcgtgtctgccgtcaacatgacatcccgcatgctgctcaatcggtttaccatggctcacagaaagccgacatatgaacgcgacgtggatctggggaccggaacgagacacgtggccgtcgagcctgaagttgctaaccttgacattatcggccagcggattgagaacatcaaacatgaacacaagagcacctggcattacgatgaggacaatccctataaaacatgggcctaccacgggtcttatgaggtgaagccctccggaagcgcttccagcatggtgaacggcgtcgtgaagctgctcaccaaaccttgggatgttattcccatggtgacacagatcgccatgaccgacacaacccctttcggccaacagcgcgtctttaaggaaaaagtggacacgagaacaccgaaggcgaaacgggggaccgcccagatcatggaggttaccgctagatggctgtggggattcctttctcggaataagaagccccgcatttgtacaagagaagagtttacgcggaaagtgcgcagcaacgccgctatcggcgccgtcttcgtggatgaaaatcaatggaactccgccaaggaggcggttgaggacgaaagattttgggatctggtgcatcgggagcgcgaactccacaaacaggggaagtgcgctacctgcgtctacaatatgatgggaaaaagagagaagaagctgggcgagttcgggaaagccaagggctctcgggccatttggtacatgtggctgggagctcgctttctcgagttcgaggccctgggcttcatgaacgaagaccactggtttagcagagaaaattccctttctggggtggaaggagagggcctgcataaactcgggtatatcctgcgggatattagcaagatccctggaggcaacatgtacgctgacgatacagccgggtgggacacccgcatcacagaggatgaccttcagaatgaagcgaaaattaccgatatcatggagcccgaacacgccctgctcgctaaggccattttcaaactgacatatcagaacaaggtcgtgagagttcaacggcctgctaagaatggcaccgtgatggacgtcatctcccgcagagatcagcggggatctggccaggtggggacgtacggactgaacacctttacaaatatggaggcccagctcattagacaaatggaaagcgagggcatcttctcccccagcgagctggaaaccccgaaccttgcggagcgcgccctggactggctcgaaaaatatggggtggagcggctgaagagaatggctatctctggagacgattgtgttgtgaaacctattgacgatcgctttgccacagctcttaccgccctgaacgacatgggcaaggtccggaaagatatcccccagtgggaaccttccaaggggtggaatgactggcaacaggtgcccttctgcagccatcactttcaccaactcattatgaaggatggcagagagatcgttgtgccttgtcgcaaccaggacgagctggtcggacgggctagagtgtctcagggcgccgggtggtccctgcgcgaaacggcgtgcctcggaaaaagctacgcccagatgtggcaactgatgtatttccatcggagagatcttcgcctggctgccaatgccatttgttccgctgtccccgtggactgggttccgacatctcggaccacatggagcatccacgcccatcaccagtggatgaccacggaggatatgctctccgtgtggaacagagtctggattgaagagaatccttggatggaagacaagacccatatcagctcttgggaggacgtgccctacctgggcaaacgggaggatcagtggtgcgggtcccttatcggactgacagcgagagctacctgggccacaaacattcaagttgccatcaatcaggtgcgccggctcattggcaacgaaaattacctggactatatgaccagcatgaagagatttaaaaacgagtctgatcccgaaggggctctgtggtga

SEQ ID NO: 19050 - RNA, 9879 nt, synthetic construct
  misc_feature 1..9879: note = derived and/or modified CDS sequence (opt5) from DENV-1__GQ199804__SS-prME
  source 1..9879: mol_type = other RNA
agcgtgaccatgctgctcatgctgatgcccacagcccttgctttccacctgacgaccagaggcggggagcctcatatgatcgtctccaagcaggaacgggggaaatctctcctgtttaagacaagcgccggcgttaacatgtgcacccttattgccatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagacgccacactggtggaggaacaggatgcgaacttcgtctgccggcgcacctttgtggacagaggctggggcaatgggtgtggactcttcggcaaagggtctctgattacatgcgccaagtttaagtgcgttacgaaacttgagggaaagatcgtgcagtacgagaacctgaaatattccgtcatcgtgaccgttcacacaggcgaccagcatcaagtggggaatgaaagcaccgagcacggaacaaccgctacgattacaccccaagcccctaccaccgaaatccagctcacagattacggcgctctgaccctggactgttctccccggacgggcctcgatttcaacgagatggtcctgcttacaatgaaggaaaaatcctggctggtgcataagcagtggtttctcgacctgcctcttccctggaccagcggggcctccacatctcaagagacctggaatcgccaggatctgctcgtcaccttcaaaacagcccacgctaagaagcaggaggtggttgtgctgggaagccaagaaggcgcgatgcacacggccctgaccggggctacagagattcagacctccggaacaaccacgatctttgccggccatctcaaatgcagactgaagatggacaaacttacactgaaggggatgagctatgtcatgtgtaccggctctttcaaactcgaaaaggaggtggccgaaacccagcacggaacagttctggtgcagattaagtacgagggcaccgatgctccgtgcaaaatccctttctccacacaagacgagaagggggtcacgcagaacggacggctgatcaccgccaatcccattgtgacagataaagaaaagcctgtgaacatcgaggcggaaccgccctttggcgagagctatattatcattggggctggagagaaagcccttaagctctcttggttcaagaaaggcagctccatcgggaagatgtttgaagccaccgctagaggcgcccgccggatggctatcctgggagacacagcctgggatttcggctctattgggggagtttttaccagcgtcggcaaactggtgcatcagatcttcgggacggcgtacggagtgctcttttccggcgtcagctggaccatgaagattgggatcggcgtgctgcttacatggctgggactcaattctagatccaccagcctgtctatgacatgtattgccgttggcctggtgaccctttacctcggggtcatggtgcaggctgactccggatgcgttatcaactggaaaggccgcgagctgaagtgtgggagcggaattttcgtgacaaatgaagtccacacctggacggagcaatataagtttcaggccgactcccctaaacggctgtctgctgccatcggcaaggcgtgggaagagggggtgtgcggcatcagaagcgccacacgcctcgagaacattatgtggaaacagatctccaacgaactgaatcatattcttctggagaacgatatgaagttcaccgttgtggtcggagacgtggctggcatcctcgcccaggggaaaaagatgattcggccgcaacccatggaatacaaatattcttggaaaagctggggaaaggctaaaatcatcggcgccgatgtgcagaataccacatttattatcgacgggcctaacacccccgagtgtcctgatgaccagagagcctggaatatttgggaagtcgaggattacggattcggcatctttacgacaaacatttggctgaagctgcgcgactcctatacccaggtttgcgatcaccggcttatgagcgctgcgatcaaagactctaaggccgtgcacgctgatatgggctactggatcgagtccgagaagaatgagacatggaagctcgccagagccagcttcattgaagtgaagacctgtatctggcccaaatctcatacactgtggtccaacggggtcctggagagcgaaatgattatcccgaagatttatggaggccctatctctcaacacaattaccgccccgggtacttcacccagacggctggaccttggcatctcggcaaactggagcttgactttgatctgtgcgaggggaccacagtggttgtggacgaacactgcggaaaccggggccccagcctcagaaccacaaccgtcacgggcaagatcattcacgagtggtgttgccggtcctgtacactgcctcccctgcgcttcagaggggaagacggatgctggtatggcatggagatccggccggtgaaagagaaggaagagaatcttgttaagagcatggtgtctgccgggtccggagaagtcgatagcttttccctcggcctgctgtgtatttctatcatgattgaggaagtgatgagaagccgctggtcccggaaaatgctcatgaccgggacactggcggttttctttcttctgatcatgggacagctcacctggaacgacctgattagactgtgcatcatggtgggcgctaatgcctctgatcgcatgggcatggggaccacataccttgccctgatggctacgttcaagatgagacctatgtttgccgtcggactcctgttccggcgcctcaccagcagagaggtgctgcttctgacaatcggcctctccctggtggcgtctgtcgagctgcccaacagccttgaagaactgggggacggactcgctatgggcattatgatcctgaaactcctgaccgattttcaatcccatcagctttgggccacactgctcagcctgaccttcattaagacgacattttctctgcactatgcctggaaaaccatggctatggttctttccatcgtgagcctgttccccctctgtctgtctaccacatcccagaagaccacatggctccctgtgctgcttgggagcctgggatgcaagccgctgacgatgtttctcattgccgaaaataaaatctggggccggcgctcttggcccctgaacgagggcatcatggctgtcgggattgtgtccatccttctgagctccctcctgaagaacgacgttcctctcgccggacccctgattgcgggcgggatgcttatcgcctgttacgtgattagcggatctagcgctgatctgtccctggaaaaagccgctgaggtctcttgggaggaagaggccgaacatagcggcgcctcccacaatatcctcgtggaggttcaggacgatgggaccatgaagatcaaagacgaagagagagatgacacactgaccattcttctgaaggctacactcctggcggtgtctggagtctatcctctcagcatccccgccaccctgttcgtgtggtacttctggcagaagaagaagcagcggtccggcgtcctttgggatacgccttctcccccggaggtggaacgcgctgttctggacgacggcatttatagaatcatgcagcgggggctgctcggacgcagccaggtgggcgtcggggtgtttcaagagaacgttttccataccatgtggcacgtgacaagaggagccgtcctgatgtaccagggcaaacggcttgaaccttcctgggccagcgtgaagaaagatctgatttcttacgggggaggctggagactccagggctcctggaataccggggaggaggtgcaggttatcgctgtcgaacccggaaagaaccctaaaaatgtgcaaacagcccccggcacctttaagacaccggagggggaagtgggagcgattgctctggacttcaagcctggcacgagcgggtctcccatcgtcaaccgcgagggaaaaatcgtgggcctctatggcaatggggttgtgaccacatccggaacctacgtcagcgccattgcccaggctaaggcctcccaggaaggccctctgcccgagatcgaggatgaagtgtttcggaaaagaaaccttaccattatggacctgcaccccgggtctggaaagacacgccggtatctgcctgcgatcgttagagaggctattaaacgcaagctccggacgctgatccttgccccgaccagagtggtcgccagcgaaatggctgaggccctgaagggcatgcccatccgctaccaaacaaccgctgtgaaatccgaacatacagggaaggagattgttgatctcatgtgccacgccaccttcacgatgcggctgctgagccctgtgagagtccccaattataacatgatcattatggacgaggcgcattttacagatccttcttccatcgccgctcggggctacattagcacccgcgtgggaatgggcgaagccgctgccatcttcatgaccgccacaccccctgggtctgtggaggcttttccgcagagcaatgcggtcatccaggacgaagagagagatattcccgaacggtcctggaactctggatatgagtggatcaccgacttccctggcaaaacagtttggtttgtgcccagcattaagtccgggaatgatatcgccaactgtctccgcaaaaatggaaagagagtgattcagctttctcggaagaccttcgacacggagtaccagaaaacaaagaacaacgactgggattacgtcgtgaccacagacatcagcgaaatgggcgctaatttcagagccgatcgcgttattgaccctcggagatgcctgaaacccgtgatcctgaaggatgggccggagcgcgtcatcctcgccggccctatgcccgtgaccgttgcttccgccgcgcagcggagaggacgcattggccggaaccacaataaagaaggggaccagtatatctacatgggacagcccctgaacaatgatgaggaccatgctcactggacggaggccaagatgcttctggataacattaatacccctgaaggcatcattcccgccctctttgagcctgaaagagaaaagagcgctgccatcgacggggaatatcgcctgagaggagaggcgcggaaaacattcgtggagctgatgcgcagaggcgatctcccggtctggctttcttacaaggtggcctccgaagggtttcaatatagcgaccggcgctggtgcttcgatggcgagagaaacaatcaggtcctggaagagaacatggacgtggaaatctggaccaaagagggagagcggaagaaactgagaccccgctggctcgacgctcggacatactccgatcctctggcccttagagaatttaaggagttcgctgccggccgccggtctgttagcggggacctgattctcgaaatcggaaaactgccccagcacctgacccagagagctcaaaatgccctcgataaccttgtgatgctgcataattccgagcagggcgggcgggcgtatcgccacgccatggaggaactgcctgacacaattgagaccctcatgctgcttgctctgatcgccgtgctcacgggaggcgtcacactgtttttcctgtctggcagagggctcggaaagaccagcattggccttctgtgtgttatggcttccagcgtgctgctctggatggcctctgtggaaccccattggatcgccgcttccatcattctggagtttttccttatggtcctgctcatcccggaacctgatcggcagcgcacaccccaagacaaccaactggcgtacgtggttattgggctgctctttatgatccttaccgtggccgctaatgagatgggactgctggagaccacaaagaaagatctcggcattgggcacgtcgccgtggaaaaccaccatcacgccgctatgctggacgtcgatcttcatcctgccagcgcgtggacgctgtacgccgtggctaccacaatcattacccccatgatgagacacacaatcgagaacaccacggccaatatctctctcaccgctattgccaaccaggcggccatcctgatgggactggacaagggctggcctatttccaaaatggatatcggcgttcccctccttgctctggggtgctatagccaggtgaatccgctgacactcaccgccgctgtcctgatgcttgtggcccattacgctattatcggacctggcctgcaagccaaggcgacacgggaagcccagaaacgcaccgctgccgggatcatgaagaaccccacggttgacggaattgtggctatcgatctcgaccccgtcgtgtatgacgccaagttcgagaaacagctgggccagattatgctgctcatcctttgtacatctcaaattctgctgatgagaaccacatgggccctctgcgaaagcatcaccctggcgaccgggcctcttacaacgctgtgggagggatccccgggcaagttttggaataccacaatcgctgtgtctatggccaacattttccggggcagctacctcgctggggccggactggccttctccctgatgaaaagcctcggcgggggacgcagaggcaccggggctcagggagagacacttggcgaaaagtggaaacggcagctgaatcagctgtccaagtctgagtttaacacctataagagaagcggcatcatggaagttgatcgctccgaggccaaagaagggctcaagcggggagagacgacaaaacacgcggtctctagaggcaccgccaagctgcgctggttcgtggagcggaatcttgtgaaacccgaagggaaggtcattgacctgggatgtggcagagggggatggagctactattgcgctggcctcaagaaagttaccgaggtgaagggctacacaaaagggggacctggccacgaggagcccatccctatggccacctacgggtggaacctggtgaagctgcattccggaaaagatgtctttttcattccccctgaaaagtgtgacacactcctttgcgatatcggcgagtctagcccgaatcccacgattgaggaagggcgcaccctgcgggtgctgaaaatggttgagccttggctcagaggaaaccaattttgtatcaagatcctgaatccctatatgccttccgtggtcgaaacacttgagcagatgcagcgcaagcacggcggcatgctggtgcggaaccccctcagcagaaattctacccatgagatgtactgggtttcctgcgggacaggaaacattgtgagcgctgtcaatatgacctctcgcatgctgctgaaccggttcacgatggcccacagaaaaccgacctatgaacgcgacgtggatctcggcgcggggacaagacacgtggccgtcgagcctgaagttgctaacctggacatcattggacagcggatcgagaatattaagcatgaacacaaatccacctggcattacgatgaggacaacccctataagacatgggcctaccacggcagctatgaggtgaaaccctctgggtccgctagctccatggtgaatggagtcgtgaaacttctgaccaagccttgggatgttatccccatggtgacacaaatcgccatgaccgacacgacaccttttggccagcagcgcgtcttcaaagaaaaggtggacaccagaaccccgaaagctaagcggggcacagcccaaattatggaggttacggcgaaatggctctgggggtttctgagcagaaacaagaagccccggatctgtacccgcgaagagttcacaagaaaagtgcggtctaatgccgctattggagccgtctttgtggatgaaaaccagtggaatagcgctaaggaggccgttgaggacgaacgcttctgggatcttgtgcatagagagcgggaactgcacaaacagggcaagtgcgcgacctgcgtctacaacatgatggggaaacgcgagaagaagctcggagaatttggcaaagcgaaggggtccagagctatctggtacatgtggctgggcgcccggttcctggagttcgaggccctcggatttatgaatgaagaccactggttctctcgcgagaacagcctgtccggcgtggaaggggagggacttcataaactgggctatattctcagagatatctctaagatccctgggggaaatatgtacgctgacgatacagccggctgggacacccggattacagaggatgacctgcagaacgaagctcgcatcaccgatattatggagcccgaacacgcccttctggcgaaaagcatctttaagctcacgtatcaaaataaagtcgtgagagttcagcggcctgccaagaacgggaccgtgatggacgtcatttcccgcagagatcagcggggctctggacaggtgggcacatacgggctgaataccttcacaaacatggaggctcaactgatcagacagatggaaagcgagggaatcttttcccccagcgagctcgaaaccccgaacctggccgagcgcgtgcttgactggctggaaaagtatggcgttgagcggctcaaaagaatggctatttctggggacgattgtgtggtcaagcctatcgacgatcgcttcgccacggcgctgacagcccttaatgacatgggaaaagtgcggaaggatattccccagtgggaaccttccaaaggctggaacgactggcagcaagttcccttttgcagccatcacttccaccagctgatcatgaaggatgggagagagattgtggtcccttgtcgcaatcaggacgagctcgtgggccgggctagagtctctcagggagccggctggtccctgcgcgaaaccgcttgcctgggaaagagctacgcccaaatgtggcagctcatgtattttcatcggagagatctgcgccttgctgccaacgcgatctgttccgccgtgcccgttgactggattccgacatctcggaccacgtggagcatccacgctcatcaccagtggatgaccacagaggatatgctgtccgtgtggaatagagtctggatcgaagagaacccttggatggaagacaaaacccatattagctcttggggagacgtgccctacctcggcaagcgggaggatcaatggtgcgggtccctgatcggacttacagccagagccacctgggctacaaatattcaggttgccatcaaccaggtgcgccggctgattggcaatgagaactacctcgactatatgaccagcatgaaaagattcaagaatgaatctgatcccgagggggcgctgtggtga

SEQ ID NO: 19051 - RNA, 9879 nt, synthetic construct
  misc_feature 1..9879: note = derived and/or modified CDS sequence (opt5) from DENV-1__GQ199805__SS-prME
  source 1..9879: mol_type = other RNA
agcgtgaccatgctgctgatgctgatgcccaccgcccttgctttccacctgacgacccggggcggggaacctcatatgatcgtcaccaagcaggaacggggaaagtcccttctgtttaagacctctgccggcgttaacatgtgcacccttattgccatggacctgggggaactctgtgaagataccatgacatacaagtgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgtcattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataagcccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccacccaagatgaaaagggggtgacacagaacggacggctgatcacggcgaatcccattgtcaccgacaaagagaagcctgtgaacatcgaagctgagccgccctttggcgagagctatattgtgatcggggccggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggctgggcgtgcttctgacctggctcggactcaattctagatccacaagcctgtctatgacctgtattgctgttggccttgtgacactctacctgggggtcatggtgcaggccgattccggatgcgttatcaactggaaaggccgcgaactgaagtgtgggagcggaattttcgtgaccaatgaggtccacacatggaccgaacaatataagtttcaggctgactcccctaaacggctctctgccgcgatcggcaaggcctgggaggagggggtgtgcggcattagaagcgctacgcgcctggaaaacatcatgtggaaacagatctccaacgagcttaatcatattctgctcgaaaacgacatgaagttcacagttgtggtcggagatgtggtgggcatcctggcccaggggaaaaagatgattcggccgcaacccatggagcacaaatactcttggaaaagctggggaaaggctaagatcattggcgccgacgtccagaataccacctttatcatcgatgggcctaacacacccgaatgtcctgacgatcagagagcctggaatatttgggaggttgaggactatggattcggcatctttaccacgaacatttggctgaaacttcgcgattcccacacacaggtgtgcgaccatcggctcatgagcgctgcgatcaaagattctaaggccgtgcacgctgacatgggctactggattgaatccgagaaaaatgaaacctggaagctggccagagccagcttcatcgaggtcaagacatgtatctggcccaaatctcataccctgtggtccaacggggtgctcgaaagcgagatgattatcccgaagatttatggaggccctatctctcaacacaattaccgccccgggtatttcacacagaccgctggaccttggcacctgggcaaacttgagctggattttgacctctgcgaagggacgaccgttgtggtcgatgagcattgcggaaaccggggccccagcctgagaacaaccacagtgaccggcaagattatccacgaatggtgttgccggtcctgtacgctgcctccccttcgcttcaaaggggaggacggatgctggtacggcatggagatcagaccggttaaggaaaaggaggaaaatctcgtgaaaagcatggtctctgccgggtccggagaggtggacagcttttccctgggcctgctctgtatttctatcatgattgaagaggttatgcggagcagatggtcccgcaagatgctgatgacagggacccttgcggtgttcctgctcctgatcatgggacagctgacatggaacgatcttacccggctgtgcattatggtcggcgctaatgcctctgacagaatgggcatggggaccacatacctcgccctgatggctacgtttaaaatgcgccctatgttcgccgtgggactcctgtttagacggcttaccagccgcgaggtgctgctcctgacaatcggcctgtcccttgtcgcgtctgttgaactgcccaacagcctcgaggaactgggggatggactcgctatgggcattatgatcctgaaacttctgaccgacttccaatcccatcagctctgggccacactgctgagccttacctttatcaaaacgacactgtctctccactatgcctggaagaccatggctatggtgctgtccattgtgagcctcttccccctgtgtctttctaccacatcccagaagaccacatggctgcctgtcctgctcgggagcctgggatgcaaaccgcttgccatgtttctgatcgctgagaataagatttggggcagaaaatcttggcccctcaacgaaggcatcatggccgtgggggttgtgtccattctgctcagctccctgcttaagaacgatgtccctctggcgggacccctgatcgccggcgggatgctcatcgcttgttacgtgattagcggatctagcgccgacctgtcccttgagaaagctgccgaggtttcttgggaagaggaagccgagcatagcggcgcttcccacaatatcctggtggaagtccaggatgacgggacgatgaagattaaagatgaggagcgggacgataccctcacaatcctgctcaaggcgaccctgcttgccgtgtctggagtctatcctctgagcattcccgctacactgttcgtgtggtacttttggcaaaagaaaaagcagcgctccggcgttctctgggacaccccttctcccccggaagtggagagagccgtcctggatgacggcatctatcggatcatgcagcgcgggcttctgggaagaagccaggtgggcgttggggtgttccaagaaaacgtcttccacacgatgtggcatgtgacccggggagccgtgctcatgtaccagggcaaacgcctggagccttcctgggctagcgttaagaaagacctcatttcttatgggggaggctggagactgcagggctcctggaatacaggggaggaagtccaggtgatcgccgtggagcccggaaagaaccctaagaatgtccaaaccgcgcccggcacatttaaaaccccggaaggggaggtgggagctattgcccttgatttcaagcctggcacaagcgggtctcccatcgttaaccgggaaggaaaaattgtgggcctgtacggcaatggggtcgtgacgacctccggaacatacgttagcgccatcgctcaggccaaggcgtcccaggagggccctctgcccgagattgaagacgaggtgtttagaaaacgcaacctcaccatcatggatctgcaccccgggtctggaaagacccggagatatcttcctgctatcgtccgcgaagccattaagcggaaactgagaacactcatcctggccccgacgcgcgtggttgctagcgagatggccgaagctctgaagggcatgcccattcggtaccaaaccacagccgtgaaatccgagcataccgggaaggagatcgtcgacctcatgtgccacgcgacattcaccatgagacttctgagccctgtgcgcgtgcccaattataacatgattatcatggatgaagcccattttacggacccttcttccatcgctgcccggggctacattagcacaagagtcggaatgggcgaggctgccgccatcttcatgaccgctacaccccctgggtctgttgaagcgtttccgcagagcaatgccgtgattcaggatgaggaacgggacatccccgagcgctcctggaactctggatatgagtggattacagatttccctggcaaaaccgtgtggtttgtccccagcatcaagtccgggaatgacatcgctaactgtctgagaaagaatggaaaacgggtgattcagctctctcgcaagacattcgataccgaataccagaagacgaagaacaacgactgggactatgttgtgacaaccgatatcagcgagatgggcgccaattttagagccgaccgggtcattgatcctagacgctgcctgaaacccgtgatccttaaggacgggccggaacgggttattctggctggccctatgcccgtgacagtcgcctccgcggctcagagacgcggacggatcggcagaaaccacaataaggagggggatcagtacatttacatgggacagcccctcaacaatgacgaggatcacgcccattggaccgaagccaaaatgctgctggacaacatcaatacgcctgagggcatcattcccgctctcttcgaacctgagcgcgaaaagagcgccgcgatcgatggggagtatcggcttagaggagaggcccgcaaaaccttcgtggaactgatgagacggggcgacctgccggtctggctctcttacaaggtggcttccgaggggtttcaatatagcgatcgcagatggtgcttcgacggcgaacggaacaatcaggttctggaggaaaacatggatgtggagatttggacaaaagagggagaacgcaagaaacttagaccccggtggctggacgccagaacctactccgaccctctcgctctgcgcgagtttaaggagttcgccgctggccggagatctgtgagcggggatctgatcctcgagattggaaaacttccccagcacctgacacagcgcgcccaaaatgcgctggacaacctcgtcatgctgcataattccgaacagggcgggcgggcctatagacacgctatggaggagcttcctgataccatcgaaacactgatgctcctggccctgatcgctgttctcaccggaggcgtgacgctctttttcctgtctggccgggggctgggaaaaacaagcattggcctcctgtgtgtgatggcctccagcgtccttctgtggatggcctctgtggagccccactggatcgctgcgtccattatcctcgaatttttcctgatggttctgctcattccggagcctgaccgccagagaacaccccaggataaccaacttgcctacgtggtcatcgggctgctgtttatgatcctcaccgtggctgccaatgagatgggactgcttgaaacaaccaagaaagacctgggcattgggcatgtcgccgtggagaaccaccatcacgctacaatgctcgatgttgacctgcatcctgccagcgcgtggacgctgtatgccgtggctaccacaatcattacccccatgatgcggcacacaatcgaaaacaccacggccaatatttctctcaccgctatcgccaaccaggcggccattcttatgggactggataagggctggcctatctccaaaatggacatcggcgtccccctgctcgctctggggtgctacagccaggtgaatccgcttacactgaccgccgctgttctcatgctggtggcccactacgctattatcggacctggcctgcaagccaaggcgacacgcgaggcccagaagagaaccgctgccgggattatgaaaaaccccacggtcgatggaatcgtggctattgacctcgatcccgtggtttatgacgccaagttcgaaaaacagcttggccagatcatgctgctgatcctctgtacatctcaaattctgcttatgcggaccacatgggccctgtgcgagagcatcaccctcgcgaccgggcctctgacaacgctgtgggagggatccccgggcaagttttggaataccacaattgctgtctctatggccaacatcttccgcggcagctacctcgctggggccggacttgccttttccctgatgaaaagcctgggcgggggaagacggggcaccggggctcagggagaaacactcggcgagaagtggaagcgccagctgaatcagctttccaaatctgagttcaacatttataagagaagcggcatcatggaggtggaccggtccgaagccaaagaggggctgaagagaggagagaccacgcgccatgcggtgtctcggggcacagccaaactcagatggttcgtcgaacgcaatctggttaagcccgaggggaaggtgatcgatctgggatgtggcagagggggatggagctactattgcgctggcctcaaaaaggtgaccgaagtcaaaggctacaccaaagggggacctggccacgaggaacccattcctatggccacatatgggtggaaccttgtgaaactgcattccggaaaggacgtgtttttcacaccccctgagaaatgtgataccctgctctgcgacatcggcgagtctagcccgaatcccacgattgaagaggggagaaccctgcgcgttcttaagatggtcgaaccttggctgcggggaaaccaattttgtatcaagattctcaatccctacatgccttccgtggttgagacactggagcagatgcagagaaaacacggcggcatgctggtgcgcaaccccctcagcagaaattctacccacgaaatgtactgggtctcctgcgggacaggaaacatcgtgagcgctgtgaatatgacctctagaatgctgcttaaccgcttcacgatggcccatcggaagccgacctatgagagagatgtcgacctgggcgcggggacacgccacgttgccgtggaacctgaggtggctaacctcgatattatcggacagagaatcgaaaatattaaacatgagcacaagtccacctggcattacgacgaggataacccctataaaacatgggcctaccacggcagctatgaagtcaagccctctgggtccgctagctccatggtgaatggagttgtgaagctgcttaccaaaccttgggacgtcatccccatggtgacacaaattgccatgaccgatacgacaccttttggccagcagcgggttttcaaggagaaagtggacacccgcaccccgaaggctaaaagaggcacagcccaaatcatggaagtcacggcgcggtggctgtgggggtttctcagcagaaacaagaagccccggatttgtacccgcgaggagttcacaagaaaagtgcggtctaatgccgctatcggagccgtttttgtggacgagaaccagtggaatagcgctaaggaggccgtcgaagatgagcgcttctgggacctggtgcagaaagaaagagagctgcacaagcagggcaaatgcgcgacctgcgtctacaacatgatggggaagcgggaaaagaaactcggagagtttggcaaggcgaaagggtcccgcgctatctggtatatgtggctgggcgccagattccttgagtttgaagccctgggattcatgaatgaggatcattggttctctcgggaaaacagcctctccggcgtggagggggagggactgcacaaacttggctacattctgcgcgacatctctaaaattcctgggggaaatatgtacgctgatgacacagccggctgggataccagaatcacagaagacgatctccaaaacgaggctcggattaccgacatcatggaacccgagcatgccctgctggcgacgagcatctttaagctcacctatcagaataaagttgtgcgcgtccagagacctgccaagaacgggacagtgatggatgtgatttcccggcgcgaccagagaggctctggacaagttggcacctacgggctgaatacattcaccaacatggaagctcagcttatccggcagatggagagcgagggaatttttctgccctccgaactcgagacgcagaacctggccgaaagagtgcttgattggctggagaagtatggcgtcgaacgcctcaaacggatggctatcagcggggacgactgtgtggttaagccgattgatgacagattcgccacagcgctgaccgccctgaatgatatgggaaaagtgcgcaaggacatccctcaatgggagccctctaaaggctggaacgattggcagcaggtccctttttgctcccaccacttccatcagctcatcatgaaggacgggcgggagattgtggtcccctgtagaaatcaagatgaactggtgggccgcgctcgggttagccagggagccggctggtctcttagagagacagcttgcctggggaagtcctacgcccagatgtggcaactcatgtattttcaccgccgggacctgagacttgctgccaacgcgatctgtagcgccgtgcctgtcgattgggtgcccacctcccgcacgacctggtctattcatgctcaccatcagtggatgacaaccgaagacatgctgagcgtttggaatcgggtgtggatcgaggaaaacccgtggatggaggataaaacacacgtctccagctggggagacgtgccttacctcggcaagagagaggaccagtggtgcgggtctctgattggactgaccgcccgggccacatgggcttccaatatccaggtggccattaaccaagttagacgcctcatcggcaatgaaaactatctggattacatgaccagcatgaaacggttcaagaatgagggggaccccgaaggcgcgctttggtga

SEQ ID NO: 19052 - RNA, 9879 nt, synthetic construct
  misc_feature 1..9879: note = derived and/or modified CDS sequence (opt5) from DENV-1__GQ199806__SS-prME
  source 1..9879: mol_type = other RNA
agcgtgaccatgctgctgatgctgatgcccacagcccttgctttccacctgacgaccagaggcggggagcctcatatgatcgtgtccaagcaggaacggggaaaatctctcctgtttaagacaagcgccggcgttaacatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccattctccgcaaactgtgcatcgaagcgaagatttccaataccacgacagatagcagatgtccgacccaaggagaggccacccttgttgaggaacaagacgctaactttgtgtgccggcgcacattcgtggatagaggctggggcaatgggtgtggactgtttggcaaagggtctctcatcacatgcgccaagttcaagtgcgtcacaaaactggagggaaagatcgtgcagtacgaaaaccttaaatattccgttattgtgacggtccacaccggcgaccagcatcaagtggggaatgagagcacagaacacggaaccacagctaccatcacgccccaggccccttctaccgagattcagctgacagactacggcgccctcaccctggattgtagcccccggacaggcctggactttaacgaaatggttctcctgaccatgaaggagaaaagctggcttgtgcataagcagtggttcctggatctccctctgccctggacgtccggggcttctacaagccaagagacctggaatcgcaaagaccttctggtcacatttaagaccgcgcacgccaagaaacaggaagctgtggtcctcggatcccaggagggcgccatgcacaccgccctgacaggggctacggaaatccaaaccagcggaacaaccacaattttcgccggccatctgaagtgcagactcaaaatggataagctgacccttaaagggatgtcttatgtgatgtgtacgggctccttcaagctggagaaggaagttgcggagacacagcacggaaccgtgctcgtccagatcaaatacgagggcaccgacgctccgtgcaagatcccttttagcacacaggatgaaaaaggggtgacccaaaacggacggctgattacagccaatcccatcgttacggacaaggagaaacctgtgaacattgaagccgagccgcccttcggcgagtcttatatcgtcattggggctggagaaaaggccctgaaacttagctggtttaaaaagggctcctctatcgggaaaatgttcgaggctaccgccagaggcgcgcgccggatggccatcctcggagatacagcttgggactttggcagcattgggggagtgttcacctccgtgggcaagctggttcatcagatctttgggacagcctacggagtcctgttcagcggcgtgtcttggaccatgaaaattgggatcggcgtgctcctgacgtggcttggactcaattccagaagcacctctctctccatgacatgtattgtcgtgggcctggttaccctgtaccttggggtgatggtccaggctgatagcggatgcgtgatcaactggaagggccgcgaactcaagtgtgggtccggaatttttgttacaaatgaggtgcacacctggacagaacagtataaattccaagccgactctcctaagcggctgagcgcggccatcggcaaggcttgggaggagggggtctgcggcatcagatccgccacccgcctggaaaacattatgtggaagcagatctctaacgagctcaatcatattctgcttgaaaacgacatgaaatttacggtggttgtgggagatgtcgctggcatcctggcccaggggaagaaaatgattcggccgcagcccatggagtacaagtatagctggaagtcctggggaaaagccaagatcatcggcgctgacgtgcaaaatacaaccttcattatcgatgggcctaacacccccgaatgtcctgacgatcagagagcgtggaatatttgggaggtggaggactacggatttggcatcttcacaaccaacatttggctcaaactgcgcgatagctatacgcaggtctgcgaccaccggctgatgtctgccgctatcaaggattccaaagccgttcacgccgacatgggctactggatcgaaagcgagaagaatgaaacatggaaacttgctagagcctctttcattgaggtgaagacctgtatctggcccaagtcccatacactctggagcaacggggtgctggaatctgagatgattatcccgaaaatttatggaggccctatcagccagcacaattaccgccccgggtactttacccaaacagcgggaccttggcatctgggcaagctcgagctggatttcgacctttgcgaagggaccacggtcgtggttgatgagcactgcggaaaccggggcccctccctgagaaccacaaccgtgacaggcaaaatcattcacgaatggtgttgccggagctgtaccctccctcccctgcgctttaagggggaggacggatgctggtatggcatggagatcagaccggtcaaggaaaaagaggaaaatctggtgaagtctatggtttccgctgggagcggagaggtggactccttctctcttggcctcctgtgtattagcatcatgattgaagaggtcatgcggtccagatggtctcgcaaaatgctgatgacggggacactcgccgtgtttttcctgcttatcatgggacagctgacctggaacgatctcattcggctgtgcatcatggttggcgccaatgctagcgacagaatgggcatggggacaacctacctggcccttatggcgacctttaagatgcgccctatgttcgctgtgggactgctctttagacggctgacatcccgcgaggtcctcctgcttacgatcggcctgtctctcgtggccagcgtggaactgcccaactccctggaggaacttggggatggactggccatgggcattatgatcctcaaactgctcaccgacttccagagccatcaactgtgggctacacttctgtctctcacctttattaagacaaccttctccctgcactatgcctggaagacgatggctatggtcctgagcatcgtttctctttttcccctgtgtctctccacaaccagccagaaaaccacatggctgcctgtgctcctggggtctcttggatgcaagccgctgaccatgttcctgattgccgagaataaaatctggggcagaaagtcctggcccctcaacgaaggcatcatggcggtggggattgtcagcatcctgctttccagcctgctcaaaaacgatgtgcctctggccggacccctcattgctggcgggatgctgatcgcctgttacgttatttctggaagctccgctgacctttctctggagaaggccgccgaggtgagctgggaagaggaagctgagcattccggcgcgtctcacaatatcctggtcgaagtgcaggatgacgggacaatgaaaatcaaggatgaggagcgggacgatacgctcaccattctgcttaaggccacactgctcgctgttagcggagtgtatcctctgtccatccccgccaccctcttcgtctggtacttttggcagaaaaagaaacaacgctctggcgtgctgtgggacacaccttcccctcccgaagtcgagagagccgtgcttgatgacggcatttatcggatcatgcagcgcgggctgctgggaagatcccaggttggcgtgggggtcttccaggaaaacgtgtttcataccatgtggcacgttacgcggggagctgtgctcatgtaccaaggcaagcgcctggagcccagctgggcctctgtcaaaaaggaccttatttcctacgggggaggctggagactgcagggcagctggaataccggggaggaagtccaggtgatcgcggttgagcccggaaagaaccctaaaaatgtccagacagctcccggcaccttcaagacatctgaaggggaggtgggagccattgccctcgattttaaaccgggcacctccgggagccctatcgtgaaccgggaaggaaagatcgtcggcctgtatggcaatggggtggttacaacgtccggaacctacgtgtctgctattgcccaagcgaaagctagccaggacggccccctccctgagatcgaggatgaagtcttcagaaagcgcaacctgacaattatggaccttcaccccgggtccggaaagacccggagatatctgcccgccatcgtgcgcgaggccattaaacggaagctgagaaccctcatcctggctcctacacgcgttgtggccagcgaaatggctgaggcccttaaaggcatgccgatccggtaccagacgaccgcggtcaagtctgaacatacagggaaagagattgtggatctgatgtgccacgccacctttacaatgagactcctgtcccccgttcgcgtgcctaattataacatgatcattatggacgaggctcatttcaccgatcccagctctatcgccgctcggggctacattagcacgagagtcggaatgggcgaagccgccgctatctttatgacagcgacccctcccgggtccgtggaggccttccctcaatctaatgctgtgatccaggacgaagaacgggatattccggaacgcagctggaactccggatatgagtggatcaccgactttcccggcaagacagtctggttcgttccttctattaagagcgggaatgatatcgccaactgtctgcgcaagaatggaaagcgggtgattcagctctcccgcaaaaccttcgacacagagtaccagaagaccaaaaacaacgactgggattacgtggtcacgacagacatcagcgaaatgggcgccaattttagagctgatcgggtgattgaccccagacgctgccttaagcctgttatcctgaaggatgggcccgagcgggtgatcctggccggcccgatgcctgtcaccgtggcgtctgctgcccaaagacgcggacggattggcagaaaccacaataaagaaggggaccagtatatctacatgggacagcccctcaacaatgatgaggaccatgcccactggacagaggctaagatgctgcttgataacattaatacccccgaaggcatcattcctgccctgttcgagcccgaacgcgagaaatccgcggccatcgacggggaatatcggctcagaggagaggctcgcaagacgtttgttgagctgatgagacggggcgatctgcctgtgtggctcagctacaaagtcgcctccgaagggttccagtattctgaccgcagatggtgctttgatggcgagcggaacaatcaagtgcttgaagagaacatggacgtcgaaatctggaccaaggagggagagcgcaaaaagctgagaccgcggtggctggacgctagaacatacagcgatcccctcgccctgcgcgagttcaaggagtttgctgccggccggagatccgtgtctggggaccttattctggaaatcggaaaactccctcagcacctgacccagcgcgcgcagaatgccctggataacctcgttatgcttcataatagcgagcaaggcgggcgggcttatagacacgccatggaggaactgcccgacacaattgagaccctgatgctcctggctcttatcgccgtgctgacaggaggcgtgaccctcttctttctgtccggccgggggctgggaaagacgagcattggcctcctttgtgtcatggcctcttccgttctgctgtggatggctagcgtggaacctcattggatcgcggcctctatcattctcgagttctttctgatggtgcttctgatccccgaaccggatcgccagagaacacctcaggacaaccagctcgcttacgtcgtgattgggctgctgttcatgatcctcaccgttgccgccaatgagatgggacttctggagaccaccaagaaggatctgggcattgggcacgtggctgtcgaaaaccaccatcacgccgcgatgctcgacgtggatctgcatcccgcctccgcttggaccctttacgccgtcgctacaacgatcattacccctatgatgcggcacacaatcgagaacaccacagccaatatcagcctgaccgcgattgccaaccaagctgccatcctcatgggactggacaaaggctggcccatttctaagatggatatcggcgtgcctctgctcgctcttgggtgctatagccaggttaatcccctgacgctgaccgccgctgtgctcatgctggtcgcccattacgcgattatcggaccgggccttcaggccaaggctacacgcgaagcccagaaaagaaccgctgccgggatcatgaagaaccctacagtggacggaattgttgccatcgatctggaccccgtggtctatgacgcgaaatttgagaagcagctcggccagattatgctgctgatcctctgtacctcccagattcttctgatgcggacgacatgggctctgtgcgaatctatcaccctcgccacagggcccctgaccaccctttgggagggaagccctggcaaattctggaatacaacgatcgctgtgtccatggccaacattttccgcggcagctacctggccggggctggactcgccttttccctgatgaagtctctgggcgggggaagacggggcaccggggcgcaaggagagacactcggcgaaaagtggaaacgccagcttaatcagctgagcaagtccgagttcaacacctataaaagatctggcatcatggaagtggatcggagcgaggccaaggaagggctgaaaagaggagagacaaccaagcacgctgtttcccgcggcacggccaagctccggtggtttgtcgagagaaatctggtgaaaccggaagggaaggtgattgaccttggatgtggccgcgggggatggtcttactattgcgctggcctgaaaaaggtcacagaggttaaaggctacaccaaagggggacccggccacgaggaacctatccccatggccacctacgggtggaacctcgtgaaactgaatagcggaaaggatgtgttctttattcctcccgaaaagtgtgacacactgctctgcgatatcggcgagtccagccctaacccgaccattgaggaagggcggacacttagagtcctgaaaatggtggagccctggctgcgcggaaatcagttctgtatcaagatcctcaacccttatatgccctctgttgtggaaacgctggagcaaatgcagcggaaacatggcggcatgcttgtcagaaatcctctgtcccgcaacagcacccacgagatgtactgggtgtcttgcgggacaggaaatattgtttccgcggtgaacatgaccagccggatgctcctgaacagatttacaatggcccatcgcaagcccacctatgaacgggacgtcgatctgggcgctgggacgagacacgtggccgtggagccggaagtcgctaatctcgacatcattggacagcgcatcgagaacattaaatacgaacacaagtctacctggcattatgatgaggacaatccttacaagacatgggcctatcacggctcctacgaggttaaacccagcgggtccgctagctctatggtgaacggagtggtcaagctgcttaccaaaccctgggatgtgatccctatggttacacagatcgccatgaccgacacaacccccttcggccaacagagagtgtttaaggaaaaagtcgacacgcggacacctaaggcgaagcgcggcaccgcccagattatggaggtgaccgctaaatggctgtgggggttcctcagcagaaataagaaaccgcggatctgtacaagagaagagtttacgcggaaggttcgctccaacgccgctattggagccgtgttcgtcgatgaaaatcaatggaactctgccaaagaggcggtggaggacgaaagattttgggatctggttcatcgggagcgcgaacttcacaagcagggcaagtgcgctacctgcgtgtacaatatgatggggaaaagagagaagaaactgggagagttcggcaaggccaaagggagccgggccatctggtatatgtggctcggcgctcgcttcctggagtttgaggccctgggattcatgaacgaagaccattggttttccagagaaaattctctcagcggcgtcgaaggggagggactgcacaaacttggctacattctgcgggatatctccaaaatccccgggggaaacatgtatgctgacgatacagccggctgggacacccgcattacagaggatgacctccagaatgaagcgaagatcaccgatattatggagcctgaacacgccctgcttgctaagtctatcttcaaactgacataccagaacaaggtggtcagagtgcaacggcccgccaaaaatgggaccgttatggacgtgattagccgcagagatcagcggggctccggacaggtcggcacgtatgggctcaacacctttacaaacatggaggctcagctgatccgccaaatggaaagcgagggaatcttctctccttccgagctggaaacccccaatctcgccggcagagtgctggactggcttgagaagcatggggtggaacggctgaaaagaatggcgattagcggagacgattgtgttgtgaagccgatcgacgatcgctttgccacagctctcaccgccctgaacgacatgggcaaggtccggaaagatattcctcagtgggagccctctaaggggtggaatgactggcaacaggtgcctttctgctcccaccattttcaccaacttatcatgaaagatggcagagaaattgttgtgccctgtcgcaaccaggacgagctggtcggacgggctagagtgagccagggcgccgggtggtccctccgcgagacggcttgcctgggaaagtcttacgcccagatgtggcaactgatgtatttccaccggagagatctccgcctggcggccaatgctatctgtagcgccgtccctgtggactgggttcccacatcccggaccacatggagcattcatgcccaccatcagtggatgaccacggaagatatgctttctgtgtggaacagagtctggatcgaggaaaatccgtggatggaggacaaaacccacatctccagctgggaagacgtgccttacctgggcaagcgcgaggatcagtggtgcgggtctctcattggactgacagctcgggccacctgggcgacaaacatccaagttgctattaatcaggtgagacggcttatcggcaacgagaattacctggactatatgaccagcatgaagagatttaaaaacgaatccgatcccgagggggccctctggtga

SEQ ID NO: 19053 - RNA, 9879 nt, synthetic construct
  misc_feature 1..9879: note = derived and/or modified CDS sequence (opt5) from DENV-1__GQ199809__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacccttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggtgggagaaaaagcccttaagctctcttggttcaagaaaggcagctccatcgggaagatgtttgaggctaccgccagaggcgctcgccggatggccatcctgggagatacagcgtgggacttcggctctattgggggagtttttaccagcgtcggcaaactggtgcatcagatcttcgggacagcctacggagtgctcttttccggcgtcagctggaccatgaagattgggatcggcgtgctgcttacgtggctgggactcaattctagatccaccagcctgtctatgacatgtattgctgttggcctggtgaccctttacctcggggtcatggtgcaggccgattccggatgcgttatcaactggaaaggccgcgaactgaagtgtgggagcggaattttcgtgacaaatgaggtccacacctggacagaacaatataagtttcaggctgactcccctaaacggctgtctgccgcgatcggcaaggcctgggaggagggggtgtgcggcatcagaagcgttacccgcctcgaaaacattatgtggaaacagatctccaacgagctgaatcatattcttctggaaaacgacatgaagttcacggtggtcgtgggagatgtggtcggcatcctcgctcaggggaaaaagatgattcggccgcaacccatggagcacaaatactcttggaaaagctggggaaaggccaagatcatcggcgctgacgttcagaatacaacctttattatcgatgggcctaacacccccgaatgtcctgacgatcagagagcctggaatatttgggaggtggaggactatggattcggcatctttacaaccaacatttggctgaagctgcgcgattcctacacgcaggcctgcgaccaccggcttatgagcgctgcgatcaaagattctaaggccgtgcatgctgacatgggctattggatcgaatccgagaaaaatgaaacatggaagctcgccagagccagcttcattgaggtcaagacctgtatctggcccaaatctcacacactgtggtccaacggggtgctggaaagcgagatggttattccgaagatctacggaggccctatttctcaacataattatcgccccgggtacttcacccagacagctggaccttggcacctcggcaaactggagcttgattttgacctgtgcgaagggaccacggtggtcgtggatgagcactgcggaaaccggggccccagcctcagaaccacaaccgttacaggcaagatcatccatgaatggtgttgccggtcctgtaccctgcctcccctgcgcttcaaaggggaggacggatgctggtacggcatggagattagaccggtgaaggaaaaggaggaaaatcttgtcaaaagcatggtgtctgccgggtccggagaggttgacagcttttccctcggcctgctgtgtatctctattatgatcgaagaggtgatgcggagcagatggtcccgcaagatgctcatgacggggacactggcggtcttccttctgctcattatgggacagctgacctggaacgatctgatccggctttgcattatggtgggcgctaatgcctctgacagaatgggcatggggacaacctatctggccctcatggctacctttaaaatgcgccctatgttcgccgtgggactgctctttagacggctgacaagccgcgaggtccttctgctcacgatcggcctgtccctggttgcgtctgtggaacttcccaacagcctggaggaactcggggatggactggctatgggcatcatgattctcaagctgcttaccgacttccaatcccaccagctgtgggccacactcctgagcctgacctttatcaaaacaaccctttctctgcattacgcctggaagacgatggctatggtgctctccattgtcagcctgttccccctctgtctgtctacaacctcccagaagaccacatggcttcctgtgctgctggggagcctcggatgcaaaccgctgaccatgtttcttatcgccgagaataagatttggggcagaaaatcttggcccctgaacgaaggcatcatggctgttggggtggtctccatcctcctgagctccctcctgaagaacgatgtgcctcttgccggacccctgattgcgggcgggatgctgatcgcctgttatgttattagcggatctagcgctgacctctccctggagaaagccgctgaggtgtcttgggaagaggaagccgagcacagcggcgcctcccataatatccttgtcgaagtgcaggatgacgggacaatgaagattaaagatgaggagcgggacgatacgctgaccatcctcctgaaggctacactcctggcggtctctggagtgtaccctcttagcatccccgccaccctgttcgtttggtatttttggcaaaagaaaaagcagcgctccggcgtgctgtgggacacaccttctcccccggaagtcgagagagctgtgctcgatgacggcatttaccggatcatgcagcgcgggctgcttggaagaagccaggttggcgtgggggtcttccaagaaaacgtgttccacaccatgtggcacgtgacgcggggagccgttctgatgtatcagggcaaacgcctcgagccttcctgggccagcgtcaagaaagacctgatttcttacgggggaggctggagactccagggctcctggaataccggggaggaagtccaggtgatcgctgtcgagcccggaaagaaccctaagaatgtgcaaacagcccccggcacctttaaaacaccggaaggggaggttggagcgattgctctggatttcaagcctggcaccagcgggtctcccatcgtgaaccgggaaggaaaaattgtcggcctttacggcaatggggtggttacaacgtccggaacctatgtgagcgccatcgcccaggctaaggcctcccaggagggccctctgcccgagatcgaagacgaggtctttagaaaacgcaacctgacaattatggatctccatcccgggtctggaaagacccggagatacctgcctgcgatcgtgcgcgaagctattaagcggaaacttagaaccctgatcctcgccccgacacgcgttgtggccagcgagatggctgaagccctgaagggcatgcccattcggtatcaaacgaccgctgtcaaatccgagcacacagggaaggagatcgtggacctgatgtgccatgccaccttcacaatgagactccttagccctgtgcgcgtccccaattacaacatgatcattatggatgaagcgcactttaccgacccttcttccatcgccgctcggggctatattagcacgagagttggaatgggcgaggccgctgccatcttcatgacagccacaccccctgggtctgtggaggcttttccgcagagcaatgcggtgattcaggatgaggaacgggacatccccgagcgctcctggaactctggatacgagtggatcaccgatttccctggcaaaacagtctggtttgtgcccagcattaagtccgggaatgacatcgccaactgtctgagaaagaatggaaaacgggttattcagctgtctcgcaagaccttcgatacagaatatcagaagaccaagaacaacgactgggactacgtggtcacgacagatatcagcgagatgggcgctaattttagagccgaccgggtgattgatcctagacgctgcctcaaacccgttatcctgaaggacgggccggaacgggtgattcttgccggccctatgcccgtcaccgtggcttccgccgcgcagagacgcggacggatcggcagaaaccataataaggagggggatcagtacatctatatgggacagcccctgaacaatgacgaggatcacgctcactggacagaagccaaaatgctcctggacaacattaatacccctgagggcatcattcccgccctgttcgaacctgagcgcgaaaagagcgctgccatcgatggggagtaccggctcagaggagaggcgcgcaaaacgttcgtcgaacttatgagacggggcgacctgccggtgtggctgtcttataaggttgcctccgaggggtttcaatacagcgatcgcagatggtgcttcgacggcgaacggaacaatcaggtgctcgaggaaaacatggatgtggagatttggaccaaagagggagaacgcaagaaactgagaccccggtggcttgacgctagaacatattccgaccctctggccctccgcgagtttaaggagttcgctgccggccggagatctgtcagcggggatctgatcctggagatcggaaagctcccccagcatcttacccagcgcgctcaaaatgccctggacaacctggttatgctccacaattccgaacagggcgggcgggcgtacagacatgccatggaggagctgcctgatacaattgaaacccttatgctgctcgctctgatcgccgtgctgacaggaggcgtgaccctctttttcctttctggccgggggctgggaaaaacgagcattggcctgctctgtgtcatggcttccagcgtgctgctttggatggcctctgttgagccccactggatcgccgcttccattatcctggaatttttcctcatggtgctgctgatcccggagcctgaccgccagagaacaccccaggataaccaactcgcgtatgtcgtgattgggcttctgtttatgatcctgaccgtcgccgctaatgagatgggactcctggaaaccacaaagaaagaccttggcattgggcacgtggccgttgagaaccatcaccatgccaccatgctggatgtggacctccaccctgctagcgcctggacactgtacgcggtcgccacgaccatcattacacccatgatgcggcataccatcgaaaacacaaccgctaatatttctctgacggccatcgctaaccaggccgcgatcctcatgggacttgataagggctggcctatttccaaaatggacatcggcgtgcccctgctggccctcgggtgctacagccaggttaatccgctgacccttacagctgccgtgctgatgctcgtcgctcactatgccattatcggacctggcctgcaagctaaggccacccgcgaggcgcagaagagaacagccgctgggattatgaaaaaccccaccgtggatggaatcgtggccatcgacctggatcccgttgtctacgacgctaagttcgaaaaacagctcggccagattatgcttctgatcctgtgtacgtctcaaattctcctgatgcggacaacctgggccctttgcgagagcatcacactggccaccgggcctctcaccacactgtgggagggatccccgggcaagttttggaatacgaccattgcggtgtctatggctaacatcttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcattatggaggtggaccggtccgaagctaaagaggggcttaagagaggagagacaacccgccacgccgtctctcggggcacggcgaaactgagatggttcgttgaacgcaatctcgtgaagcccgaggggaaggtgatcgatctgggatgtggcagagggggatggagctattactgcgccggcctgaaaaaggtcacagaagtgaaaggctataccaaagggggacctggccatgaggaacccattcctatggctacctacgggtggaacctcgttaaacttcactccggaaaggacgtgtttttcacaccccctgagaaatgtgataccctgctgtgcgacatcggcgagtctagcccgaatcccacaattgaagaggggagaacgctccgcgtcctgaagatggtggaaccttggcttcggggaaaccaattttgtatcaagattctgaatccctacatgccttccgttgtggagaccctcgagcagatgcagagaaaacatggcggcatgctggtccgcaaccccctgagcagaaattctacacacgaaatgtattgggtgtcctgcgggaccggaaacatcgtgagcgccgtcaatatgacatctagaatgctcctgaaccgcttcaccatggctcaccggaagccgacgtacgagagagatgttgaccttggcgccgggacccgccatgtggcggtggaacctgaggtcgccaacctggatatcattggacagagaatcgaaaatattaaacacgagcataagtccacatggcactatgacgaggataacccctacaaaacctgggcttatcatggcagctacgaagtgaagccctctgggtccgccagctccatggttaatggagtggtcaagctcctgacaaaaccttgggacgtgatccccatggttacccaaattgctatgacagataccacgccttttggccagcagcgggtgttcaaggagaaagtcgacacacgcaccccgaaggccaaaagaggcaccgctcaaatcatggaagtgacagcccggtggctttgggggtttctgagcagaaacaagaagccccggatctgtacgcgcgaggagttcaccagaaaagttcggtctaatgcggccattggagctgtgtttgtcgacgagaaccagtggaatagcgccaaggaggctgtggaagatgagcgcttctgggacctcgtccagaaagaaagagagctgcacaagcagggcaaatgcgccacatgcgtgtataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgttgagggggagggactccataagctgggctacattcttcgcgacatctctaaaattcctgggggaaatatgtatgccgatgacaccgctggctgggatacaagaatcaccgaagacgatctgcaaaacgaggccaagatcacagacattatggaacccgagcacgctctcctggccaccagcatctttaaactgacgtaccagaataaggtggtccgggtgcagcgccctgcgaagaacgggaccgtgatggatgttatttccagacgggaccagcgcggctctggacaagtgggcacatatgggctcaataccttcacaaacatggaagcccagctgatcagacagatggagagcgagggaatttttcttccctccgaactggagaccccgaacctcgctgaacgggtcctggattggcttgagaaacatggcgtggaaagactgaagcgcatggccatcagcggggacgactgtgttgtgaaacctatcgatgaccggttcgctacggccctcacagcgctgaatgatatgggaaaggtcagaaaagacattccccagtgggagccttctaagggctggaacgattggcaacaggtgcccttttgctcccaccacttccatcagctgatcatgaaggacgggcgcgagattgtcgtgccttgtcggaatcaggatgaactcgttggcagagcccgcgtgagccaaggagctggctggtctctgcgggagaccgcctgccttgggaaatcctacgctcagatgtggcagctgatgtattttcacagacgcgacctccggctggccgctaacgccaattgtagcgcggtccccgtggattgggttccgacatccagaaccacgtggtctatccatgcccaccatcaatggatgaccacagaagacatgcttagcgtgtggaaccgcgtctggattgaggaaaatccttggatggaggataagacccacgtgtccagctggggagacgtgccctacctgggcaaacgggaggaccagtggtgcgggtctctcatcggactgacagctagagccacctgggcctccaacattcaggttgctatcaatcaggtccggagactgatcggcaacgaaaattatctcgattacatgacaagcatgaagcgcttcaaaaacgagggggaccccgaaggcgccctgtggtga

SEQ ID NO: 19054 - RNA, 9879 nt, synthetic construct
  misc_feature 1..9879: note = derived and/or modified CDS sequence (opt5) from DENV-1__GQ199810__SS-prME
  source 1..9879: mol_type = other RNA
tccgtgaccatgctgctcatgctgatgcccacagcccttgctttccacctgacgaccagaggcggggaacctcatatgatcgtctccaagcaggaacggggaaaatctctcctgtttaagacaagcgccggcgttaatatgtgcacccttattgccatggacctgggggaactctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgttggcaaactcgtccatcagatcttcgggacggcctacggagtgctgtttagcggcgtgtcctggaccatgaagattgggatcggcgtccttctgacatggctcggactgaatagcagatctacctccctgagcatgacatgtattgctgtgggccttgttaccctctacctgggggtgatggtccaggccgattctggatgcgtgatcaactggaaaggccgcgaactgaagtgtgggtccggaattttcgttacaaatgaggtgcacacctggacggaacaatataagtttcaggctgacagccctaaacggctctccgccgcgatcggcaaggcctgggaggagggggtctgcggcatcagatctgctacacgcctggaaaacattatgtggaaacagatcagcaacgagcttaatcatattctgctcgaaaacgacatgaagttcaccgtggttgtgggagatgtcgccggcatcctggctcaggggaaaaagatgattcggccgcaacccatggagtacaaatattcctggaagtcttggggaaaggccaaaatcatcggcgccgacgtgcagaataccacatttattatcgatgggcctaacacccccgaatgtcctgacgatcagagagcttggaatatttgggaggtggaggactacggattcggcatctttacgacaaacatttggctgaaacttcgcgatagccacacccaggtctgcgaccaccggctcatgtccgcggccatcaaagatagcaaggctgttcatgccgacatgggctattggatcgaatctgagaaaaatgaaacatggaagctggccagagcttccttcattgaggtgaagacctgtatctggcccaaaagccacacactgtggtctaacggggtgctcgaatccgagatgattatcccgaagatttacggaggccctatcagccaacataattatcgccccgggtacttcacccagacggccggaccttggcacctgggcaaacttgagctggattttgacctctgcgaagggaccacagtcgtggttgatgagcactgcggaaaccggggcccctctctgagaaccacaaccgtgacgggcaagatcattcatgaatggtgttgccggagctgtacactgcctccccttcgcttcagaggggaggacggatgctggtacggcatggagatccggccggtcaaagaaaaggaggaaaatctcgtgaagtccatggttagcgcggggtctggagaggtggactcctttagcctgggcctgctctgtatttccatcatgattgaagaggtcatgagatctcgctggagccggaaaatgctgatgaccgggacacttgctgtgttctttctgctcatcatgggacagctgacctggaacgatctgattagactttgcatcatggttggcgccaatgcctccgaccgcatgggcatggggaccacatatctggctctcatggccacgttcaagatgagacctatgtttgcggtgggactcctgttccggcgcctgacctctagagaggtccttctgctcacaatcggcctgagcctggtggcttccgtggaacttcccaactctctggaggaactcggggatggactggccatgggcattatgatcctcaaactgcttaccgactttcaaagccaccagctgtgggccacactcctgtccctgaccttcattaagacgacatttagccttcattacgcttggaaaaccatggccatggtcctgtctatcgtttccctcttccccctgtgtctcagcaccacatctcagaagaccacatggctgcctgtgcttctggggtccctgggatgcaagccgctcacgatgtttctgattgctgagaataaaatctggggccggcgcagctggccccttaacgaaggcatcatggccgtggggattgtctctatcctgctctccagcctgctcaagaacgatgtgcctctggcgggaccccttattgccggcgggatgctgatcgcttgttatgttatttccggaagctctgccgacctgagcctcgagaaagctgccgaggtgtcctgggaagaggaagtcgagcactctggcgccagccataatatcctggtggaagttcaggatgacgggaccatgaagatcaaagatgaggagagagacgatacacttaccattctgctcaaggctacactgctcgcggtgtccggagtctaccctctgtctatccccgccacccttttcgtgtggtatttctggcagaagaagaagcagcggagcggcgtcctgtgggacacgcctagccctcccgaagtggagcgcgctgttctggatgacggcatttacagaatcatgcagcgggggctcctgggacgctctcaggtgggcgtcggggtgtttcaagaaaacgttttccacaccatgtggcacgtgacaagaggagccgtccttatgtatcagggcaaacggctggagcccagctgggcctccgtgaagaaagacctcattagctacgggggaggctggagactgcagggctcttggaataccggggaggaagtgcaggttatcgctgtcgagcccggaaagaaccctaaaaatgtgcaaacagcccccggcacctttaagacaccggaaggggaggtgggagcgattgctctcgatttcaagcctggcacgtccgggagccccatcgtcaaccgcgaaggaaaaatcgtgggcctgtacggcaatggggttgtgaccacatctggaacctatgtctccgccattgcccaggctaaggccagccaggagggccctcttcccgagatcgaagacgaggtgtttcggaaaagaaacctgaccattatggatctgcatcccgggtccggaaagacacgccggtacctccctgcgatcgttagagaagctattaaacgcaagctgcggacgcttatcctggccccgaccagagtggtcgcctctgagatggctgaagccctcaagggcatgcccatccgctatcaaacaaccgctgtgaaaagcgagcacacagggaaggagattgttgacctgatgtgccatgccaccttcacgatgcggctgctctcccctgtgagagtccccaattacaacatgatcattatggatgaagcgcactttacagaccctagctctatcgccgctcggggctatatttccacccgcgtgggaatgggcgaggccgctgccatcttcatgaccgccacaccccctgggagcgtggaggcttttccgcagtctaatgcggtcatccaggatgaggaaagagacattcccgagcggagctggaactccggatacgagtggatcaccgatttccctggcaaaacagtttggtttgtgccctctattaagagcgggaatgacatcgccaactgtcttcgcaaaaatggaaagagagtgattcagctgtcccggaagaccttcgatacggaatatcagaagaccaagaacaacgactgggactacgtcgtgaccacagatatctctgagatgggcgctaatttcagagccgaccgcgttattgatcctcggagatgcctgaaacccgtgatcctcaaggacgggccggaacgcgtcatcctggccggccctatgcccgtgaccgttgctagcgccgcgcagcggagaggacgcattggccggaaccataataaagagggggatcagtacatctatatgggacagccccttaacaatgacgaggatcacgctcactggacggaagccaagatgctgctcgacaacattaatacccctgagggcatcattcccgccctgtttgaacctgagagagaaaagtccgctgccatcgatggggagtaccgcctgagaggagaggcgcggaaaacattcgtggaactcatgcgcagaggcgaccttccggtctggctgagctataaggtggcctctgaggggtttcaatactccgatcggcgctggtgcttcgacggcgaaagaaacaatcaggtcctggaggaaaacatggatgtggagatctggaccaaagagggagaacggaagaaactcagaccccgctggctggacgctcggacatatagcgaccctcttgccctgagagagtttaaggagttcgctgccggccgccggtccgtttctggggatctcattctggagatcggaaaactgccccagcatctcacccagagagctcaaaatgcccttgacaacctggtgatgctgcacaatagcgaacagggcgggcgggcgtaccgccatgccatggaggagctccctgatacaattgaaaccctgatgcttctggctctcatcgccgtgctgacgggaggcgtcacactgtttttcctctccggcagagggcttggaaagacctctattggcctgctgtgtgttatggctagctccgtgctcctgtggatggccagcgtggagccccactggatcgccgcttctatcattcttgaatttttcctgatggtcctcctgatcccggagcctgaccggcagcgcacaccccaggataaccaactggcgtatgtggttattgggctcctttttatgatcctgacagtggccgctaatgagatgggactgctcgaaaccacaaagaaagacctgggcattgggcacgtcgccgtggagaaccatcaccatgccgctatgcttgatgtcgacctgcaccctgcctccgcgtggacgctctacgccgtggctaccacaatcattacccccatgatgagacatacaatcgaaaacaccacggccaatatcagcctgaccgctattgccaaccaggcggccatcctgatgggactcgataagggctggcctatttctaaaatggacatcggcgttccccttctggctctggggtgctactcccaggtgaatccgctcacactgaccgccgctgtccttatgctggtggcccactatgctattatcggacctggcctccaagccaaggcgacacgggaggcccagaaacgcaccgctgccgggatcatgaagaaccccacggttgatggaattgtggctatcgacctggatcccgtcgtgtacgacgccaagttcgaaaaacagctgggccagattatgctccttatcctgtgtacaagccaaattctgctcatgagaaccacatgggccctgtgcgagtctatcacccttgcgaccgggcctctgacaacgctctgggagggaagcccgggcaagttttggaataccacaatcgctgtgtccatggccaacattttccggggctcttatctggctggggccggactggccttcagcctcatgaaatcccttggcgggggacgcagaggcaccggggctcagggagaaacactgggcgagaagtggaaacggcagctgaatcagctcagcaagtccgaatttaacacctacaagagatctggcatcatggaggttgaccgcagcgaagccaaagaggggctgaagcggggagagacgacaaaacacgcggtctccagaggcaccgccaaacttcgctggttcgtggaacggaatctggtgaaacccgaggggaaggtcattgatctcggatgtggcagagggggatggtcttattactgcgctggcctgaagaaagttaccgaagtgaagggctatacaaaagggggacctggccatgaggaacccatccctatggccacctacgggtggaacctggtgaagctccacagcggaaaagacgtctttttcattccccctgagaagtgtgatacacttctgtgcgacatcggcgagtcctctccgaatcccacgattgaagaggggcgcaccctgcgggtgctcaaaatggttgaaccttggctgagaggaaaccaattttgtatcaagatccttaatccctacatgcctagcgtggtcgagacactggagcagatgcagcgcaagcatggcggcatgctcgtgcggaaccccctgtccagaaatagcacccacgaaatgtattgggtttcttgcgggacaggaaacattgtgtccgctgtcaatatgaccagccgcatgctgctcaaccggttcacgatggcccacagaaaaccgacctacgagcgcgatgtggacctgggcgcggggacaagacatgtggccgtcgaacctgagatcgctaaccttgatattatcggacagcggattgaaaatatcaagcacgagcataaatctacctggcactatgacgaggataacccctacaagacatgggcctatcatggctcctacgaagttaaacccagcgggtctgcttccagcatggtgaatggagtggtcaagctgctcaccaagccttgggacgtgatccccatggttacacaaattgccatgaccgatacgacaccttttggccagcagcgcgtgttcaaagagaaggtcgacaccagaaccccgaaagctaagcggggcacagcccaaatcatggaagtgacggcgaaatggctgtgggggtttctttccagaaacaagaagccccggatttgtacccgcgaggagttcacaagaaaagttcggagcaatgccgctatcggagccgtgtttgtcgacgagaaccagtggaactctgctaaggaggccgtggaagatgagcgcttctgggacctggttcacagagaacgggagctccacaaacagggcaagtgcgcgacctgcgtgtataacatgatggggaaacgcgaaaagaagctgggagagtttggcaaagcgaaggggagcagagctatttggtacatgtggctgggcgcccggttcctcgagttcgaagccctgggatttatgaatgaggatcattggttctcccgcgaaaactctcttagcggcgtcgagggggagggactgcacaaactcggctacatcctgagagacatctccaagattcctgggggaaatatgtatgctgatgacacagccggctgggatacccggatcacagaagacgatcttcagaacgaggctcgcattaccgacatcatggaacccgagcatgccctgctcgcgaaatctatttttaagctgacgtaccaaaataaagtggtcagagtgcagcggcctgccaagaacgggaccgttatggatgtgatcagccgcagagaccagcggggctccggacaggtcggcacatatgggctgaataccttcacaaacatggaagctcaactcatcagacagatggagtctgagggaatttttagcccctccgaactggagaccccgaaccttgccgaacgcgtgctggattggctcgagaagtacggcgtggaacggctgaaaagaatggctatcagcggggacgactgtgttgtgaagcctattgatgaccgcttcgccacggcgcttacagccctgaatgatatgggaaaagtccggaaggacatcccccagtgggagccttctaaaggctggaacgattggcagcaagtgcccttttgctcccaccacttccatcagctcattatgaaggacgggagagagatcgttgtgccttgtcgcaatcaggatgaactggtcggccgggctagagtgagccagggagccggctggtctctgcgcgagaccgcttgcctcgggaagtcctatgcccaaatgtggcagctgatgtactttcaccggagagaccttcgcctggctgccaacgcgatttgtagcgccgtccccgtggattggatcccgacatcccggaccacgtggtctatccatgctcaccatcagtggatgaccacagaagacatgctcagcgtttggaatagagtgtggattgaggaaaacccttggatggaggataaaacccacatctccagctggggagacgtcccctatctgggcaagcgggaggaccaatggtgcgggtctcttattggactgacagccagagccacctgggctacaaatatccaggtggccattaaccaggttcgccggctcatcggcaatgaaaactacctggattacatgacctccatgaaaagattcaagaatgagggggaccccgaaggcgcgctgtggtga

SEQ ID NO: 19055 - RNA, 9879 nt, synthetic construct
  misc_feature 1..9879: note = derived and/or modified CDS sequence (opt5) from DENV-1__GQ199811__SS-prME
  source 1..9879: mol_type = other RNA
agcgtgacaatgctgctgatgctgatgcccacagcccttgctttccacctgacgacccggggaggggagcctcatatgattgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaattacatcctgcttgaaaacgacatgaagctgacggttgtggtcggagatgtggctggcattctcgcccaggggaaaaagatgatccggccgcaacccatggagtataaatacagctggaagtcctggggaaaggccaaaattatcggcgctgacgtgcagaatacaacctttatcattgatgggcctaacacccccgaatgtcctgacgatcagagagcgtggaatatctgggaggtcgaggactatggattcggcatttttacaaccaacatctggctgaagctgcgcgatagctacacgcaggtttgcgaccatcggcttatgtctgccgctattaaagattccaaggccgtgcacgccgacatgggctattggatcgaaagcgagaaaaatgaaacatggaagctcgctagagcctctttcatcgaggtgaagacctgtatttggcccaaatcccacacactgtggagcaacggggtcctggaatctgagatgatcattccgaagatctacggaggccctattagccaacataattaccgccccgggtatttcacccagacagcgggaccttggcacctcggcaaactggagcttgattttgacctgtgcgaagggaccacggtggttgtggatgagcattgcggaaaccggggcccctccctcagaaccacaaccgtcacaggcaagatcatccacgaatggtgttgccggagctgtaccctgcctcccctgcgcttcaaaggggaggacggatgctggtacggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctatcttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccaccagctttgggctacactgctctctctgaccttcgttagaacaaccttttccctgcattacgcctggaaaacgatggctatggtgcttagcatcgtgtctctgttccccctctgtctgtccacaaccagccagaagaccacatggctccctgtcctgcttgggtctctgggatgcaagccgctgaccatgtttctcattgccgagaataaaatctggggccggaagtcctggcccctgaacgaaggcattatggcggtggggatcgttagcatccttctgtccagcctcctgaaaaacgatgtgcctctcgccggacccctgattgctggcgggatgcttatcgcctgttatgtcatttctggaagctccgctgacctgtctctggagaaggccgccgtggttagctgggaggaagaggctgaacactccggcgcgtctcataatatcctcgtggaggtccaggatgacgggacaatgaaaattaaggatgaagaaagagacgatacgctgaccatccttctgaaagccacactcctggctgtgagcggagtctaccctctctccatccccgccaccctgttcgtgtggtatttctggcaaaagaagaaacagagatctggcgttctttgggacacaccttcccctcccgaggtggaacgggccgtcctggatgacggcatttaccgcatcatgcagagagggctgctcggacggtcccaggtgggcgttggggtgtttcaagagaacgtcttccacaccatgtggcatgtgacgcgcggagctgtgctgatgtaccagggcaagagacttgaacccagctgggcctctgttaaaaaggacctgatttcctatgggggaggctggcggctccagggcagctggaataccggggaggaggtccaggtgatcgcggtggaacccggcaagaatcctaagaatgtccaaacagctcccggcacctttaagacatctgagggggaagtgggagccattgccctggatttcaaaccgggcacctccgggagccctatcgttaacagagagggaaagattgtgggcctctacggcaatggggtcgtgacaacgtccggaacctatgtttctgctatcgcccaggcgaaagctagccaggaaggccccctgcctgagatcgaggacgaagtgtttcgcaagcggaaccttacaattatggatctgcaccccgggtccggaaaaaccagacgctacctgcccgccatcgtccgggaggccattaagagaaagctccgcaccctgatccttgctcctacacgggtggttgccagcgaaatggctgaggccctgaaaggcatgccgattagatatcaaacgaccgcggtgaagtctgaacacacagggaaagagatcgtcgacctcatgtgccatgccaccttcacaatgcgcctgctgtcccccgtgcgggtgcctaattacaacatgatcattatggatgaggctcactttaccgaccccagctctatcgccgctagaggctatattagcacgcgggtcggaatgggcgaagccgccgctatcttcatgacagcgacccctcccgggtccgttgaggcctttcctcagtctaatgctgtgattcaggatgaggaacgcgacatcccggaaagaagctggaactccggatacgagtggatcaccgatttccccggcaagacagtgtggtttgtcccttctattaaaagcgggaatgacatcgccaactgtctccggaagaatggaaagcgcgtgattcagctttccagaaaaaccttcgatacagagtaccaaaagaccaaaaacaacgactgggactatgttgtgacgacagatatcagcgaaatgggcgccaatttccgggctgacagagtcattgatccccgccggtgcctgaagcctgtgatcctgaaagacgggcccgagagagttattctcgccggcccgatgcctgtgaccgtcgcgtctgctgcccagcgccggggaagaatcggccgcaaccataataaggaaggggatcagtacatctatatgggacagcccctgaacaatgacgaggatcacgcccattggacagaggctaagatgcttctggacaacattaatacccccgaaggcatcattcctgccctctttgagcccgaacgggagaaatccgcggccatcgatggggaatacagactgcgcggagaggctagaaagacgttcgtggagctgatgcggcgcggcgacctccctgtctggcttagctataaagtggcctccgaagggtttcaatactctgatagacggtggtgcttcgacggcgagcgcaacaatcaggttctggaagagaacatggatgtggaaatttggaccaaggagggagagcgcaagaagctgcggccgagatggctcgacgctcgcacatatagcgaccccctggcccttcgggaatttaaagagttcgctgccggcagacgctccgtgtctggggatctgatcctcgaaatcggaaagctgcctcagcacctgacccagcgggcgcaaaatgccctcgacaaccttgtcatgctgcacaatagcgagcagggcgggagagcttaccggcatgccatggaggaactgcccgatacaattgagaccctcatgctgcttgctctgatcgccgttctcacaggaggcgtgaccctgtttttcctgtccggccgcgggctcggaaagacgagcattggccttctgtgtgtgatggcctcttccgtcctgctctggatggctagcgtggaacctcactggatcgcggcctctattatcctggagtttttccttatggttctgctcatccccgaaccggacagacagcggacacctcaggataaccaactggcttacgtggtcattgggctgctctttatgatccttaccgtggccgccaatgagatgggactgctggagaccaccaagaaggacctcggcattgggcatgtcgctgtggaaaaccaccaccatgccgcgatgctggatgttgaccttcaccccgcctccgcttggaccctgtatgccgtggctacaacgatcattacccctatgatgcgccatacaatcgagaacaccacagccaatattagcctcaccgcgatcgccaaccaggctgccatcctgatgggactggataaaggctggcccatttctaagatggacatcggcgtccctctccttgctctggggtgctacagccaggtgaatcccctgacgctcaccgccgctgttctgatgcttgtggcccactatgcgattatcggaccgggcctgcaagccaaagctacaagagaagcccagaagcggaccgctgccgggattatgaagaaccctacagtcgatggaatcgtggccatcgacctcgatcccgtggtttacgacgcgaaattcgagaagcagctgggccagattatgctgctcatcctttgtacctcccaaattctgctgatgcgcacgacatgggctctctgcgaatctatcaccctggccacagggccccttaccaccctgtgggagggaagccctggcaaattttggaatacaacgattgctgtctccatggccaacatcttcagaggcagctatctcgccggggctggactggccttctccctgatgaagtctctcggcgggggacggcgcggcaccggggcgcagggagagacacttggcgaaaaatggaagagacagctgaatcagctgagcaagtccgagtttaacacctacaaacggtctggcatcatggaagtggacagaagcgaggccaaggaagggctcaaacgcggagagacaaccaagcatgctgtgtcccggggcacggccaaactgagatggttcgtcgagcgcaatcttgttaagccggaagggaaggtgattgatctgggatgtggcagagggggatggtcttattactgcgctggcctcaaaaaggtgacagaggtcaaaggctacaccaaagggggacccggccacgaggagcctatccccatggccacctatgggtggaacctggtgaaactgcacagcggaaaggacgtctttttcattcctcccgaaaaatgtgatacactcctttgcgacatcggcgagtccagccctaatccgaccattgaggaagggagaacactgcgcgtgctgaagatggtcgagccctggctccggggaaaccaattttgtatcaagattctgaatccttacatgccctctgtggttgaaacgcttgagcagatgcagagaaaacatggcggcatgctggtgcgcaaccctctctcccggaatagcacccacgagatgtattgggtctcttgcgggacaggaaacatcgtgtccgcggtgaatatgaccagcagaatgctgctgaaccgcttcacaatggcccatcggaagcccacctacgaaagagatgtcgacctcggcgctgggacgcgccacgttgccgtggagccggaagtggctaacctggatatcattggacagagaatcgagaatattaaacacgaacataagtctacctggcactatgacgaggataacccttacaaaacatgggcctatcatggctcctacgaggtcaagcccagcgggtccgctagctctatggtgaatggagttgtgaaacttctgaccaaaccctgggacgtcatccctatggtgacacaaattgccatgaccgatacaaccccctttggccagcagcgggttttcaaggaaaaagtggacacgcgcacacctaaggcgaaaagaggcaccgcccaaatcatggaggtcaccgctaagtggctctgggggtttctgagccggaacaagaaaccgagaatctgtacacgggaagagttcacgcgcaaggtgagatccaatgccgctattggagccgtttttgtggacgaaaaccagtggaactctgccaaagaggcggtcgaggatgaacggttctgggaccttgtgcaccgcgagagagaactgcataagcagggcaaatgcgctacctgcgtctacaacatgatggggaagcgggagaagaaactcggagaatttggcaaggccaaagggagccgcgccatctggtatatgtggctgggcgctagattcctggagttcgaggccctcggatttatgaatgaagatcactggttctcccgggagaactctctgagcggcgtggaaggggagggacttcacaagctgggctacattctccgcgacatctccaaaattcccgggggaaatatgtatgctgatgacacagccggctgggataccagaatcacagaggacgatctgcagaacgaagcgaagatcaccgacattatggagcctgaacatgcccttctggctaaatctatctttaagctcacataccaaaataaggttgtgcgggtccagcgccccgccaaaaacgggaccgtgatggatgtgattagcagacgggaccagcgcggctccggacaggttggcacgtatgggctgaataccttcacaaacatggaggctcaactgatcagacagatggaaagcgagggaatcttttctccttccgagctcgaaacccccaacctggccggccgggtgcttgattggctggagaagcacggggtcgaaagactcaaacgcatggcgatcagcggagacgactgtgtggttaagccgatcgatgaccggttcgccacagctctgaccgcccttaatgatatgggcaaagtgagaaaggacattcctcagtgggagccctctaaggggtggaacgattggcagcaagtccctttttgctcccatcacttccaccagctgatcatgaaagacggccgcgaaattgtggtcccctgtcggaatcaggatgagctcgtgggcagagctcgcgttagccagggagccgggtggtccctgcgggagacggcttgcctgggaaagtcttacgcccaaatgtggcagctcatgtattttcatagacgcgacctgcggcttgcggccaacgctatctgtagcgccgtgcctgtcgattgggtgcccacatccagaaccacatggagcattcacgcccatcaccagtggatgaccacggaagacatgctgtctgtttggaatcgcgtgtggatcgaggaaaacccgtggatggaggataaaacccatatttccagctggggcgacgtcccttacctcgggaagcgggaagaccaatggtgcggatctctgatcggccttacagctagagccacctgggcgacaaatatccaggtggctattaaccaggtgcggagactgctcgggaatgagaactacctggattatatgaccagcatgaaacgcttcaagaatgagtccgaccccgaaggcgccctgtggtga

SEQ ID NO: 19056 - RNA, 9879 nt, synthetic construct
  misc_feature 1..9879: note = derived and/or modified CDS sequence (opt5) from DENV-1__FJ882549__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttatcgcgatggacctgggggaactctgtgaagatacaatgacctacaagtgcccgagaatcacagaggtggaacccgacgatgtggactgttggtgcaataccacggatacctgggtcacatatggaacctgttcccaaacaggcgagcaccggcgggacaagcgctctgtggctctggcccctcatgttgggctgggactcgagaccagagccgaaacgtggatgagctccgagggcgcttggaagcagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaggataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggcaaggggctcggaaaaacgagcatcggccttctgtgtgtgatggcttcttccgccctgctctggatggccagcgtcgagccccattggattgctgcgtctatcatcctggagttctttcttatggtgctgctcattccggagcctgaccgccagagaacaccccaggataaccaactggcctacgttgtgatcgggctcctgttcatgattcttaccgtcgctgccaatgagatgggactgctggaaaccacaaagaaagacctcggcatcgggcacgtggccgtcgagaaccaccatcacgctaccatgctggatgtggaccttcatcctgcctccgcgtggacactgtacgccgttgctacgaccattatcacacccatgatgcggcacaccattgaaaacacaaccgccaatatcagcctcacggctatcgccaaccaggcggccattctgatgggactggataagggctggcctatctctaaaatggacattggcgtgcccctccttgctctggggtgctatagccaggtcaatccgctgaccctcacagccgctgtgctgatgcttgttgcccattacgctatcattggacctggcctgcaagccaaggcgacccgcgaggcccagaagagaacagctgccgggatcatgaaaaaccccaccgtggatggaatcgtcgctattgacctcgatcccgtggtgtatgacgccaagtttgaaaaacagctgggccagatcatgctgctcattctttgtacgtcccaaatcctgctgatgcggacaacctgggccctctgcgagtctattacactggcgaccgggcctcttaccacactgtgggagggaagcccgggcaagttctggaatacgaccatcgctgtttccatggccaacatctttcgcggcagctacctcgctggggccggactggccttctccctgatgaaatctctcggcgggggaagacggggcacaggggctcagggagaaacccttggcgagaagtggaagcgccagctgaatcagctgagcaaatccgagttcaacacatataagagatctggcattatggaggtcgaccggagcgaagccaaagaggggctcagacgcggagagaccacgaagcacgcggtgtcccggggcacagccaaactgagatggtttgtggaacgcaatcttgtcaagcccgaggggaaggttatcgatctgggatgtggcagaggcgggtggtcttactattgcgctgggctcaaaaaggtgaccgaagtgaaaggctacaccaaagggggacctggccacgaggaacccattcctatggccacatacgggtggaacctggtcaaactgcatagcggaaaggacgtgttctttattccccctgagaaatgtgataccctcctttgcgacattggcgagtccagcccgaatcccacaatcgaagaggggagaacgctgcgcgttctgaagatggtggaaccttggctccggggaaaccaattctgtattaagatcctgaatccctatatgccttctgtcgtggagacccttgagcagatgcagagaaaacacggcggcatgctggttcgcaaccccctctcccggaatagcacacatgaaatgtactgggtgtcttgcgggaccggaaacatcgtctccgctgtgaatatgacaagcagaatgctgctgaaccgctttaccatggcccaccggaagccgacgtatgagagagatgtggacctcggcgcggggacccgccacgtcgccgttgaacctgaggtggctaacctggatattatcggacagagaattgaaaatatcaaacatgagcacaagtctacatggcattacgacgaggataacccctataaaacctgggcctaccacggctcctatgaagtgaagcccagcgggtccgctagctctatggtcaatggagtggttaaacttctgacaaaaccttgggacgtgattcccatggtcacccaaatcgccatgacagataccacgcctttcggccagcagcgggtgctcaaggagaaagttgacacacgcaccccgaaggctaaaagaggcaccgcccaaatcatggaagtgacagcgaagtggctgtgggggtttcttagccggaacaagaaacccagaatttgtacgcgggaggagttcacccgcaaggtcagatccaatgccgctatcggagccgtgtttgttgacgagaaccagtggaactctgctaaagaggccgtggaagatgagcggttctgggacctggtccatcgcgaaagagagctccacaagcagggcaaatgcgccacatgcgtgtacaacatgatggggaagcgggaaaagaaactgggagagtttggcaaggcgaaagggagccgcgctatttggtacatgtggctgggcgccagattcctcgagtttgaagccctgggattcatgaatgaggatcactggttctcccgggaaaactctcttagcggcgtcgagggggagggactgcataagctcggctatatcctgcgcgacatttccaaaatccctgggggaaatatgtacgctgatgacaccgccggctgggatacaagaatcaccgaagacgatcttcagaacgaggctaagattacagacatcatggaacccgagcacgccctgctcgcgacctctatttttaaactgacgtatcaaaataaggtggttcgggtgcagcgccctgccagaaacgggaccgtcatggatgtgatcagccggcgcgaccagagaggctccggacaggtgggcacatacgggctgaataccttcacaaacatggaagctcaactcattcggcagatggagagcgagggaatcttttctccctccgaactggagaccccgaaccttgccgaaagagttctggattggctcgagaagcatggcgtggaacgcctgaaacggatggctatcagcggggacgactgtgtcgtgaagcctattgatgacagattcgccacggcgctttctgccctgaatgatatgggaaaagttcgcaaggacatcccccagtgggagccttccaaaggctggaacgattggcagcaagtgcccttttgcagccaccacttccatcagctcattatgaaggacgggcgggagatcgtcgtgccttgtagaaatcaggatgaactggtcggccgcgctcgggtgtcccagggagccggctggtctctgagagagacagcttgcctcggaaagagctatgcccaaatgtggcagctgatgtactttcaccgccgggaccttagactggctgccaacgcgatttgttccgccgttcccgtggattgggtcccgaccagccgcacaacctggtctatccatgctcaccatcagtggatgacgaccgaagacatgctctccgtgtggaatcgggtttggattgaggaaaacccttggatggaggataaaacacacatcagctcttggggagacgtgccctatctgggcaagagagaggaccaatggtgcgggagccttatcggactgaccgcccgggccacatgggctaccaatattcaggtcgccatcaaccaggtgagacgcctcattggcaatgaaaactacctggattacatgacatccatgaaacggttcaagaatgagtctgaccccgaaggggcgctgtggtga

SEQ ID NO: 19057 - RNA, 9879 nt, synthetic construct
  misc_feature 1..9879: note = derived and/or modified CDS sequence (opt5) from DENV-1__GQ199814__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagataagcctgtgaacatcgaggccgaaccgcccttcggcgagtcttatattgtgatcggggccggagagaaagctctgaaacttagctggtttaagaaaggctcctctattgggaagatgttcgaagccaccgctagaggcgcccgccggatggcgatcctcggagacacagcctgggattttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgacagcggatgcgttattaactggaaaggccgcgagctcaagtgtgggtccggaatctttgtgacaaatgaagtccacacctggacagagcaatataagttccaggccgactctcctaaacggctgagcgcggccattggcaaggcttgggaagagggggtgtgcggcatcagatccgccacccgcctggagaacatcatgtggaaacagatttctaacgaactcaatcatatcctgcttgagaacgatatgaagtttacggttgtggtcggagacgtggctggcattctggcccaggggaaaaagatgatccggccgcaacccatggaatacaaatatagctggaagtcctggggaaaggccaaaattatcggcgctgatgtgcagaatacaaccttcatcattgacgggcctaacacccccgagtgtcctgatgaccagagagcgtggaatatctgggaagtcgaggattacggatttggcattttcacaaccaacatctggctcaagctgcgcgacagctatacgcaggtttgcgatcaccggctgatgtctgccgctattaaagactccaaggccgtgcacgccgatatgggctactggatcgagagcgagaagaatgagacatggaaacttgctagagcctctttcatcgaagtgaagacctgtatttggcccaaatcccatacactctggagcaacggggtcctggagtctgaaatgatcattccgaagatctatggaggccctattagccaacacaattaccgccccgggtactttacccagacagcgggaccttggcatctgggcaaactcgagctggacttcgatctttgcgaggggaccacggtggttgtggacgaacactgcggaaaccggggcccctccctgagaaccacaaccgtcacaggcaagatcatccacgagtggtgttgccggagctgtaccctccctcccctgcgctttaaaggggaagacggatgctggtatggcatggagattagaccggtgaaggagaaggaagagaatctggttaaatctatggtgtccgctgggagcggagaagtcgattccttctctcttggcctcctgtgtatcagcattatgacggaggaagtgatgcggtccagatggtctcgcaagatgctgatgacagggaccctcgccgtctttttcctgcttatcatgggacagctgacatggaacgacctcattcggctgtgcatcatggtgggcgccaatgctagcgatagaatgggcatggggaccacctacctggcccttatggcgacatttaaaatgcgccctatgttcgctgtcggactgctctttagacggctgacgtcccgcgaggtgctcctgcttaccattggcctgtctctcgtggccagcgtcgagctgcccaactccctggaagaacttggggacggactggccatgggcatcatgatcctcaagctgctcacagatttccaaagccatcagctgtgggctacccttctgtctctcacatttattaaaaccacgttctccctgcactatgcctggaagacaatggctatggttctgagcatcgtgtctctttttcccctgtgtctctccaccaccagccagaagacaacctggctgcctgtgctcctggggtctcttggatgcaaaccgctgacaatgttcctgattgccgaaaataagatctggggcagaaaatcctggcccctcaacgagggcattatggcggtcgggatcgtgagcatcctgctttccagcctgctcaagaacgacgttcctctggccggacccctcattgctggcgggatgctgatcgcctgttacgtgatttctggaagctccgctgatctttctctggaaaaagccgccgaggtcagctgggaggaagaggctgaacattccggcgcgtctcacaatatcctggtggaggttcaggacgatgggacgatgaagattaaagacgaagaacgggatgacaccctcacaatcctgcttaaggccaccctgctcgctgtgagcggagtctatcctctgtccatccccgccacactcttcgtgtggtacttttggcaaaagaaaaagcagcgctctggcgtcctgtgggataccccttcccctcccgaggtggaaagagccgttcttgacgacggcatttatcggatcatgcagcgcgggctgctgggaagatcccaggtgggcgtcggggtgttccaagagaacgtttttcatacgatgtggcacgtgacccggggagctgtcctcatgtaccagggcaaacgcctggaacccagctgggcctctgtgaagaaagatcttatttcctacgggggaggctggagactgcagggcagctggaatacaggggaggaggtgcaggttatcgcggtcgaacccggaaagaaccctaagaatgtgcaaaccgctcccggcacattcaaaacctctgagggggaagtgggagccattgccctcgactttaagccgggcacatccgggagccctatcgtcaaccgggagggaaaaattgtgggcctgtatggcaatggggttgtgacgacctccggaacatacgtctctgctatcgcccaggcgaaggctagccaggaaggccccctccctgagatcgaggatgaagtgttcagaaaacgcaacctgaccattatggaccttcaccccgggtccggaaagacccggagatatctgcccgccatcgttcgcgaggccattaagcggaaactgagaacactcatcctggctcctacgcgcgtggtcgccagcgaaatggctgaggcccttaagggcatgccgattcggtaccaaaccacagcggtgaaatctgaacataccgggaaggagatcgttgatctgatgtgccacgccacatttaccatgagactcctgtcccccgtgcgcgtccctaattataacatgatcattatggacgaggctcatttcacggatcccagctctatcgccgctcggggctacattagcacaagagtgggaatgggcgaagccgccgctatctttatgaccgcgacccctcccgggtccgtggaggccttccctcagtctaatgctgtcattcaggacgaggaacgggatatcccggaacgcagctggaactccggatatgagtggatcacagactttcccggcaaaaccgtttggttcgtgccttctattaagagcgggaatgatatcgccaactgtctgagaaagaatggaaaacgggtgattcagctctcccgcaagacattcgacaccgagtaccagaagacgaagaacaacgactgggattacgtcgtgacaaccgacatcagcgaaatgggcgccaattttagagctgatcgggttattgaccccagacgctgccttaaacctgtgatcctgaaggatgggcccgagcgggtcattctggccggcccgatgcctgtgacagttgcgtctgctgcccagagacgcggacggatcggcagaaaccacaataaggaaggggaccagtatgtgtacatgggacagcccctcaacaatgatgaggaccatgcccactggaccgaggctaaaatgctgcttgataacatcaatacgcccgaaggcattatccctgccctgttcgagcccgaacgcgagaagtccgcggccattgacggggaatatcggctcagaggagaggctcgcaaaacctttgtcgagctgatgagacggggcgatctgcctgtgtggctcagctacaaggtcgcctccgaagggttccaatattctgaccgcagatggtgctttgatggcgagcggaacaatcaggtgcttgaagagaacatggacgttgaaatctggacaaaagagggagagcgcaagaaactgagaccgcggtggctggacgctagaacctacagcgatcccctcgccctgcgcgagttcaaggagtttgctgccggccggagatccgtgtctggggaccttattctggaaatcggaaagctccctcagcacctgacacagcgcgcgcaaaatgccctggataacctcgtgatgcttcataatagcgagcagggcgggcgggcttatagacacgccatggaggaactgcccgacaccatcgagacactgatgctcctggctcttattgccgtcctgaccggaggcgttacgctgttctttctgtccggccgggggctgggaaaaacaagcatcggcctcctttgtgtgatggcctcttccgtgctgctgtggatggctagcgtcgaacctcattggattgcggcctctatcattctcgagttctttctgatggtgcttctgatccccgaaccggatcgccagagaacccctcaggacaaccaactcgcttacgttgtgatcgggctgctgttcatgattctcaccgtcgccgccaatgagatgggacttctggagacaaccaagaaagatctgggcatcgggcacgtggctgtcgaaaaccaccatcacgccgcgatgctcgacgtggatctgcatcccgcctccgcttggacactttacgccgttgctacgaccattatcacacctatgatgcggcacaccattgagaacacaaccgccaatatcagcctgacggcgattgccaaccaggctgccatcctcatgggactggacaagggctggcccatctctaaaatggatattggcgtgcctctgctcgctcttgggtgctatagccaggtcaatcccctgaccctgacagccgctgtgctcatgctggttgcccattacgcgatcattggaccgggccttcaagccaaggctacccgcgaagcccagaagagaacagctgccgggatcatgaaaaaccctaccgtggacggaattgtcgccatcgatctggaccccgtggtgtatgacgcgaagtttgagaaacagctcggccagatcatgctgctgattctctgtacgtcccaaatccttctgatgcggacaacctgggctctgtgcgaatctattacactcgccaccgggcccctgaccacactttgggagggaagccctggcaagttctggaatacgaccatcgctgtttccatggccaacattttccgcggcagctacctggccggggctggactcgccttttccctgatgaaatctctgggcgggggaagacggggcacaggggcgcagggagagaccctcggcgaaaagtggaagcgccagcttaatcagctgagcaaatccgagttcaacacatataagagatctggcatcatggaagtcgatcggagcgaggccaaagaagggctgaagagaggagagaccacgaaacacgctgtgtcccgcggcacagccaagctccggtggtttgtggagagaaatctggtcaagccggaagggaaagttatcgaccttggatgtggccgcgggggatggtcttactattgcgctggcctgaagaaagtgaccgaggtgaagggctacaccaaagggggacccggccacgaggaacctattcccatggccacatacgggtggaacctcgtcaagctgcatagcggaaaagatgtgttctttatccctcccgaaaagtgtgacaccctgctctgcgatattggcgagtccagccctaatccgacaatcgaggaagggcggacgcttagagttctgaagatggtggagccctggctgcgcggaaaccaattctgtattaaaatcctcaatccttatatgccctctgtcgtggaaaccctggagcagatgcagcggaagcacggcggcatgcttgttagaaaccctctgtcccgcaatagcacacatgagatgtactgggtgtcttgcgggaccggaaacattgtctccgcggtgaatatgacaagccggatgctcctgaacagatttaccatggcccaccgcaaacccacgtatgaacgggacgtggatctgggcgctgggaccagacacgtcgccgttgagccggaagtggctaacctcgacatcatcggacagcgcattgagaatatcaagcatgaacacaaatctacatggcattacgatgaggacaacccttataagacctgggcctaccacggctcctatgaggtgaagcccagcgggtccgctagctctatggtcaatggagtggttaaactgcttacaaagccctgggatgtgattcctatggtcacccaaatcgccatgacagacaccacgcccttcggccagcagagagtgtttaaagaaaaggttgacacacggacccctaaagcgaagcgcggcaccgcccaaattatggaggtgacagctaagtggctgtgggggttcctcagcagaaacaaaaagccgcggatctgtacgagagaagagtttacccggaaagtccgctccaatgccgctatcggagccgtgttcgttgatgaaaaccagtggaactctgccaaggaggcggtggaggacgaaagattttgggatctggtccatcgggagcgcgaacttcacaaacagggcaagtgcgctacatgcgtgtacaacatgatggggaagagagagaaaaagctgggagagttcggcaaagccaaggggagccgggccatttggtacatgtggctcggcgctcgcttcctggagtttgaggccctgggattcatgaatgaagaccactggttttccagagagaactctctcagcggcgtcgaaggggagggactgcataaacttggctatatcctgcgggatatttccaagatccccgggggaaatatgtacgctgacgataccgccggctgggacacacgcattaccgaggatgacctccagaacgaagcgaaaatcacagatatcatggagcctgaacacgccctgcttgctaagtctattttcaagctgacctatcaaaataaagtggttagagtgcagcggcccgccaagaacgggacggtcatggacgtgatcagccgcagagatcagcggggctccggacaggtgggcacctacgggctcaatacatttaccaacatggaggctcaactgattcgccagatggaaagcgagggaatcttctctccttccgagctggaaacacccaacctcgccggcagagttctggactggcttgagaaacatggggtggaacggctgaagagaatggcgattagcggagacgattgtgtcgtgaaaccgatcgacgatcgctttgccaccgctctcacggccctgaatgacatgggcaaggttcggaaggatatccctcagtgggagccctctaaagggtggaacgactggcagcaagtgcctttctgctcccaccactttcatcagcttattatgaaggatggcagagaaatcgtcgtgccctgtcgcaatcaggacgagctggtcggacgggctagagtgagccagggcgccgggtggtccctccgcgagacagcttgcctgggaaaatcttatgcccaaatgtggcagctgatgtacttccaccggagagatctccgcctggcggccaacgctatttgtagcgccgttcctgtggactgggtccccacctcccggacaacctggagcatccatgcccaccatcagtggatgacgaccgaagatatgctttctgtgtggaatagagtttggattgaggaaaacccgtggatggaggacaagacacacatctccagctggggcgacgtgccttatctggggaaacgcgaagatcaatggtgcggatctctcattggcctgaccgctcgggccacatgggcgaccaatatccaggtcgctatcaaccaggtgagacggcttattgggaatgagaactacctggactacatgacaagcatgaagagatttaagaatgagtccgatcccgaaggcgccctctggtga

SEQ ID NO: 19058 - RNA, 9879 nt, synthetic construct
  misc_feature 1..9879: note = derived and/or modified CDS sequence (opt5) from DENV-1__GQ199816__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaaatctctcctgtttaagacaagcgccggcgttaacatgtgcacccttattgccatggacctgggggagttctgtgaagatacaatgacctacaaatgcccccgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagtacgaaaaccttaagtattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgttcccccagaaccggcctggactttaacgaaatggtgctcctgacgatgaaagagaaggcttggcttgtccataaacagtggttcctggatctccctctgccctggacaagcggggcgtccacctctcaagagacatggaatcggaaggaccttctggtgacctttaagaccgcccacgctaaaaagcaggaagtcgtggttctcggaagccaggagggcgccatgcacacagccctgacgggggctaccgaaatccaaacatccggaaccacaaccattttcgccggccatctgaaatgccgcctcaagatggataaactgacgcttaaggggatgagctatgtgatgtgtacaggctctttcaagctggagaaagaagtcgcggagacccagcacggaaccgtgctcgttcagatcaagtacgagggcacagacgctccgtgcaaaattcctttttccacccaggatgaaaagggggtgacacaaaacggaagactgatcacggccaatcccatcgtcaccgacaaagagaagcctgtgaacattgaagccgagccgcccttcggcgagagctatatcgtgattggggctggagaaaaggccctgaaactttcttggtttaagaaaggcagctccatcgggaagatgttcgaggctacagcccggggcgcgagacgcatggccattctcggagataccgcttgggactttggctctatcgggggagttttcacaagcgtcggcaaactggtgcatcagatctttgggaccgcctacggagtgctgttctccggcgtcagctggacgatgaagattgggatcggcgtgctcctgacctggcttggactcaattctcggtccacaagcctctctatgacctgtattgctgttggcctggtgacactgtaccttggggtcatggtgcaggccgattccggatgcgttatcaactggaagggcagagaactcaaatgtgggagcggaatttttgtgaccaatgaggtccacacatggaccgaacagtataagttccaagcggactcccctaaacgcctgtctgccgctatcggcaaggcctgggaggagggggtgtgcggcattcggagcgctacgagactggaaaacatcatgtggaaacagatctccaacgagctcaatcatattctgcttgaaaacgacatgaagtttacagttgtggtcggagatgtggccggcatcctggcccaggggaaaaagatgattcgcccgcagcccatggagtacaagtattcttggaaaagctggggaaaggctaaaatcattggcgcggacgtgcaaaatgccaccttcatcatcgatgggcctaacacccccgaatgtcctgacgatcagcgggcttggaatatttgggaggtcgaggactacggatttggcatcttcacaaccaacatttggctcaagctgagagattcctatacgcaggtttgcgaccaccgcctgatgagcgccgccatcaaagattctaaggctgtgcacgccgacatgggctactggattgaatccgagaagaatgaaacatggaaacttgcgcgggctagcttcatcgaggtgaagacctgtatctggcccaaatctcatacactctggtccaacggggtcctggaaagcgagatgattatcccgaagatttatggaggccctatctctcagcacaattacagacccgggtactttacccaaacagccggaccttggcatctgggcaaactcgagctggatttcgacctttgcgaagggaccacggtggttgtggatgagcactgcggaaaccgcggccccagcctgcggaccacaaccgtcacaggcaagattatccacgaatggtgttgcagatcctgtaccctccctcccctgcggtttaagggggaggacggatgctggtatggcatggagatccgcccggtgaaagaaaaggaggaaaatctggttaaaagcatggtgtctgccgggtccggagaggtcgacagcttctcccttggcctcctgtgtatttctatcatgattgaagaggtgatgagaagccggtggtccagaaagatgctgatgacggggatcctcgctgtctttttcctgcttattatgggacagctgacatggaacgatctcatccgcctgtgcattatggtgggcgccaatgcgtctgaccggatgggcatggggaccacatacctggctcttatggccacctttaaaatgagacctatgttcgccgtcggactgctctttcgcagactgaccagccgggaggtgctcctgcttacaatcggcctgtccctcgtggcttctgtcgaactgcccaacagcctggaggaacttggggatggactggccatgggcatcatgattctcaagctgctcacggacttccagtcccatcaactgtgggctacccttctgagcctcacatttatcaagaccacattctctctgcactatgcctggaaaaccatggcgatggttctgtccattgtgagcctttttcccctgtgtctctctacgacatcccagaagaccacctggctgcctgtgctcctggggagccttggatgcaaaccgctgacaatgttcctgatcgccgagaataagatttggggccgcaaatcttggcccctcaacgaaggcatcatggctgtcgggatcgtgtccattctgcttagctccctgctcaagaacgatgttcctctggccggacccctcatcgctggcgggatgctgattgcctgttacgtgatcagcggatctagcgccgacctttccctggagaaagctgcggaggtctcttgggaagaggaagccgagcatagcggcgcttcccacaatattctggtggaagttcaggatgacgggaccatgaagatcaaggatgaggagagagacgatacactcacgatcctgcttaaagccaccctgctcgccgtgtctggagtctatcctctgagcattcccgctacactcttcgtgtggtacttttggcagaagaaaaagcaacggtccggcgtcctgtgggacaccccttctcccccggaagtggagcgcgccgttcttgatgacggcatctatagaattatgcagcgggggctgctgggacgcagccaggtgggcgtcggggtgttccaggaaaacgtttttcatacaatgtggcacgtgaccagaggagcggtcctcatgtaccaaggcaaacggctggagccttcctgggctagcgtgaagaaggaccttatctcttacgggggaggctggcgcctgcagggctcctggaatacgggggaggaagtgcaggttattgccgtcgagcccggcaaaaatcctaagaatgtgcagaccgcccccggcacattcaaaaccagcgaaggggaggtgggagctatcgccctcgattttaagccgggcacatctgggtcccctattgtcaacagagaaggaaaaatcgtgggcctgtatggcaatggggttgtgaccacaagcggaacgtacgtctccgcgatcgctcaagccaaggcctctcaggagggccccctccctgagattgaagacgaggtgttccggaagagaaacctgaccatcatggatcttcaccccgggagcggaaaaacacgccggtatctgcccgctattgttagagaagccatcaagcgcaaactgcggaccctcattctggctcctaccagagtggtcgcctccgagatggcggaagcccttaagggcatgccgatccgctaccagacaacggctgtgaaaagcgagcataccgggaaggagatcgttgacctgatgtgccacgccacatttaccatgcggctcctgtctcccgtgagagtccctaattataacatgattatcatggatgaagctcatttcacagacccctccagcattgccgcccgcggctacatctctacccgggtgggaatgggcgaggctgcggccatttttatgacggctacacctcccgggagcgtggaagccttccctcaatccaatgccgtcatccaggatgaggaaagagacatcccggagcggtcttggaacagcggatatgagtggattaccgattttcccggcaagaccgtttggttcgtgccttccatcaaatctgggaatgacattgctaactgtctgcgcaagaatggaaaaagagtgatccagctcagccggaagacattcgataccgaataccagaaaacaaagaacaacgactgggactacgtcgtgaccacggatatttccgagatgggcgccaattttcgcgcggacagagttatcgatccccggagatgccttaagcctgtgattctgaaagacgggcccgaacgcgtcatcctggctggcccgatgcctgtgacagttgccagcgccgctcaacggagaggacgcatcggccggaaccacaataaggagggggatcagtatatttacatgggacagcccctcaacaatgacgaggatcatgcccactggaccgaagcgaaaatgctgcttgacaacatcaatacacccgagggcattatccctgccctgttcgaacccgagagagaaaagtctgctgccattgatggggagtatcgcctccggggagaggctagaaaaacctttgtggaactgatgcgcagaggcgacctgcctgtctggctctcctacaaggtggccagcgaggggttccagtattccgatcggcgctggtgctttgacggcgaaagaaacaatcaagtccttgaggaaaacatggatgtggagatctggacgaaagagggagaacggaagaagctgcgcccgagatggctggacgctcggacctactctgaccccctcgccctgagagagttcaaagaatttgcggccggccgccggagcgtttccggggatcttatcctggagattggaaagctccctcagcacctgacacagagagctcagaatgccctggacaacctcgtgatgcttcataattctgaacaaggcgggcgcgcttatcggcacgccatggaggagctgcccgataccatcgaaacactgatgctcctggcccttattgctgtgctgaccggaggcgtcacactcttctttctgagcggcagagggctgggaaaaacctccatcggcctcctttgtgttatggcgagctctgtgctgctgtggatggcctccgtggagcctcattggattgctgccagcatcatcctcgagttctttctgatggtccttctgattcccgagccggaccggcagcgcacgcctcaggataaccagctcgcctacgtggttatcgggctgctgttcatgattctcacagtggctgccaatgagatgggacttctggaaaccaccaagaaagacctgggcatcgggcacgtcgcggtggagaaccaccatcacgccgctatgctcgatgtcgacctgcatcccgcctctgcttggacactttacgccgtggcgaccacaattatcacgcctatgatgagacacaccattgaaaacacaaccgccaatatctccctgacagctatcgccaaccaagctgccattctcatgggactggataagggctggcccatcagcaagatggacattggcgttcctctgctcgctcttgggtgctattctcaggtgaatcccctgaccctgacggccgcggtcctcatgctggtggcccattacgctatcattggaccgggccttcaggccaaagctacccgggaggcccaaaagcgcacagccgcggggatcatgaaaaaccctaccgttgatggaatcgtggctattgacctggatcccgtcgtgtatgacacaaagtttgaaaaacagctcggccagatcatgctgctgattctctgtaccagccagatccttctgatgagaacgacatgggccctgtgcgagtccattaccctcgctacagggcccctgaccaccctttgggagggatctcctggcaagttctggaatacaacgatcgccgtgagcatggccaacatcttccggggctcctacctggctggggccggactcgcgtttagcctgatgaagtccctgggcgggggacgcagaggcaccggggcccaaggagaaacactcggcgagaaatggaagcggcagcttaatcagctgtctaaaagcgagttcaacacctataagcgctccggcattatggaggttgacagatctgaagctaaagaggggctgaagcggggagagacaaccaagcacgccgtcagcagaggcacggctaaactccgctggtttgtggaacggaatctggtgaagccggaggggaaagtcatcgatcttggatgtggcagagggggatggtcctactattgcgccggcctgaagaaagttacagaagtgaagggctacaccaaagggggacccggccacgaggaacctattcccatggcgacctacgggtggaacctcgtgaagctgcattctggaaaggacgtcttctttatccctcccgagaaatgtgatacactgctctgcgacattggcgagagctcccctaatccgaccatcgaagaggggcgcacacttcgggtgctgaagatggttgaaccctggctgagaggaaaccagttctgtattaaaatcctcaatccttatatgcccagcgtggtcgagacgctggagcaaatgcagcgcaagcacggcggcatgcttgtgcggaaccctctgtctagaaattccacccatgaaatgtactgggttagctgcgggacaggaaacatcgtgtctgccgtcaatatgacctcccgcatgctcctgaaccggtttacaatggctcacagaaaacccacctatgagcgcgatgtggacctgggcgccgggacgcggcacgtggctgtcgaaccggaggttgccaacctcgatattatcggacagagaattgaaaatatcaagcatgagcacaagagcacctggcattacgacgaggataacccttataaaacatgggcttaccacggctcttatgaagtgaagccctccgggagcgcctccagcatggtgaatggagtcgtgaaactgcttaccaagccctgggacgttattcctatggtgacacagatcgcgatgaccgatacaacccccttcggccaacagcgcgtctttaaagagaaggtggacacgagaacacctaaggccaaacggggcaccgctcagatcatggaagttaccgccaagtggctgtgggggttcctctctcgcaacaaaaagccgagaatttgtacacgggaggaatttacgagaaaagtgcggagcaatgctgccatcggagccgtcttcgtggacgagaaccaatggaactccgcgaaggaggctgttgaagatgagcgcttttgggacctggtgcatagagaacgggagcttcacaagcagggcaaatgcgcgacctgcgtctacaacatgatggggaagcgcgagaaaaagctgggagagttcggcaaagccaaggggtctagagctatttggtacatgtggctcggcgcccggttcctggagtttgaagctctgggattcatgaatgaggatcactggtttagccgcgaaaactccctctctggcgtggagggggagggactgcataaacttggctatatcctgagagacattagcaagatccccgggggaaatatgtacgccgatgacacagcgggctgggatacccggatcacagaagacgatctccagaacgaggccaagattaccgacatcatggaacctgagcacgctctgcttgccaaatccattttcaagctgacatatcagaataaagtcgtgcgcgttcaaagacccgctaagaacgggaccgtgatggatgtcatctctcggcgcgaccagagaggcagcggacaggtgggcacgtacgggctcaatacctttacaaacatggaagcccagctgattcggcaaatggagtccgagggaatcttcagcccttctgaactggagacccccaacctcgcgggccgcgtgctggattggcttgaaaaacatggggttgagagactgaagcggatggccatctccggagacgactgtgtggtcaagccgattgatgacagatttgctacagccctcaccgctctgaatgatatgggcaaagtgcgcaaggacatccctcagtgggaacccagcaaagggtggaacgattggcagcaggttcctttctgctctcaccactttcatcaacttattatgaaggacggccgggagatcgtggtcccctgtagaaatcaggatgagctggtgggacgcgcccgggtctcccagggcgctgggtggagcctcagagaaacggcctgcctgggaaaatcctatgcgcagatgtggcaactgatgtacttccaccgccgggacctcagactggccgctaacgccatttgttctgccgtgcctgttgattgggtgcccacaagccgcaccacatggtccatccatgctcaccatcagtggatgaccacggaggacatgcttagcgtctggaatcgggtgtggattgaagagaacccgtggatggaagataagacccacatctcttcctggggcgacgttccttatctggggaagagagaggaccagtggtgcggaagcctcatcggcctgacagcccgcgcgacctgggctacaaatattcaagtggccatcaaccaggtccggagacttattgggaatgagaactacctggattacatgacctctatgaaacggtttaagaatgaaatcgaccccgagggcgccctctggtga

SEQ ID NO: 19059 - RNA, 9879 nt, synthetic construct
  misc_feature 1..9879: note = derived and/or modified CDS sequence (opt5) from DENV-1__GQ199817__SS-prME
  source 1..9879: mol_type = other RNA
agcgtgaccatgctgctgatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcatcagaacaaccttttccctgcactatgcctggaaaacgatggctatggttcttagcattgtgtctctgatccccctctgtctgtccacaaccagccagaagaccacatggctccctgtgctgcttgggtctctgggatgcaagccgctgaccatgttcctcattgccgagaataaaatctggggccggaagtcctggcccctgaacgaaggcatcatggcggtcgggattgtgagcatccttctgtccagcctcctgaaaaacgatgttcctctcgccggacccctgattgctggcgggatgcttatcgcctgttacgtgatttctggaagctccgctgacctgtctctggagaaggccgccgaggtcagctgggaagaggaagctgagcattccggcgcgtctcacaatatcctcgtggaagttcaggatgacgggacaatgaaaatcaaggatgaggagcgcgacgatacgctgaccattcttctgaaagccacactcctggctgtgagcggagtctatcctctctccatccccgccaccctgtttgtgtggtgcttctggcaaaagaagaaacagagatctggcgtcctttgggacacaccttcccctcccgaagtggagcgggccgttctggatgacggcatttaccgcatcatgcagagagggctgctcggacggtcccaggtgggcgtcggggtgttccaagaaaacgtttttcataccatgtggcacgtgacgcgcggagctgtcctgatgtatcagggcaagagacttgagcccagctgggcctctgtgaaaaaggacctgatttcctacgggggaggctggcggctccagggcagctggaataccggggaggaagtgcaggttatcgcggtcgagcccggcaagaatcctaagaatgtgcaaacagctcccggcaccttcaagacatctgaaggggaggtgggagccattgccctggattttaaaccgggcacctccgggagccctatcgtcaacagagaaggaaagatcgtgggcctctacggcaatggggttgtgacaacgtccggaacctatgtctctgctattgcccaggcgaaagctagccaggagggccccctgcctgagatcgaagacgaggtgttccgcaagcggaaccttacaattatggatctgcaccccgggtccggaaaaaccagacgctacctgcccgccatcgttcgggaagccattaagagacgcctccggaccctgatccttgctcctacaagagtggtcgccagcgagatggctgaagccctgaagggcatgccgatccgctatcaaacgaccgcggtgaaatctgagcatacagggaaggagattgttgacctcatgtgtcacgccacctttacaatgcggctgctgtcccccgtgagagtccctaattacaacatgatcattatggatgaagctcatttcaccgaccccagctctatcgccgctcggggctatattagcacgcgcgtgggaatgggcgaggccgccgctatctttatgacagcgacccctcccgggtccgtggaagccttccctcagtctaatgctgtcatccaggatgaggaaagagacattccggagcggagctggaactccggatacgagtggatcaccgattttcccggcaaaacagtttggttcgtgccttctattaagagcgggaatgacatcgccaactgcctccgcaaaaatggaaagagagtgattcagctttcccggaagacctttgatacagaatatcagaagaccaagaacaacgactgggactacgtcgtgacgacagatatcagcgagatgggcgccaatttcagagctgaccgcgttattgatccccggagatgcctgaaacctgtgatcctgaaggacgggcccgaacgcgtcatcctcgccggcccgatgcctgtgaccgttgcgtctgctgcccagcggagaggacgcattggccggaaccacaataaagagggggatcagtacatctatatgggacagcccctgaacaatgacgaggatcatgcccactggacagaagctaagatgcttctggacaacattaatacccccgagggcatcattcctgccctcttcgaacccgagagagaaaagtccgcggccatcgatggggagtaccgcctgagaggagaggctcggaaaacgtttgtggaactgatgcgcagaggcgacctccctgtctggcttagctataaggtggcctccgaggggttccaatactctgatcggcgctggtgttttgacggcgaaagaaacaatcaggtcctggaggaaaacatggatgtggagatctggaccaaagagggagaacggaagaaactgagaccgcgctggctcgacgctcggacatatagcgaccccctggcccttagagagttcaaggaatttgctgccggccgccggtccgtttctggggatctgattctcgagatcggaaaactgcctcagcacctgacccagagagcgcaaaatgccctcgacaaccttgtgatgctgcataatagcgaacagggcgggcgggcttaccgccacgccatggaggagctgcccgatacaattgaaaccctcatgctgcttgctctgatcgccgtgctcacaggaggcgtcaccctgttcctgctctccggcagagggcttggaaagacgagcattggcctgctgtgcgttatggcctcttccgtgctcctgtggatggctagcgtggagcctcattggatcgcggcctctatcattcttgaatttttcctgatggtcctcctgatccccgagccggaccggcagcgcacacctcaggataaccaactggcttatgtggttattgggctcctttttatgatcctgaccgtggccgccaatgagatgggactgctcgaaaccacaaagaaagacctgggcattgggcacgtcgctgtggagaaccaccatcacgccgcgatgcttgatgtcgacctgcatcccgcctccgcttggaccctctacgccgtggctacaacgatcattacccctatgatgagacacacaatcgaaaacaccacagccaatatcagcctgaccgcgattgccaaccaggctgccatcctgatgggactcgataagggctggcccatttctaaaatggacatcggcgttcctcttctggctctggggtgttacagccaggtgaatcccctcacgctgaccgccgctgtccttatgctggtggcccattatgcgattatcggaccgggcctccaagccaaggctacacgggaggcccagaaacgcaccgctgccgggatcatgaagaaccctacagttgatggaattgtggccatcgacctggatcccgtcgtgtacgacgcgaagttcgaaaaacagctgggccagattatgctccttatcctgtgcacctcccaaattctgctcatgagaacgacatgggctctgtgtgagtctatcacccttgccacagggcccctgaccaccctctgggagggaagccctggcaagttttggaatacaacgatcgctgtgtccatggccaacattttccggggcagctatctggccggggctggactggccttttccctcatgaaatctcttggcgggggacgcagaggcaccggggcgcagggagaaacactgggcgagaagtggaaacggcagctgaatcagctcagcaagtccgagttcaacacctacaagagatctggcatcatggaggttgaccgcagcgaagccaaagaggggctgaagcggggagagacaaccaaacacgctgtctccagaggcacggccaaacttcgctggttcgtggaacggaatctggtgaaaccggaggggaaggtcattgatctcggatgcggcagagggggatggtcttattactgtgctggcctgaagaaagttacagaagtgaagggctataccaaagggggacccggccacgaggaacctatccccatggccacctacgggtggaacctggtgaagctccatagcggaaaagacgtctttttcattcctcccgagaagtgcgatacacttctgtgtgacatcggcgagtccagccctaatccgaccattgaagaggggcgcacactgcgggtgctcaaaatggttgaaccctggctgagaggaaaccaattttgcatcaagatccttaatccttacatgccctctgtggtcgagacgctggagcagatgcagcgcaagcacggcggcatgctcgtgcggaaccctctgtccagaaatagcacccatgaaatgtattgggtttcttgtgggacaggaaacattgtgtccgcggtcaatatgaccagccgcatgctgctcaaccggttcacaatggcccacagaaaacccacctacgagcgcgatgtggacctgggcgctgggacgagacacgtggccgtcgaaccggaggttgctaaccttgatatcattggacagcggatcgaaaatattaagcatgagcacaaatctacctggcattatgacgaggataacccttacaagacatgggcctatcacggctcctacgaagtgaaacccagcgggtccgctagctctatggtgaatggagtcgtgaagctgctcaccaagccctgggacgttatccctatggtgacacaaatcgccatgaccgatacaaccccctttggccagcagcgcgtcttcaaagagaaggtggacacgagaacacctaaagcgaagcggggcaccgcccaaattatggaagttaccgctaaatggctgtgggggtttcttagcagaaacaagaagccgcggatctgcacacgcgaggagttcacgagaaaagtgcggtccaatgccgctattggagccgtctttgtggacgagaaccagtggaactctgccaaggaggcggttgaagatgagcgcttctgggacctggtgcatagagaacgggagctccacaaacagggcaagtgcgctacctgtgtctataacatgatggggaaacgcgaaaagaagctgggagagtttggcaaagccaaggggagcagagccatctggtacatgtggctgggcgctcggttcctcgagtttgaagccctgggattcatgaatgaggatcactggttctcccgcgaaaactctcttagcggcgtggagggggagggactgcataaactcggctacattctgagagacatctccaagatccccgggggaaatatgtatgctgatgacacagccggctgggatacccggattacagaagacgatcttcagaacgaggcgaaaatcaccgacattatggaacctgagcacgccctgctcgctaagtctatctttaaactgacataccaaaataaggtcgtgcgcgttcagagacccgccaagaacgggaccgtgatggatgtcattagccggcgcgaccagagaggctccggacaggtgggcacgtatgggctgaataccttcacaaacatggaagctcaactcatccggcagatggagagcgagggaatcttttctccttccgaactggagacccccaaccttgccggcagagtgctggattggctcgaaaaacatggggttgagcgcctgaagcggatggcgattagcggagacgactgcgtggtcaaaccgatcgatgacagattcgccacagctcttaccgccctgaatgatatgggcaaggtgcgcaaagacattcctcagtgggaaccctctaaggggtggaacgattggcagcaagttcctttttgttcccaccacttccatcagctcatcatgaaggacggccgggagattgtggtcccctgcagaaatcaggatgagctggtgggacgcgctcgggtcagccagggcgccgggtggtccctgagagaaacggcttgtctcggaaaatcttacgcccaaatgtggcagctgatgtattttcaccgccgggaccttagactggcggccaacgctatctgcagcgccgtgcctgttgattgggtgcccacatcccgcaccacatggagcattcatgcccaccatcagtggatgaccacggaggacatgctctctgtctggaatcgggtgtggatcgaagagaacccgtggatggaagataagacccacgtttccagctggggcgacgtgccttacctggggaaaagagaggaccaatggtgtggatctcttatcggcctgacagctcgggccacctgggcgacaaatattcaggtcgctatcaaccaggtgagacgcctcctggggaatgagaactatctggattacatgaccagcatgaagcggttcaaaaatgaatccgaccccgagggcgccctctggtga

SEQ ID NO: 19060 - RNA, 9879 nt, synthetic construct
  misc_feature 1..9879: note = derived and/or modified CDS sequence (opt5) from DENV-1__FJ882550__SS-prME
  source 1..9879: mol_type = other RNA
agcgtgaccatgctgctcatgctgatgcccaccgcccttgctttccacctgacgacccggggcggggaacctcatatgatcgtgaccaagcaggaacggggaaaatccctcctgtttaagacctctgccggcgttaacatgtgcacccttattgccatggacctgggggaactctgtgaagataccatgacgtacaaatgcccccgcatcaccgaagctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaatgaccacaatctttgctggccatctcaaatgcagactgaagatggataaacttaccctgaaggggatgagctatgttatgtgtacgggctctttcaaactcgagaaggaagtggccgagacacagcacggaaccgtcctggtgcagattaagtacgagggcaccgacgcgccgtgcaaaatccctttctccacacaagatgaaaagggggttacccagaacggacggctgatcacagctaatcccattgtgacggacaaagagaagcctgtcaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctgtcgggggagtttttaccagcgtcggcaaactggtgcatcagatcttcgggacagcttacggagtgctcttttccggcgtcagctggaccatgaagattgggatcggcgtgctgcttacgtggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacaaatgaggtccacacctggacagaacaatataagtttcaggccgactcccctaaacggctgtctgcggccatcggcaaggcttgggaggagggggtgtgcggcattagaagcgccacccgcctcgaaaacatcatgtggaaacagatctccaacgagctgaatcatattcttctggaaaacgacatgaagttcacggttgtggtcggagatgtggtgggcatcctcgctcaggggaaaaagatgattcggccgcaacccatggagcacaaatactcttggaaaagctggggaaaggccaagatcattggcgccgacgtccagaatacaacctttatcatcgatgggcctaacacccccgaatgtcctgacgatcagagagcttggaatatttgggaggttgaggactatggattcggcatctttacaaccaacatttggctgaagctgcgcgattcctacacacaggtgtgcgaccaccggcttatgagcgcggccatcaaagattctaaggctgtgcatgccgacatgggctattggattgaatccgagaaaaatgaaacatggaagctcgccagagctagcttcatcgaggtcaagacctgtatctggcccaaatctcacacactgtggtccaacggggtgctggaaagcgagatgattatcccgaagatttacggaggccctatctctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagattatccatgaatggtgttgccggtcctgtaccctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacggggacactggctgtgttccttctgctcatcatgggacagctgacctggaacgatctgattcggctttgcatcatggtcggcgccaatgcctctgacagaatgggcatggggacaacctatctggctctcatggccacctttaaaatgcgccctatgttcgcggtgggactgctctttagacggctgacaagccgcgaggtgcttctgctcacgattggcctgtccctggtcgcttctgttgaacttcccaacagcctggaggaactcggggatggactggccatgggcatcatgatcctcaagctgcttaccgacttccaatcccaccagctgtgggccacactcctgagcctgacctttattaaaacaaccctttctctgcattacgcttggaagacgatggccatggtgctctccatcgtgagcctgttccccctctgtctgtctacaacctcccagaagaccacatggcttcctgtcctgctggggagcctcggatgcaaaccgctgaccatgtttcttattacagagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttatgtgatcagcggatctagcgctgacctctccctggagaaagccgctgaggtttcttgggaagaggaagccgagcacagcggcgcctcccataatattcttgtggaagtccaggatgacgggacgatgaagatcaaagatgaggagcgggacgataccctgacaattctcctgaaggctaccctcctggcggtgtctggagtctaccctcttagcatccccgccacactgttcgtgtggtatttttggcaaaagaaaaagcagcgctccggcgttctgtgggacaccccttctcccccggaagtggagagagctgtcctcgatgacggcatctaccggattatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggccagcgttaagaaagacctgatctcttacgggggaggctggagactccagggctcctggaatacaggggaggaagtccaggtgattgctgtggagcccggaaagaaccctaagaatgtccaaaccgcccccggcacatttaaaaccccggaaggggaggtgggagcgatcgctctggatttcaagcctggcacaagcgggtctcccattgttaaccgggaaggaaaaatcgtgggcctttacggcaatggggtcgtgacgacctccggaacatatgttagcgccattgcccaggctaaggcctcccaggagggccctctgcccgagatcgaagacgaggtgtttagaaaacgcaacctgaccatcatggatctccatcccgggtctggaaagacccggagatacctgcctgcgattgtccgcgaagctatcaagcggaaacttagaacactgattctcgccccgacgcgcgtggttgccagcgagatggctgaagccctgaagggcatgcccatccggtatcaaaccacagctgtgaaatccgagcacaccgggaaggagattgtcgacctgatgtgccatgccacattcaccatgagactccttagccctgtgcgcgtgcccaattacaacatgatcatcatggatgaagcgcactttacggacccttcttccattgccgctcggggctatatcagcacaagagtcggaatgggcgaggccgctgccattttcatgaccgccacaccccctgggtctgttgaggcttttccgcagagcaatgcggtgatccaggatgaggaacgggacattcccgagcgctcctggaactctggatacgagtggatcacagatttccctggcaaaaccgtgtggtttgtccccagcatcaagtccgggaatgacattgccaactgtctgagaaagaatggaaaacgggtgatccagctgtctcgcaagacattcgataccgaatatcagaagacgaagaacaacgactgggactacgttgtgacaaccgatattagcgagatgggcgctaattttagagccgaccgggtcatcgatcctagacgctgcctcaaacccgtgattctgaaggacgggccggaacgggttatccttgccggccctatgcccgtgacagtcgcttccgccgcgcagagacgcggacggattggcagaaaccataataaggagggggatcagtacatctatatgggacagcccctgaacaatgacgaggatcacgctcactggaccgaagccaaaatgctcctggacaacatcaatacgcctgagggcattatccccgccctgttcgaacctgagcgcgaaaagagcgctgccattgatggggagtaccggctcagaggagaggcgcgcaaaaccttcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatctggacaaaagagggagaacgcaagaaactgagaccccggtggcttgacgctagaacctattccgaccctctggccctccgcgagtttaaggagttcgctgccggccggagatctgtgagcggggatctgattctggagatcggaaagctcccccagcatcttacacagcgcgctcaaaatgccctggacaacctggtcatgctccacaattccgaacagggcgggcgggcgtacagacatgccatggaggagctgcctgataccatcgaaacacttatgctgctcgctctgattgccgttctgaccggaggcgtgacgctctttttcctttctggccgggggctgggaaaaacaagcatcggcctgctctgtgtgatggcttccagcgtcctgctttggatggcctctgtggagccccactggattgccgcttccatcattctggaatttttcctcatggttctgctgatcccggagcctgaccgccagagaacaccccaggataaccaactcgcgtatgtggtcatcgggcttctgtttatgattctgaccgtggccgctaatgagatgggactcctggaaacaaccaagaaagaccttggcatcgggcacgtcgccgtggagaaccatcaccatgccacaatgctggatgttgacctccaccctgctagcgcctggacgctgtacgcggtggccaccacaattatcacccccatgatgcggcatacaattgaaaacaccacggctaatatctctctgaccgccattgctaaccaggccgcgatcctcatgggacttgataagggctggcctatctccaaaatggacattggcgtccccctgctggccctcgggtgctacagccaggtgaatccgctgacacttaccgctgccgttctgatgctcgtggctcactatgccatcattggacctggcctgcaagctaaggccacacgcgaggcgcagaagagaaccgccgctgggatcatgaaaaaccccacggtcgatggaattgtggccatcgacctggatcccgtggtttacgacgctaagttcgaaaaacagctcggccagatcatgcttctgattctgtgtacatctcaaatcctcctgatgcggaccacatgggccctttgcgagagcattaccctggccaccgggcctctcacaacgctgtgggagggatccccgggcaagttttggaataccacaatcgcggtctctatggctaacattttccgcggcagctatctggccggggctggactcgccttttcccttatgaaaagcctgggcgggggaagacggggcaccggggcccagggagaaacactgggcgagaagtggaagcgccagctcaatcagctgtccaaatctgagttcaacatctacaagagaagcggcatcatggaggtggaccggtccgaagctaaagaggggcttaagagaggagagaccacgcgccacgccgtgtctcggggcacagcgaaactgagatggttcgtcgaacgcaatctcgttaagcccgaggggaaggtgattgatctgggatgtggcagagggggatggagctattactgcgccggcctgaaaaaggtgaccgaagtcaaaggctataccaaagggggacctggccatgaggaacccatccctatggctacatacgggtggaacctcgtgaaacttcactccggaaaggacgtctttttcacaccccctgagaaatgtgatacactgctgtgcgacattggcgagtctagcccgaatcccacgatcgaagaggggagaaccctccgcgtgctgaagatggtcgaaccttggcttcggggaaaccaattttgtattaagatcctgaatccctacatgccttccgtggttgagacactcgagcagatgcagagaaaacatggcggcatgctggtgcgcaaccccctgagcagaaattctacccacgaaatgtattgggtctcctgcgggacaggaaacattgtgagcgccgtgaatatgacctctagaatgctcctgaaccgcttcacgatggctcaccggaagccgacctacgagagagatgtcgaccttggcgccgggacacgccatgttgcggtggaacctgaggtggccaacctggatatcatcggacagagaattgaaaatatcaaacacgagcataagtccacctggcactatgacgaggataacccctacaaaacatgggcttatcatggcagctacgaagtcaagccctctgggtccgccagctccatggtgaatggagttgtgaagctcctgaccaaaccttgggacgtcattcccatggtgacacaaatcgctatgaccgatacgacaccttttggccagcagcgggttttcaaggagaaagtggacacccgcaccccgaaggccaaaagaggcacagctcaaattatggaagtcacggcccggtggctttgggggtttctgagcagaaacaagaagccccggatctgtacccgcgaggagttcacaagaaaagtgcggtctaatgcggccatcggagctgtttttgtggacgagaaccagtggaatagcgccaaggaggctgtcgaagatgagcgcttctgggacctcgtgcagaaagaaagagagctgcacaagcagggcaaatgcgcgacctgcgtctataacatgatggggaagcgggaaaagaaactgggagagtttggcaaggccaaagggtcccgcgcgatttggtacatgtggctcggcgctagattcctggagtttgaagcccttggattcatgaatgaggatcactggttctctcgggaaaacagcctgtccggcgtggagggggagggactccataagctgggctacatccttcgcgacatttctaaaatccctgggggaaatatgtatgccgatgacacagctggctgggataccagaattacagaagacgatctgcaaaacgaggccaagatcaccgacatcatggaacccgagcacgctctcctggccacgagcatttttaaactgacctaccagaataaggttgtgcgggtccagcgccctgcgaagaacgggacagtgatggatgtgatctccagacgggaccagcgcggctctggacaagttggcacctatgggctcaatacattcaccaacatggaagcccagctgattagacagatggagagcgagggaatctttcttccctccgaactggagacgccgaacctcgctgaacgggtgctggattggcttgagaaatacggcgtcgaaagactgaagcgcatggccattagcggggacgactgtgtggttaaacctatcgatgaccggttcgctacagccctcaccgcgctgaatgatatgggaaaggtgagaaaagacatcccccagtgggagccttctaagggctggaacgattggcaacaggtccccttttgctcccatcacttccaccagctgattatgaaggacgggcgcgagatcgtggtcccttgtcggaatcaggatgaactcgtgggcagagcccgcgttagccaaggagctggctggtctctgcgggagacagcctgccttgggaaatcctatgctcagatgtggcagctgatgtactttcatagacgcgacctccggctggccgctaacgccatttgtagcgcggtgcccgtcgattgggtgccgacctccagaacgacctggtctatccacgcccatcaccaatggatgacaaccgaagacatgcttagcgtttggaatcgcgtgtggattgaggaaaacccttggatggaggataagacacatgtctccagctggggagacgtgccctatctgggcaaacgggaggaccagtggtgcgggtctctcatcggactgaccgctagagccacatgggcctccaatattcaggtggctatcaaccaggttcggagactgatcggcaatgaaaactacctcgattacatgaccagcatgaagcgcttcaaaaatgagggggaccccgaaggcgccctgtggtga

SEQ ID NO: 19061 - RNA, 9879 nt, synthetic construct
  misc_feature 1..9879: note = derived and/or modified CDS sequence (opt5) from DENV-1__FJ882551__SS-prME
  source 1..9879: mol_type = other RNA
agcgtgaccatgctgctgatgctgatgcccacagcccttgctttccacctgacgacccggggaggggagcctcatatgatcgtctccaagcaggaacggggaaagtctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctaccagccaacacaattaccgccccgggtacttcacacagaccgcgggaccttggcatctcggcaaactggagcttgattttgacctgtgcgaagggacgaccgtggttgtggatgagcactgcggaaaccggggcccctccctcagaacaaccacagtcaccggcaagattatccacgaatggtgttgccggagctgtacgctgcctcccctgcgcttcaaaggggaggacggatgctggtatggcatggagatcagaccggtgaaggaaaaggaggaaaatcttgttaaatctatggtgtccgctgggagcggagaggtcgactccttttctctcggcctgctgtgtattagcatcatgattgaagaggtgatgcggtccagatggtctcgcaagatgctcatgacagggaccctggccgttttctttcttctgatcattggacagctcacatggaacgatctgatccggctgtgcattatggtgggcgccaatgctagcgacagaatgggcatggggaccacctaccttgccctgatggcgacattcaaaatgcgccctatgtttgctgtcggactcctgttcagacggctcacgtcccgcgaggtgctgcttctgaccatcggcctctctctggtggccagcgtcgaactgcccaactcccttgaggaactgggggatggactcgccatgggcatcatgattctgaagctcctgacagactttcaaagccatcagctttgggctaccctgctctctctgacattcatcagaaccacgttttccctgcactatgcctggaaaacaatggctatggttcttagcattgtgtctctgttccccctctgtctgtccaccaccagccagaagacaacctggctccctgtgctgcttgggtctctgggatgcaagccgctgacaatgtttctcatcgccgagaataaaatttggggccggaagtcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgtcgtgagctgggaggaagaggctgaacattccggcgcgtctcacaatattctcgttgaggtgcaggatgacgggacgatgaaaatcaaggatgaagaaagagacgataccctgacaatccttctgaaagccaccctcctggctgtcagcggagtgtatcctctctccattcccgccacactgttcgtctggtacttctggcaaaagaagaaacagagatctggcgtgctttgggacaccccttcccctcccgaggttgaacgggccgtgctggatgacggcatctatcgcattatgcagagagggctgctcggacggtcccaggtcggcgtgggggtttttcaagagaacgtgttccatacgatgtggcacgtcacccgcggagctgtgctgatgtaccagggcaagagacttgaacccagctgggcctctgtgaaaaaggacctgatctcctacgggggaggctggcggctccagggcagctggaatacaggggaggaggttcaggtcattgcggtggaacccggcaagaatcctaagaatgtgcaaaccgctcccggcacatttaagacctctgagggggaagtcggagccatcgccctggatttcaaaccgggcacatccgggagccctattgtgaacagagagggaaagatcgttggcctctatggcaatggggtggtcacgacctccggaacatacgtgtctgctatcgcccaggcgaaagctagccaggaaggccccctgcctgagattgaggacgaagtttttcgcaagcggaaccttaccatcatggatctgcaccccgggtccggaaaaaccagacgctatctgcccgccattgtgcgggaggccatcaagagaaagctccgcacactgattcttgctcctacgcgggtcgtggccagcgaaatggctgaggccctgaaaggcatgccgatcagataccaaaccacagcggttaagtctgaacataccgggaaagagatcgtggacctcatgtgccacgccacattcaccatgcgcctgctgtcccccgtccgggtgcctaattataacatgattatcatggatgaggctcattttacggaccccagctctattgccgctagaggctacatcagcacacgggtgggaatgggcgaagccgccgctattttcatgaccgcgacccctcccgggtccgtcgaggcctttcctcagtctaatgctgttatccaggatgaggaacgcgacatcccggaaagaagctggaactccggatatgagtggattacagatttccccggcaagaccgtgtggtttgtgccttctatcaaaagcgggaatgacattgccaactgtctccggaagaatggaaagcgcgtcatccagctttccagaaaaacattcgataccgagtaccaaaagacgaaaaacaacgactgggactacgtggttacaaccgatattagcgaaatgggcgccaatttccgggctgacagagtgatcgatccccgccggtgcctgaagcctgtcattctgaaagacgggcccgagagagtgatcctcgccggcccgatgcctgttacagtggcgtctgctgcccagcgccggggaagaatcggccgcaaccacaataaggaaggggatcagtatatttacatgggacagcccctgaacaatgacgaggatcatgcccactggaccgaggctaagatgcttctggacaacatcaatacgcccgaaggcattatccctgccctctttgagcccgaacgggagaaatccgcggccattgatggggaatatagactgcgcggagaggctagaaagaccttcgtcgagctgatgcggcgcggcgacctccctgtgtggcttagccacaaagtcgcctccgaagggtttcaatactctgatagacggtggtgcttcgacggcgagcgcaacaatcaggtgctggaagagaacatggatgttgaaatctggacaaaggagggagagcgcaagaagctgcggccgagatggctcgacgctcgcacctatagcgaccccctggcccttcgggaatttaaagagttcgctgccggcagacgctccgtgtctggggatctgatcctcgaaattggaaagctgcctcagcatctgacacagcgggcgcaaaatgccctcgacaaccttgtgatgctgcacaatagcgagcagggcgggagagcttaccggcatgccatggaggaactgcccgataccatcgagacactcatgctgcttgctctgattgccgtcctcaccggaggcgttacgctgtttttcctgtccggccgcgggctcggaaagacaagcatcggccttctgtgtgtgatggcctcttccgtgctgctctggatggctagcgtcgaacctcactggattgcggcctctatcatcctggagtttttccttatggtgctgctcattcccgaaccggacagacagcggacccctcaggataaccaactggcttatgttgtgatcgggctgctctttatgattcttaccgtcgccgccaatgagatgggactgctggagacaaccaaaaaggacctcggcatcgggcacgtggctgtcgaaaaccatcaccatgccgcgatgctggatgtggaccttcaccccgcctccgcttggacactgtacgccgttgctacgaccattatcacacctatgatgcgccataccattgagaacacaaccgccaatatcagcctcacggcgatcgccaaccaggctgccattctgatgggactggataaaggctggcccatctctaagatggacattggcgtgcctctccttgctctggggtgctacagccaggtcaatcccctgaccctcacagccgctgtgctgatgcttgttgcccactatgcgatcattggaccgggcctgcaagccaaagctaccagagaagcccagaagcggacagctgccgggatcatgaagaaccctaccgtggatggaatcgtcgccattgacctcgatcccgtggtgtacgacgcgaaattcgagaagcagctgggccagatcatgctgctcattctttgtacgtcccaaatcctgctgatgcgcacaacctgggctctctgcgaatctattacactggccaccgggccccttaccacactgtgggagggaagccctggcaaattttggaatacgaccatcgctgtttccatggccaacatcttcagaggcagctatctcgccggggctggactggccttctccctgatgaagtctctcggcgggggacggcgcggcacaggggcgcagggagagacccttggcgaaaaatggaagagacagctgaatcagctgagcaagtccgagtttaacacatacaaacggtctggcattatggaagtcgacagaagcgaggccaaggaagggctcaaacgcggagagaccacgaagcacgctgtgtcccggggcacagccaaactgagatggttcgtggagcgcaatcttgtcaagccggaagggaaggttatcgatctgggatgtggcagagggggatggtcttattactgcgctggcctcaaaaaggtgaccgaggtgaaaggctataccaaagggggacccggccatgaggagcctattcccatggccacatacgggtggaacctggtcaaactgcacagcggaaaggacgtgtttttcatccctcccgaaaaatgtgataccctcctttgcgacattggcgagtccagccctaatccgacaatcgaggaagggagaacgctgcgcgttctgaagatggtggagccctggctccggggaaaccaattttgtattaagatcctgaatccttacatgccctctgtcgtggaaacccttgagcagatgcagagaaaacatggcggcatgctggttcgcaaccctctctcccggaatagcacacacgagatgtattgggtgtcttgcgggaccggaaacatcgtctccgcggtgaatatgacaagcagaatgctgctgaaccgcttcaccatggcccaccggaagcccacgtacgaaagagatgtggacctcggcgctgggacccgccatgtcgccgttgagccggaagtggctaacctggatattatcggacagagaattgagaatatcaaacaagaacacaagtctacatggcattatgacgaggataacccttacaaaacctgggcctatcacggctcctacgaggtgaagcccagcgggtccgctagctctatggtcaatggagtggttaaacttctgacaaaaccctgggacgtgattcctatggtcacccagatcgccatgacagataccacgccctttggccagcaacgggtgttcaaggaaaaagttgacacacgcacccctaaggcgaaaagaggcaccgcccagatcatggaggtgacagctaagtggctctgggggtttctgagccggaacaagaaaccgagaatttgtacgcgggaagagttcacccgcaaggtcagatccaatgccgctatcggagccgtgtttgttgacgaaaaccagtggaactctgccaaagaggcggtggaggatgaacggttctgggaccttgtccatcgcgagagagaactgcacaagcagggcaaatgcgctacatgcgtgtataacatgatggggaagcgggagaagaaactcggagaatttggcaaggccaaagggagccgcgccatttggtacatgtggctgggcgctagattcctggagttcgaggccctcggatttatgaatgaagatcactggttctcccgggagaactctctgagcggcgtcgaaggggagggacttcataagctgggctacatcctccgcgacatttccaaaatccccgggggaaatatgtatgctgatgacaccgccggctgggatacaagaatcaccgaggacgatctgcaaaacgaagcgaagattacagacatcatggagcctgaacacgcccttctggctaaatctatttttaagctcacctaccagaataaggtggttcgggtgcagcgccccgccaaaaacgggacggtcatggatgtgatcagcagacgggaccagcgcggctccggacaagtgggcacctatgggctgaatacattcaccaacatggaggctcagctgattagacagatggaaagcgagggaatcttttctccttccgagctcgaaacacccaacctggccggccgggttcttgattggctgaagaaacatggggtggagagactcaagcgcatggcgatcagcggagacgactgtgtcgtgaaaccgattgatgaccggttcgccaccgctctgacggcccttaatgatatgggcaaggttagaaaggacatccctcagtgggaaccctctaaagggtggaacgattggcaacaggtgcctttttgctcccaccacttccatcagctgattatgaaggacggccgcgagctcgtcgtgccctgtcggaatcaggatgaactggtcggcagagctcgcgtgagccaaggagccgggtggtccctgcgggagacagcttgcctcggaaaatcttacgcccagatgtggcagctgatgtattttcacagacgcgaccttcggctggcggccaacgctatctgtagcgccgttcctgtggattgggtccccacctccagaacaacctggagcattcatgcccaccatcaatggatgacgaccgaggacatgctctctgtgtggaatcgcgtttggatcgaagagaacccgtggatggaagataagacacacatttccagctggggcgacgtgccttacctggggaaacgggaggaccagtggtgcggatctcttatcggcctgaccgctagagccacatgggcgaccaatatccaggtcgctattaaccaggtgcggagactcctggggaatgaaaactatctggattacatgacaagcatgaagcgcttcaagaatgagtccgaccccgagggcgccctctggtga

SEQ ID NO: 19062 - RNA, 9879 nt, synthetic construct
  misc_feature 1..9879: note = derived and/or modified CDS sequence (opt5) from DENV-1__FJ882552__SS-prME
  source 1..9879: mol_type = other RNA
agcgtgaccatgctgctgatgctgatgcccaccgcccttgctttccacctgacgaccagaggcggggaacctcatatgattgtctccaagcaggaacggggaaaatctctcctgtttaagacaagcgccggcgttaacatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccaaaccggcgaacacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgtccagcctgcactatgcctggaagacaatggctatggttctgtctatcgtgtcccttttccccctgtgtctcagcaccacctctcagaaaacaacctggctgcctgtgctcctggggtcccttggatgcaagccgctgacaatgtttctgattgccgagaataaaatctggggcagaaagagctggcccctcaacgaaggcattatggcggtcgggatcgtgtccatcctgcttagctctctgctcaaaaacgatgttcctctggccggacccctcattgctggcgggatgctgatcgcctgttacgtgattagcggatcctctgctgaccttagcctggagaaggccgccgaggtctcctgggaagaggaagctgagcattctggcgcgagccacaatatcctggtggaagttcaggatgacgggacgatgaaaattaaggatgaggagcgggacgataccctcacaatcctgcttaaggccaccctgctcgctgtgtccggagtctatcctctgtctatccccgccacactcttcgtgtggtacttctggcagaaaaagaaacaacgcagcggcgtcctgtgggacacccctagccctcccgaagtggagagagccgttcttgatgacggcatttatcggatcatgcagcgcgggctgctgggaagaagccaggtgggcgtcggggtgtttcaggaaaacgttttccatacgatgtggcacgtgacccggggagctgtcctcatgtaccaaggcaagcgcctggagccctcttgggcctccgtgaaaaaggaccttattagctacgggggaggctggagactgcagggctcttggaatacaggggaggaagtgcaggttatcgcggtcgagcccggaaagaaccctaaaaatgtgcagaccgctcccggcacatttaagacctccgaaggggaggtgggagccattgccctcgatttcaaaccgggcacaagcgggtcccctatcgtcaaccgggaaggaaagattgtgggcctgtatggcaatggggttgtgacgacctctggaacatacgtcagcgctatcgcccaagcgaaggcttcccaggagggccccctccctgagatcgaagacgaggtgtttagaaagcgcaacctgaccattatggatcttcaccccgggagcggaaagacccggagatatctgcccgccatcgttcgcgaagccattaaacggaagctgagaacactcatcctggctcctacgcgcgtggtcgcctctgagatggctgaagcccttaaaggcatgccgattcggtaccagaccacagcggtgaagtccgagcataccgggaaagagatcgttgacctgatgtgccacgccacattcaccatgagactcctgagccccgtgcgcgtccctaattataacatgatcattatggatgaagctcattttacggacccctctagcatcgccgctcggggctacatttccacaagagtgggaatgggcgaggccgccgctatcttcatgaccgcgacccctcccgggtctgtggaagcctttcctcaaagcaatgctgtcattcaggatgaggaacgggacatcccggagcgctcctggaactctggatatgagtggatcacagatttccccggcaagaccgtttggtttgtgcctagcattaagtccgggaatgacatcgccaactgtctgcgcaaaaatggaaagcgggtgattcagctcagccgcaaaacattcgataccgaataccagaagacgaaaaacaacgactgggactacgtcgtgacaaccgatatctctgagatgggcgccaatttcagagctgaccgggttattgatcccagacgctgccttaagcctgtgatcctgaaggacgggcccgaacgggtcattctggccggcccgatgcctgtgacagttgcgtccgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgtttgaacccgagcgcgagaaatccgcggccatcgatggggagtatcggctcagaggagaggctcgcaagaccttcgtggaactgatgagacggggcgacctgcctgtctggctctcctacaaagtggcctctgaggggtttcagtatagcgatcgcagatggtgcttcgacggcgaacggaacaatcaagtccttgaggaaaacatggatgtggagatttggacaaaggagggagaacgcaaaaagctgagaccgcggtggctggacgctagaacctactccgaccccctcgccctgcgcgagtttaaggagttcgctgccggccggagatctgttagcggggatcttatcctggagatcggaaaactccctcagcacctgacacagcgcgcgcagaatgccctggacaacctcgtgatgcttcataattccgaacaaggcgggcgggcttatagacacgccatggaggagctgcccgataccattgaaacactgatgctcctggctcttatcgccgtgctgaccggaggcgtcacgctctttttcctgagcggccgggggctgggaaagacatctattggcctcctttgtgttatggcctccagcgtgctgctgtggatggcttctgtggagcctcattggatcgcggcctccattatcctcgaatttttcctgatggtccttctgatccccgagccggaccgccagagaacccctcaggataaccagctcgcttacgtggttattgggctgctgtttatgatcctcaccgtggccgccaatgagatgggacttctggaaacaaccaaaaaggacctgggcattgggcacgtcgctgtggagaaccaccatcacgccgcgatgctcgatgtcgacctgcatcccgccagcgcttggacactttacgccgtggctacgaccatcattacacctatgatgcggcacaccatcgaaaacacaaccgccaatatttctctgacggcgatcgccaaccaagctgccatcctcatgggactggataaaggctggcccattagcaagatggacatcggcgttcctctgctcgctcttgggtgctattcccaggtgaatcccctgaccctgacagccgctgtcctcatgctggtggcccattacgcgattatcggaccgggccttcaggccaaggctacccgcgaggcccagaaaagaacagctgccgggattatgaagaaccctaccgttgatggaatcgtggccatcgacctggatcccgtcgtgtatgacgcgaaattcgaaaagcagctcggccagattatgctgctgatcctctgtacgtctcagattcttctgatgcggacaacctgggctctgtgcgagagcatcacactcgccaccgggcccctgaccacactttgggagggatcccctggcaaattttggaatacgaccattgctgtgagcatggccaacatcttccgcggctcctacctggccggggctggactcgccttctctctgatgaagtccctgggcgggggaagacggggcacaggggcgcaaggagaaaccctcggcgagaagtggaaacgccagcttaatcagctgtccaagtctgaatttaacacatataaaagaagcggcatcatggaggttgaccggtccgaagccaaggaggggctgaaaagaggagagaccacgaatcacgctgtctctcgcggcacagccaagctccggtggttcgtggaaagaaacctggtgaagccggaggggaaagtcattgatcttggatgtggccgcgggggatggagctactattgcgctggcctgaagaaagttaccgaagtgaagggctacaccaaagggggacccggccacgaggaacctatccccatggccacatacgggtggaatctcgtgaagctgcattccggaaaagacgtctttttcattcctcccgagaagtgtgataccctgctctgcgacatcggcgagagctctcctaacccgacaattgaagaggggcggacgcttagagtgctgaagatggttgaaccctggctgcgcggaaatcagttttgtatcaaaattctcaacccttatatgccctccgtggtcgagaccctggagcaaatgcagcggaagcacggcggcatgcttgtgagaaatcctctgagccgcaactctacacatgaaatgtactgggtttcctgcgggaccggaaatatcgtgagcgcggtcaacatgacatctcggatgctcctgaacagattcaccatggcccaccgcaaacccacgtatgagcgggatgtggacctgggcgctgggaccagacacgtggccgtcgaaccggaggttgctaatctcgatatcattggacagcgcatcgaaaacattaagcatgagcacaaatccacatggcattacgacgaggataatccttataagacctgggcctaccacggcagctatgaagtgaagccctccgggagcgcttctagcatggtgaacggagtcgtgaaactgcttacaaagccctgggacgttatccctatggtgacccagattgccatgacagataccacgccctttggccaacagagagtcttcaaagagaaggtggacacacggacccctaaagcgaagcgcggcaccgcccagatcatggaagttacagctaagtggctgtgggggtttctctccagaaataaaaagccgcggatctgtacgagagaggagttcacccggaaagtgcgctctaacgccgctattggagccgtctttgtggacgagaatcaatggaacagcgccaaggaggcggttgaagatgagagattctgggacctggtgcatcgggaacgcgagcttcacaaacagggcaagtgcgctacatgcgtctacaatatgatggggaagagagagaaaaagctgggagagtttggcaaagccaaggggtcccgggccatctggtacatgtggctcggcgctcgcttcctggagttcgaagccctgggatttatgaacgaggatcactggttctctagagaaaatagcctctccggcgtggagggggagggactgcataaacttggctatattctgcgggacatctctaagattcccgggggaaacatgtacgctgatgacaccgccggctgggatacacgcatcaccgaagacgatctccagaatgaggcgaaaatcacagacattatggaacctgagcacgccctgcttgctaagagcatctttaagctgacctatcagaacaaagtcgtgagagttcaacggcccgccaagaatgggacggtgatggatgtcatttcccgcagagaccagcggggcagcggacaggtgggcacctacgggctcaacacattcaccaacatggaagctcagctgatccgccaaatggagtctgagggaatcttttcccctagcgaactggagacacccaatctcgccagacgggtgctggattggcttgaaaaacatggcgttgagagactgaagcgcatggcgatctctggggacgactgtgtggtcaaaccgatcgatgaccggttcgccaccgctctcacggccctgaacgatatgggaaaggtgagaaaggacattcctcagtgggaaccctccaaaggctggaatgattggcagcaggttcctttttgcagccaccacttccatcaacttatcatgaaggacgggcgcgagattgtggtcccctgtcggaaccaggatgagctggtgggcagagctcgcgtctcccagggagccggctggtctctccgggaaacagcttgcctggggaaaagctatgcccagatgtggcaactgatgtactttcacagacgcgacctccggctggcggccaatgctatctgttccgccgtgcctgttgattgggtgcccaccagcagaacaacctggtctattcatgcccaccatcagtggatgacgaccgaggacatgctttccgtctggaaccgcgtgtggatcgaagagaatccgtggatggaagataagacacacattagctcttggggagacgttccttatctgggcaaacgggaggaccagtggtgcgggagcctcatcggactgaccgctagagccacatgggcgaccaacatccaagtggctattaatcaggtccggagacttatcggcaacgagaattacctggattacatgacatccatgaagcgcttcaagaacgaatctgaccccgagggggccctctggtga

SEQ ID NO: 19063 - RNA, 9879 nt, synthetic construct
  misc_feature 1..9879: note = derived and/or modified CDS sequence (opt5) from DENV-1__FJ882553__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcagaaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattcagaggggaagacggatgctggtatggcatggagattcggccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcatcatgattctgaagctcctgaccgactttcaatcccatcagctttgggccacactgctcagcctgaccttcatcaaaacgacattttctctgcactatgcttggaagaccatggccatggttctttccattgtgagcctgttccccctctgtctgtctaccacatcccagaaaaccacatggctccctgtgctgcttgggagcctgggatgcaagccgctgacgatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgttacgtgatcagcggatctagcgccgacctgtccctggagaaggctgccgaggtctcttgggaagaggaagccgagcatagcggcgcttcccacaatattctcgtggaagttcaggatgacgggaccatgaaaatcaaggatgaggagcgggacgatacactgaccatccttctgaaagcgacactcctggccgtgtctggagtctatcctctcagcattcccgctaccctgttcgtgtggtacttctggcaaaagaaaaagcagcgctccggcgtcctttgggacacgccttctcccccggaagtggagagagccgttctggatgacggcatctatcggattatgcagcgcgggctgctcggaagaagccaggtgggcgtcggggtgtttcaagaaaacgttttccataccatgtggcacgtgacacggggagccgtcctgatgtaccagggcaagagacttgagccttcctgggctagcgtgaaaaaggacctgatctcttacgggggaggctggcgcctccagggctcctggaataccggggaggaagtgcaggttattgccgtcgagcccggcaagaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctatggcaatggggttgtgaccacatccggaacctacgtcagcgccatcgctcaggccaaagcgtcccaggagggccctctgcccgagattgaagacgaggtgtttagaaagcgcaaccttaccatcatggatctgcaccccgggtctggaaaaacacggagatatctgcctgctattgttcgcgaagccatcaagcggaaactcagaacgctgattcttgccccgacccgcgtggtcgctagcgagatggccgaagctctgaagggcatgcccatccggtaccaaacaaccgccgtgaagtccgagcatacagggaaagagatcgttgacctcatgtgccacgcgaccttcacgatgagactgctgagccctgtgcgggtccccaattataacatgattatcatggatgaagcccattttacagacccttcttccattgctgcccgcggctacatcagcaccagagtgggaatgggcgaggctgccgccattttcatgaccgctacaccccctgggtctgtggaagcgtttccgcagagcaatgccgtcatccaggatgaggaacgggacatccccgagcgctcctggaactctggatatgagtggattaccgatttccctggcaagacagtttggtttgtgcccagcatcaaatccgggaatgacattgctaactgtctcagaaagaatggaaaacgggtgatccagctttctagaaagaccttcgatacggaataccaaaagaccaagaacaacgactgggactacgtcgtgaccacagatattagcgagatgggcgccaatttccgcgccgaccgggttatcgatcctagacgctgcctgaagcccgtgattctgaaagacgggccggaacgggtcatcctcgctggccctatgcccgtgaccgttgcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctctttgaacctgagcgcgaaaagagcgccgcgattgatggggagtatagactgcggggagaggcccgcaagacattcgtggaactgatgagacggggcgacctcccggtctggctttcttacaaagtggcttccgaggggtttcaatatagcgatcgcagatggtgcttcgacggcgaacggaacaatcaggtcctggaggaaaacatggatgtggagatctggaccaaggagggagaacgcaaaaagctgcgcccccggtggctcgacgccagaacatactccgaccctctggctcttagagagtttaaagagttcgccgctggccggagatctgttagcggggatctgatcctcgagattggaaagctgccccagcacctgacccagcgggcccaaaatgcgctcgacaaccttgtgatgctgcataattccgaacagggcgggcgcgcctatagacacgctatggaggagctgcctgatacaatcgaaaccctcatgctgcttgccctgattgctgtgctcacgggaggcgtcacactgtttttcctgtctggccgggggctcggaaaaaccagcatcggccttctgtgtgttatggcctccagcgtgctgctctggatggcctctgtggagccccattggattgctgcgtccatcatcctggaatttttccttatggtcctgctcattccggagcctgaccgccagagaacaccccaggataaccaactggcctacgtggttatcgggctgctctttatgattcttacagtggctgccaatgagatgggactgctggaaaccacaaagaaggacctcggcatcgggcacgtcgccgtggagaaccaccatcacgctgccatgctggatgtcgaccttcatcctgcgagcgcctggacgctgtacgctgtggccaccacaattatcacccccatgatgcggcacacaattgaaaacaccacggctaatatctctctcaccgccatcgcgaaccaggccgctattctgatgggactggataaaggctggcctatctccaagatggacattggcgttcccctccttgccctggggtgctatagccaggtgaatccgctgacactcaccgctgccgtcctgatgcttgtggctcattacgccatcattggacctggcctgcaagcgaaagccacacgcgaggctcagaagagaaccgccgctgggatcatgaaaaaccccacggttgatggaatcgtggccattgacctcgatcccgtcgtgtatgacgccaagttcgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattttggaataccacaatcgccgtgtctatggctaacatcttccgcggcagctacctcgccggggccggactggctttctccctgatgaaaagcctcggcgggggaagacggggcaccggggcccagggagaaacacttggcgagaaatggaagagacagctgaatcagctgtccaaatctgaatttaacacctataagcgcagcggcattatggaggttgaccggtccgaagcgaaggaggggctcaaaagaggagagacgacaaagcacgccgtctctcgcggcaccgctaaactgcggtggttcgtggaaagaaatcttgtgaagcccgaggggaaagtcatcgatctgggatgtggccgcgggggatggagctactattgcgccggcctcaagaaggttaccgaagtgaaaggctacacaaaaggcgggcctgggcacgaggaacccattcctatggctacctacgggtggaacctggtgaaactgcattccggaaaggacgtctttttcattccccctgagaaatgtgatacactcctttgcgacattggcgagtctagcccgaatcccacgatcgaagaggggcggaccctgagagtgctgaagatggttgaaccttggctccgcggaaaccaattttgtattaaaatcctgaatccctatatgccttccgtggtcgagacacttgagcagatgcagcggaagcacggcggcatgctggtgagaaaccccctcagccgcaattctacccatgaaatgtactgggtttcctgcgggacaggaaacatcgtgagcgccgtcaatatgacctctcggatgctgctgaacagattcacgatggcgcaccgcaagccgacctatgagagagatgtggacctcggcgccgggacacggcacgtggctgtcgaacctgaggttgccaacctggatattatcggacagcgcattgaaaatatcaaacatgagcacaagtccacctggcattacgacgaggataacccctataaaacatgggcttaccacggcagctatgaagtgaagccctctgggtccgccagctccatggtgaatggagtcgtgaaacttctgaccaagccttgggacgttattcccatggtgacacaaatcgctatgaccgatacgacaccttttggccagcagagagtcttcaaggagaaagtggacacccggaccccgaaggccaaaagaggcacagcgcaaatcatggaagttacggccaagtggctctgggggtttctgagccggaacaaaaagccccgcatttgtaccagagaggagttcacacggaaggtgcgctctaatgctgccatcggagctgtctttgtggacgagaaccagtggaatagcgccaaagaggccgttgaagatgagagattctgggaccttgtgcatcgggaacgcgagctgcacaagcagggcaaatgcgcgacctgcgtctacaacatgatggggaagagagagaaaaagctcggagagtttggcaaggctaaagggtcccgggccatttggtacatgtggctgggcgcccgcttcctggagttcgaagctctcggatttatgaatgaggatcactggttctctagagaaaacagcctgtccggcgtggagggggagggacttcataagctgggctatatcctccgggacatttctaaaatccctgggggaaatatgtacgccgatgacacagctggctgggatacccgcatcacagaagacgatctgcagaacgaggccagaattaccgacatcatggaacccgagcacgcgcttctggccaagagcatttttaaactcacgtatcaaaataaggtcgtgcgggttcagcgccctgctaaaaacgggaccgtgatggatgtcatctccagacgggaccagagaggctctggacaggtgggcacatacgggctgaataccttcacaaacatggaagcccaactgattcgccagatggagagcgagggaatcttttcccccagcgaactcgagaccccgaacctggctgaacgggtgcttgattggctggagaagtatggcgttgaaagactcaagcgcatggccatctctggggacgactgtgtggtcaaacctattgatgaccggttcgcgacggccctgacagctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagaccgcctgcctgggaaagagctacgctcaaatgtggcagctcatgtattttcatagacgcgacctgcggcttgccgcgaacgccatttgttccgctgtgcccgttgattggatcccgacatctagaaccacgtggagcattcacgcccatcaccagtggatgaccacagaagacatgctgtccgtgtggaatcgggtctggatcgaggaaaacccttggatggaggataagacccatatcagctcttggggagacgtgccctacctcggcaaaagagaggaccaatggtgcgggtccctgattggacttacagcccgcgctacctgggccacaaatatccaggttgcgattaaccaggtgcggagactgatcggcaatgaaaactacctcgattatatgaccagcatgaagcgcttcaaaaatgagtctgaacccgagggggctctgtggtga

SEQ ID NO: 19064 - RNA, 9879 nt, synthetic construct
  misc_feature 1..9879: note = derived and/or modified CDS sequence (opt5) from DENV-1__FJ882554__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttattgcgatggacctgggggagctctgtgaagataccatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattgtgatcggggccggagaaaaagccctcaagctgagctggttcaagaaaggctctagcattgggaagatgtttgaggctaccgccagaggcgctcgccggatggccatcctgggagatacagcgtgggacttcggctccatcgggggagtttttacctctgtcggcaaactcgtgcatcagattttcgggacggcctacggagtgctgtttagcggcgtctcctggaccatgaagatcgggattggcgtgcttctgacatggctcggactgaatagcagatctacctccctgagcatgacatgtatcgctgttggccttgtgaccctctacctgggggtcatggtgcaggccgattctggatgcgttattaactggaaaggccgcgaactgaagtgtgggtccggaatcttcgtgacaaatgaggtccacacctggacggaacaatataagtttcaggctgacagccctaaacggctctccgccgcgattggcaaggcctgggaggagggggtgtgcggcatcagatctgctacacgcctggaaaacatcatgtggaaacagattagcaacgagcttaatcatatcctgctcgaaaacgacatgaagttcaccgttgtggtcggagatgtggccggcattctggctcaggggaaaaagatgatccggccgcaacccatggagtacaaatattcctggaagtcttggggaaaggccaaaattatcggcgccgacgtgcagaataccacatttatcattgatgggcctaacacccccgaatgtcctgacgatcagagagcttggaatatctgggaggtcgaggactacggattcggcatttttacgacaaacatctggctgaaacttcgcgatagctatacccaggtttgcgaccaccggctcatgtccgcggccattaaagatagcaaggctgtgcacgccgacatgggctactggatcgaatctgagaaaaatgaaacatggaagctggccagagcttccttcatcgaggtgaagacctgtatttggcccaaaagccatacactgtggtctaacggggtcctcgaatccgagatgatcattccgaagatctatggaggccctattagccaacacaattaccgccccgggtacttcacccaggccgcgggaccttggcatctgggcaaacttgagctggattttgacctctgcgaagggacgaccgtggttgtggatgagcactgcggaaaccggggcccctctctgagaacaaccacagtcaccggcaagatcatccacgaatggtgttgccggagctgtacgctgcctccccttcgcttcagaggggaggacggatgctggtatggcatggagattcggccggtgaaagaaaaggaggaaaatctcgttaagtccatggtgagcgctgggtctggagaggtcgactcctttagcctgggcctgctctgtatctccattatgatcgaagaggtgatgagatctcgctggagccggagaatgctgatgacagggacccttgccgttttctttctgctcattatgggacagctgacatggaacgatctgatccgcctttgcattatggtgggcgccaatgcttccgacagaatgggcatggggaccacctacctggccctcatggcgacattcaaaatgcggcctatgtttgctgtcggactcctgttccgcagactgacgtctcgggaggtgcttctgctcaccatcggcctgagcctggtggcctccgtcgaacttcccaactctctggaggaactcggggatggactggccatgggcatcatgattctcaagctgcttacagactttcaaagccatcagctgtgggctaccctcctgtccctgacattcatcaaaaccacgtttagccttcactatgcctggaagacaatggctatggttctgtctattgtgtccctcttccccctgtgtctcagcaccacctctcagaaaacaacctggctgcctgtgcttctggggtccctgggatgcaagccgctcacaatgtttctgatcgccgagaataagatttggggccgcagaagctggccccttaacgaaggcatcatggcggtcgggatcgtgtctattctgctctccagcctgctcaaaaacgatgttcctctggccggaccccttatcgctggcgggatgctgattgcctgttacgtgatctccggaagctctgctgacctgagcctcgagaaggccgccgaggtctcctgggaagaggaagctgagcattctggcgcgagccacaatattctggtggaagttcaggatgacgggacgatgaaaatcaaggatgaggagcgggacgatacccttacaatcctgctcaaagccaccctgctcgctgtgtccggagtctatcctctgtctattcccgccacacttttcgtgtggtacttctggcaaaagaaaaagcagcgcagcggcgtcctgtgggacacccctagccctcccgaagtggagagagccgttctggatgacggcatctatcggattatgcagcgcgggctcctgggaagatctcaggtgggcgtcggggtgtttcaagaaaacgttttccatacgatgtggcacgtgacccggggagctgtccttatgtaccagggcaagagactggagcccagctgggcctccgtgaaaaaggacctcatcagctacgggggaggctggcgcctgcagggctcttggaatacaggggaggaagtgcaggttattgcggtcgagcccggcaagaaccctaagaatgtgcaaaccgctcccggcacatttaaaaccccggaaggggaggtgggagccatcgccctcgatttcaagcctggcacatccgggagccccattgtcaaccgggaaggaaagatcgtgggcctgtatggcaatggggttgtgacgacctctggaacatacgtctccgctatcgcccaggcgaaagctagccaggagggccctcttcccgagattgaagacgaggtgtttagaaagcgcaacctgaccatcatggatctgcaccccgggtccggaaaaacccggagatatctccctgccattgttcgcgaagccatcaagcggaaactgagaacacttattctggctccgacgcgcgtggtcgcctctgagatggctgaagccctcaagggcatgcccatccggtaccaaaccacagcggtgaagtccgagcataccgggaaagagatcgttgacctgatgtgccacgccacattcaccatgagactgctctcccctgtgcgggtccccaattataacatgattatcatggatgaagctcattttacggacccttacagcattgccgctcgcggctatatctctacaagagtgggaatgggcgaggccgccgctattttcatgaccgcgacaccccctgggtccgtggaagcctttccgcagagcaatgctgtcatcaaggatgaggaacgggacatccccgagcgctcttggaacagcggatacgagtggattacagatttccctggcaaaaccgtttggtttgtgccctccatcaagtctgggaatgacattgccaactgtcttcgcaagaatggaaagcgggtgatccagctgagcagaaagacattcgataccgaataccagaaaacgaagaacaacgactgggactatgtcgtgacaaccgatatttccgagatgggcgccaatttccgcgctgaccgggttatcgatcctagacgctgcctgaaacccgtgattctcaaggacgggccggaacgggtcatcctggccggccctatgcccgtgacagttgcgtctgctgcccaaagacgcggacggatcggcagaaaccacaataaagagggggatcagtacatttatatgggacagccccttaacaatgacgaggatcatgcccactggaccgaagctaagatgctgctcgacaacatcaatacgcctgagggcattatccccgccctgtttgaacctgagcgcgaaaagagcgcggccattgatggggagtacagactgcggggagaggctcgcaaaaccttcgtggaactcatgagacggggcgaccttccggtctggctgtcctataaggtggccagcgaggggtttcagtactctgatcgcagatggtgcttcgacggcgaacggaacaatcaagtcctggaggaaaacatggatgtggagatctggacaaaagagggagaaagaaagaaactccgcccccggtggctggacgctagaacctattccgaccctcttgccctgcgcgagtttaaggagttcgctgccggccggagaagcgtttccggggatctcatcctggagattggaaaactgccccagcacctcacacagcgggcgcagaatgcccttgacaacctggtgatgctgcataattctgaacaaggcgggcgcgcttacagacacgccatggaggagctccctgataccatcgaaacactgatgcttctggctctcattgccgtgctgaccggaggcgtcacgctgtttttcctcagcggccgggggcttggaaagacatccatcggcctgctgtgtgttatggcctctagcgtgctcctgtggatggcttccgtggagccccattggattgcggccagcatcatccttgaatttttcctgatggtcctcctgattccggagcctgaccgccagagaacaccccaggataaccagctggcttacgtggttatcgggctcctttttatgattctgaccgtggccgccaatgagatgggactgctcgaaacaaccaagaaagacctgggcatcgggcacgtcgctgtggagaaccaccatcacgccgcgatgcttgatgtcgacctgcatcctgcctctgcttggacactctatgccgtggctacgaccattatcacacccatgatgcggcacaccattgaaaacacaaccgccaatatctccctgacggcgatcgccaaccaagctgccattctgatgggactcgataagggctggcctatcagcaaaatggacattggcgttccccttctggctctggggtgctactctcaggtgaatccgctcaccctgacagccgctgtccttatgctggtggcccattatgcgatcattggacctggcctccaggccaaggctacccgcgaggcccagaaaagaacagctgccgggatcatgaagaaccccaccgttgatggaatcgtggccattgacctggatcccgtcgtgtacgacgcgaagttcgaaaaacagctgggccagatcatgctccttattctgtgtacgtcccagatcctgctcatgcggacaacctgggctctgtgcgagagcattacacttgccaccgggcctctgaccacactctgggagggatctccgggcaagttttggaatacgaccatcgctgtgagcatggccaacatcttccgcggctcctatctggccggggctggactggccttctctctcatgaaaagccttggcgggggaagacggggcacaggggcgcaaggagaaaccctgggcgagaagtggaaaagacagctgaatcagctctccaagagcgaatttaacacatacaagcgctccggcattatggaggttgaccggtctgaagccaaagaggggctgaagagaggagagaccacgaaacacgctgtcagccgcggcacagccaaacttcggtggttcgtggaaagaaatctggtgaaacccgaggggaaggtcatcgatctcggatgtggccgcgggggatggtcctattactgcgctggcctgaagaaagttaccgaagtgaagggctacaccaaagggggacctggccacgaggaacccattcctatggccacatatgggtggaacctggtgaagctccattctggaaaagacgtctttttcattccccctgagaagtgtgatacccttctgtgcgacatcggcgagagctccccgaatcccacaatcgaagaggggcggacgctgagagtgctcaaaatggttgaaccttggctgcgcggaaaccagttttgtattaagatccttaatccctacatgccttctgtggtcgagaccctggagcaaatgcagcggaagcacggcggcatgctcgtgagaaaccccctgagccgcaattccacacatgaaatgtattgggttagctgcgggaccggaaacatcgtgtctgcggtcaatatgacatcccggatgctgctcaacagattcaccatggcccaccgcaaaccgacgtacgagagagatgtggacctgggcgctgggacccggcacgtggccgtcgaacctgaggttgctaaccttgatattatcggacagcgcattgaaaatatcaagcatgagcacaaaagcacatggcattatgacgaggataacccctacaagacctgggcctatcacggctcttacgaagtgaaaccctccgggagcgcttcttccatggtgaatggagtcgtgaagctgctcacaaagccttgggacgttattcccatggtgacccagatcgccatgacagataccacgccttttggccaacagagagtcttcaaagagaaggtggacacacggaccccgaaagcgaagagaggcaccgcccagatcatggaagttacagctaaatggctgtgggggtttcttagccggaacaagaagccccgcatttgtacgagagaggagttcacccggaaagtgcgctccaatgccgctatcggagccgtctttgtggacgagaaccaatggaatagcgccaaggaggcggttgaagatgagagattctgggacctggtgcatcgggaacgcgagctccacaaacagggcaagtgcgctacatgcgtctacaacatgatggggaaaagagaaaagaagctgggagagtttggcaaagccaaggggtctcgggccatttggtatatgtggctgggcgctcgcttcctcgagttcgaagccctgggatttatgaatgaggatcactggttcagcagagaaaactccctttctggcgtggagggggagggactgcataaactcggctacatcctgcgggacattagcaagatccctgggggaaatatgtatgctgatgacaccgccggctgggatacacgcatcaccgaagacgatcttcagaacgaggcgagaattacagacatcatggaacccgagcacgccctgctcgctaaatccatttttaagctgacctaccagaataaagtcgtgcgggttcaacgccctgccaagaacgggacggtgatggatgtcatctctagacgggaccagagaggcagcggacaggtgggcacctatgggctgaatacattcaccaacatggaagctcagctcattcgccaaatggagtccgagggaatcttttctcccagcgaactggagacaccgaaccttgccgaacgggtgctggattggctcgagaagtacggcgttgaaagactgaaacgcatggcgatctccggggacgactgtgtggtcaagcctattgatgaccggttcgccaccgctcttacggccctgaatgatatgggaaaagtgagaaaggacatcccccagtgggagcctagcaaaggctggaacgattggcagcaggttcccttttgctctcatcacttccaccaactcattatgaaggacgggcgcgagatcgtggtcccttgtcggaatcaggatgaactggtgggcagagctcgcgtctcccagggagccggctggagcctgcgggagacagcttgcctcgggaagtcttatgcccagatgtggcaactgatgtactttcatagacgcgaccttcggctggcggccaacgctatttgttccgccgtgcccgttgattggatcccgaccagcagaacaacctggtccattcacgcccatcaccagtggatgacgaccgaagacatgctctctgtgtggaatcgggtctggatcgaggaaaacccttggatggaggataaaacacatatcagctcctggggagacgtgccctacctgggcaagagagaggaccagtggtgcgggagccttattggactgaccgctcgcgccacatgggcgaccaatatccaagttgctattaaccaggtgcggagactcatcggcaatgaaaactatctggattacatgacatctatgaaacgcttcaagaatgagtccgaccccgaaggggccctgtggtga

SEQ ID NO: 19065 - RNA, 9879 nt, synthetic construct
  misc_feature 1..9879: note = derived and/or modified CDS sequence (opt5) from DENV-1__GQ868610__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctgattacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagctgcgcgattcctacacacaggtctgcgaccaccggcttatgagcgcggccatcaaagattctaaggctgttcatgccgacatgggctattggatcgaatccgagaaaaatgaaacctggaagctcgccagagctagcttcattgaggtgaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgtcgtggttgatgagcactgcggaaaccggggccccagcctcagaacaaccacagtgaccggcaagatcattcatgaatggtgttgccggtcctgtacgctgcctcccctgcgcttcaaaggggaggacggatgctggtacggcatggagatcagaccggtcaaggaaaaggaggaaaatcttgtgaaaagcatggtttctgcggggtccggagaggtggacagcttttccctcggcctgctgtgtatttctatcatgattgaagaggtcatgcggagcagatggtcccgcaagatgctcatgacagggaccctggctgtgttccttctgctcatcatgggacagctgacatggaacgatctgattcggctttgcatcatggttggcgccaatgcctctgacagaatgggcatggggaccacctatctggctctcatcgccacatttaaaatgcgccctatgttcgcggtgggactgctctttagacggctgacgagccgcgaggtccttctgctcaccattggcctgtccctggtggcttctgtggaacttcccaacagcctggaggaactcggggatggactggccatgggcatcatgattctcaagctgcttacagacttccaatcccaccagctgtgggccaccctcctgagctttacattcatcaaaaccacgctgtctcttcattacgcttggaagacaatggccatggtcctgtccattgttagcctctttcccctgtgtctctctaccacctcccagaagacaacctggctgcctgtgcttctggggagcctgggatgcaaaccgctcacaatgttcctgatcgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgttccaagaaaacgtttttcacacgatgtggcacgtgacccggggagccgtccttatgtatcagggcaaacgcctggagccttcctgggctagcgtgaagaaagacctcatttcttacgggggaggctggagactgcagggctcctggaatacaggggaggaagtgcaggttatcgccgtcgagcccggaaagaaccctaagaatgtgcaaaccgcgcccggcacattcaaaaccccggaaggggaggtgggagctattgccctcgattttaagcctggcacaagcgggtctcccatcgtcaaccgggaaggaaaaatcgtgggcctgtacggcaatggggttgtgacgacctccggaacatatgtcagcgccattgctcaggccaaggcgtcccaggagggccctcttcccgagatcgaagacgaggtgttcagaaaacgcaacctgaccattatggatctgcatcccgggtctggaaagacccggagatacctccctgctatcgttcgcgaagccattaagcggaaactgagaacacttatcctggccccgacgcgcgtggtcgctagcgagatggccgaagctctcaagggcatgcccatccggtatcaaaccacagccgtgaaatccgagcacaccgggaaggagattgttgacctgatgtgccatgcgacatttaccatgagactgctcagccctgtgcgcgtccccaattacaacatgatcattatggatgaagcccacttcacggacccttcttccatcgctgcccggggctatattagcacaagagtgggaatgggcgaggctgccgccatctttatgaccgctacaccccctgggtctgtggaagcgttcccgcagagcaatgccgtcatccaggatgaggaacgggacattcccgagcgctcctggaactctggatacgagtggatcacagattttcctggcaaaaccgtttggttcgtgcccagcattaagtccgggaatgacatcgctaactgtcttagaaagaatggaaaacgggtgattcagctgtctcgcaagacatttgataccgaatatcagaagacgaagaacaacgactgggactacgtcgtgacaaccgatatcagcgagatgggcgccaatttcagagccgaccgggttattgatcctagacgctgcctgaaacccgtgatcctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacgcctgagggcatcattcccgctctgttcgaacctgagcgcgaaaagagcgccgcgatcgatggggagtaccggctgagaggagaggcccgcaaaacctttgtggaactcatgagacggggcgaccttccggtctggctgtcttataaggtggcttccgaggggttccaatacagcgatcgcagatggtgctttgacggcgaacggaacaatcaggtcctggaggaaaacatggatgtggagatctggacaaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacgctgttctttctctctggccgggggcttggaaaaacaagcattggcctgctgtgtgttatggcctccagcgtgctcctgtggatggcctctgtggagccccactggatcgctgcgtccatcattcttgagttctttctgatggtcctcctgatcccggagcctgaccgccagagaacaccccaggataaccaactggcctatgtggttattgggctccttttcatgatcctgaccgtggctgccaatgagatgggactgctcgaaacaaccaagaaagacctgggcattgggcacgtcgccgtggagaaccatcaccatgctacaatgcttgatgtcgacctgcaccctgccagcgcgtggacgctctacgccgtggctaccacaatcattacccccatgatgcggcatacaatcgaaaacaccacggccaatatctctctgaccgctattgccaaccaggcggccatcctgatgggactcgataagggctggcctatttccaaaatggacatcggcgttccccttctggctctggggtgctacagccaggtgaatccgctcacactgaccgccgctgtccttatgctggtggcccactatgctattatcggacctggcctccaagccaaggcgacacgcgaggcccagaagagaaccgctgccgggatcatgaaaaaccccacggttgatggaattgtggctatcgacctggatcccgtcgtgtacgacgccaagtttgaaaaacagctgggccagattatgctccttatcctgtgtacatctcaaattctgctcatgcggaccacatgggccctgtgcgagagcatcacccttgcgaccgggcctctgacaacgctctgggagggatccccgggcaagttctggaataccacaatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgagttcaacacctacaagagaagcggcatcatggaggttgaccggtccgaagccaaagaggggctgaagagaggagagacgacacgccacgcggtctctcggggcaccgccaaacttagatggtttgtggaacgcaatctggtgaagcccgaggggaaggtcattgatctcggatgtggcagagggggatggagctattactgcgctggcctgaaaaaggttaccgaagtgaaaggctatacaaaagggggacctggccatgaggaacccatccctatggccacctacgggtggaacctggtgaaactccactccggaaaggacgtcttctttacaccccctgagaaatgtgatacgcttctgtgcgacattggcgagtctagcccgaatcccaccatcgaagaggggagaacactgcgcgtgctcaagatggttgaaccttggctgcggggaaaccaattctgtattaagatccttaatccctacatgccttccgtggtcgagaccctggagcagatgcagagaaaacatggcggcatgctcgtgcgcaaccccctgagcagaaattctacacacgaaatgtattgggtttcctgcgggaccggaaacatcgtgagcgctgtcaatatgacgtctagaatgctgctcaaccgctttaccatggcccaccggaagccgacatacgagagagatgtggacctgggcgcggggacccgccatgtggccgtcgaacctgaggttgctaaccttgatattatcggacagagaattgaaaatatcaaacacgagcataagtccacatggcactatgacgaggataacccctacaaaacctgggcctatcatggcagctacgaagtgaagccctctgggtccgctagctccatggtgaatggagtcgtgaagctgctcacaaaaccttgggacgttattcccatggtgacccaaatcgccatgacggatacaacccctttcggccagcagcgggtctttaaggagaaagtggacacccgcacaccgaaggctaaaagaggcacggcccaaatcatggaagttaccgcgaagtggctgtgggggttccttagccggaacaagaaacccagaatttgtacacgggaggaatttacccgcaaggtgagatctaatgccgctatcggagccgtcttcgtggacgagaaccagtggaatagcgctaaagaggccgttgaagatgagcggttttgggacctggtgcagaaggaacgcgagctccacaaacagggcaagtgcgccacatgcgtctataacatgatggggaagagagagaaaaagctgggagagttcggcaaagcgaaggggtcccgggctatttggtacatgtggctgggcgcccgctttctcgagttcgaagccctgggattcatgaatgaggatcactggttttctagagaaaacagcctttccggcgtggagggggagggactgcataaactcggctacatcctgcgggacatttctaagatccctgggggaaatatgtatgctgatgacaccgccggctgggatacacgcatcaccgaagacgatcttcaaaacgaggctaaaattacggacatcatggaacccgagcacgccctgctcgcgaccagcattttcaagctgacataccagaataaggtcgtgagagttcagcggcctgccaaaaacgggaccgtgatggatgtcatctcccgcagagaccagcggggctctggacaagtgggcacatatgggctgaatacctttacgaacatggaagctcagctcattcgccagatggagagcgagggaatcttcctgccctccgaacttgagacaccgaacctggccgaaagagtgctcgattggctggagaagtacggcgttgaacggcttaaaagaatggctatcagcggggacgactgtgtggtcaagcctattgatgaccgctttgccaccgcgctgacagccctcaatgatatgggaaaagtgcggaaggacatcccccagtgggagccttctaagggctggaacgattggcaacaggttcccttctgctcccatcactttcaccagctgattatgaaagacgggagagagatcgtggtcccttgtcgcaatcaggatgaactggtgggccgggctagagtcagccaaggagccggctggtctctccgcgagaccgcttgcctggggaagtcctatgcccagatgtggcagcttatgtacttccatcggagagacctgcgcctcgctgccaacgcgatttgtagcgccgtgcccgttgattgggtgccgacgtcccggaccacatggtctatccacgctcatcaccaatggatgaccacagaagacatgctgagcgtctggaatagagtgtggattgaggaaaacccttggatggaggataaaacccatgtttccagctggggagacgtgccctatcttggcaagcgcgaggaccagtggtgcgggtctctgatcggactcacagcccgggccacctgggcttccaatatccaggtcgccattaaccaggtgagacggctgatcggcaatgaaaactacctggattacatgacgagcatgaaaagatttaagaatgagggggaccccgaaggcgcgctctggtga

SEQ ID NO: 19066 - RNA, 9879 nt, synthetic construct
  misc_feature 1..9879: note = derived and/or modified CDS sequence (opt5) from DENV-1__GQ868611__SS-prME
  source 1..9879: mol_type = other RNA
agcgtgaccatgttcctgatgctcatgcccaccgccctggcttttcaccttacgaccagaggcggggaacctcatatgatcgtgtccaagcaggaacggggaaaatctctcctgttcaagacaagcgccggcgttaacatgtgcaccctgatcgcgatggaccttggggaactgtgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtgacacctagcatggccatgagatgcgtgggcattgggtcccgggatttcgttgagggacttagcggcgctacgtgggtggacgtggtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatccctttttccacacaagatgaaaagggggttacgcagaacggacggctgatcaccgcgaatcccattgtgacagacaaagagaagcctgtcaacatcgaagctgagccgcccttcggcgagagctatattgtgatcggggccggagaaaaagcccttaagctctcttggtttaagaaaggcagctccattgggaagatgttcgaggctaccgccagaggcgctcgccggatggccatcctgggagatacagcgtgggactttggctctatcgggggagtgttcaccagcgttggcaaactggtccatcagatttttgggacggcctacggagtcctgttctccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagtttaccgtggttgtgggagatgtcgccggcattctcgctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggctgaagctgcgcgattcctatacccaggtctgcgaccaccggcttatgagcgcggccattaaagattctaaggctgttcacgccgacatgggctactggatcgaatccgagaaaaatgaaacatggaagctcgccagagctagcttcatcgaggtgaagacctgtatttggcccaaatctcatacactgtggtccaacggggtgctggaaagcgagatgatcattccgaagatctatggaggccctatttctcaacacaattaccgccccgggtactttacccagacggccggaccttggcatctcggcaaactggagcttgatttcgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgctttagaggggaggacggatgctggtatggcatggagattcggccggtcaaagaaaaggaggaaaatcttgtcaagagcatggtttctgcggggtccggagaggtggacagcttctccctcggcctgctgtgtatctctattatgatcgaagaggtcatgagaagccgctggtcccggaaaatgctcatgaccgggacactggctgtgtttttccttctgattatgggacagctcacctggaacgatctgatcagactgtgcattatggttggcgccaatgcctctgaccgcatgggcatggggaccacataccttgctctgatggccacgtttaagatgagacctatgttcgcggtgggactcctgtttcggcgcctcaccagcagagaggtcctgcttctgacaatcggcctctccctggtggcttctgtggaactgcccaacagccttgaggaactgggggatggactcgccatgggcatcatgattctgaaactcctgaccgacttccaatcccatcagctttgggccacactgctcagcctgacctttatcaagacgacattctctctgcactatgcttggaaaaccatggccatggtcctttccattgttagcctgtttcccctctgtctgtctaccacatcccagaagaccacatggctccctgtgctgcttgggagcctgggatgcaagccgctgacgatgttcctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggaccatgaagatcaaagatgaggagagagacgatacactgaccatccttctgaaggcgacactcctggccgtttctggagtgtatcctctcagcattcccgctaccctgttcgtctggtacttttggcagaagaagaagcagcggtccggcgtgctttgggacacgccttctcccccggaagtcgagcgcgccgtgctggatgacggcatctatagaattatgcagcgggggctgctcggacgcagccaggttggcgtgggggtcttccaagaaaacgtgtttcataccatgtggcacgttacaagaggagccgtgctgatgtaccagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctctatggcaatggggtggttaccacatccggaacctacgtgagcgccatcgctcaggcccgggcgtcccaggagggccctctgcccgagattgaagacgaggtcttcagaaagcgcaaccttaccatcatggatctgcaccccgggtctggaaaaacacggagatatctgcctgctattgtgcgcgaagccatcaagcggaaactcagaacgctgattcttgccccgacccgcgttgtggctagcgagatggccgaagctctgaagggcatgcccatccggtaccaaacaaccgccgtcaagtccgagcatacagggaaagagatcgtggacctcatgtgccacgcgacctttacgatgagactgctgagccctgttcgggtgcccaattataacatgattatcatggatgaagcccatttcacagacccttcttccattgctgcccgcggctacatcagcaccagagtcggaatgggcgaggctgccgccatttttatgaccgctacaccccctgggtctgtggaagcgttcccgcagagcaatgccgtgatccaggatgaggaacgggacatccccgagcgctcctggaactctggatatgagtggattaccgattttcctggcaagacagtctggttcgttcccagcatcaaatccgggaatgacattgctaactgtctcagaaagaatggaaaacgggtgatccagctttctagaaagaccttcgatacggaataccaaaagaccaagaacaacgactgggactacgtggtcaccacagatattagcgagatgggcgccaattttcgcgccgaccgggtgatcgatcctagacgctgcctgaagcccgttattctgaaagacgggccggaacgggtgatcctcgctggccctatgcccgtcaccgtggcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctcttcgaacctgagcgcgaaaagagcgccgcgattgatggggagtatagactgcggggagaggcccgcaagacatttgttgaactgatgagacggggcgacctcccggtgtggctttcttacaaagtcgcttccgaggggttccaatatagcgatcgcagatggtgctttgacggcgaacggaacaatcaggtgctggaggaaaacatggatgtcgagatctggaccaaggagggagaacgcaaaaagctgcgcccccggtggctcgacgccagaacatactccgaccctctggctcttagagagttcaaagaatttgccgctggccggagatctgtgagcggggatctgatcctcgagattggaaagctgccccagcacctgacccagcgggcccaaaatgcgctcgacaaccttgttatgctgcataattccgaacagggcgggcgcgcctatagacacgctatggaggagctgcctgatacaatcgaaaccctcatgctgcttgccctgattgctgtgctcacgggaggcgtgacactgttctttctgtctggccgggggctcggaaaaaccagcatcggccttctgtgtgtcatggcctccagcgttctgctctggatggcctctgtggagccccattggattgctgcgtccatcatcctggagttctttcttatggtgctgctcattccggagcctgaccgccagagaacaccccaggataaccaactggcctacgtcgtgatcgggctcctcttcatgattcttacagttgctgccaatgagatgggactgctggaaaccacaaagaaggacctcggcatcgggcacgtggccgtcgagaaccaccatcacgctgccatgctggatgtggaccttcatcctgcgagcgcctggacgctgtacgctgtcgccaccacaattatcacccccatgatgcggcacacaattgaaaacaccacggctaatatctctctcaccgccatcgcgaaccaggccgctattctgatgggactggataaaggctggcctatctccaagatggacattggcgtgcccctccttgccctggggtgctatagccaggttaatccgctgacactcaccgctgccgtgctgatgcttgtcgctcattacgccatcattggacctggcctgcaagcgaaagccacacgcgaggctcagaagagaaccgccgctgggatcatgaaaaaccccacggtggatggaatcgttgccattgacctcgatcccgtggtctatgacgccaagtttgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattctggaataccacaatcgccgtgtctatggctaacatcttccgcggcagctacctcgccggggccggactggctttttccctgatgaaaagcctcggcgggggaagacggggcaccggggcccagggagaaacacttggcgagaaatggaagagacagctgaatcagctgtccaaatctgagttcaacacctataagcgcagcggcattatggaggtggaccggtccgaagcgaaggaggggctcaaaagaggagagacgacaaagcacgccgtttctcgcggcaccgctaaactgcggtggtttgtcgaaagaaatcttgtgaagcccgaggggaaagtgatcgatctgggatgtggccgcgggggatggagctactattgcgccggcctcaagaaggtcaccgaagttaaaggctacacaaaaggcgggcctgggcacgaggaacccattcctatggctacctacgggtggaacctggtgaaactgcattccggaaaggacgtgttctttattccccctgagaaatgtgatacactcctttgcgacattggcgagtctagcccgaatcccacgatcgaagaggggcggaccctgagagtcctgaagatggtggaaccttggctccgcggaaaccaattctgtattaaaatcctgaatccctatatgccttccgttgtggagacacttgagcagatgcagcggaagcacggcggcatgctggtcagaaaccccctcagccgcaattctacccatgaaatgtactgggtgtcctgcgggacaggaaacatcgttagcgccgtgaatatgacctctcggatgctgctgaacagatttacgatggcgcaccgcaagccgacctatgagagagatgtcgacctcggcgccgggacacggcacgtggctgtggaacctgaggtcgccaacctggatattatcggacagcgcattgaaaatatcaaacatgagcacaagtccacctggcattacgacgaggataacccctataaaacatgggcttaccacggcagctatgaagttaagccctctgggtccgccagctccatggtgaatggagtggtcaaacttctgaccaagccttgggacgtgattcccatggttacacaaatcgctatgaccgatacgacacctttcggccagcagagagtgtttaaggagaaagtcgacacccggaccccgaaggccaaaagaggcacagcgcaaatcatggaagtgacggccaagtggctctgggggttcctgagccggaacaaaaagccccgcatttgtaccagagaggaatttacacggaaggttcgctctaatgctgccatcggagctgtgttcgtcgacgagaaccagtggaatagcgccaaagaggccgtggaagatgagagattttgggaccttgttcatcgggaacgcgagctgcacaagcagggcaaatgcgcgacctgcgtgtacaacatgatggggaagagagagaaaaagctcggagagttcggcaaggctaaagggtcccgggccatttggtacatgtggctgggcgcccgcttcctggagtttgaagctctcggattcatgaatgaggatcactggttttctagagaaaacagcctgtccggcgtcgagggggagggacttcataagctgggctatatcctccgggacatttctaaaatccctgggggaaatatgtacgccgatgacacagctggctgggatacccgcatcacagaagacgatctgcagaacgaggccagaattaccgacatcatggaacccgagcacgcgcttctggccaagagcattttcaaactcacgtatcaaaataaggtggtccgggtgcagcgccctgctaaaaacgggaccgttatggatgtgatctccagacgggaccagagaggctctggacaggtcggcacatacgggctgaatacctttacaaacatggaagcccaactgattcgccagatggagagcgagggaatcttctcccccagcgaactcgagaccccgaacctggctgaacgggtgcttgattggctggagaagtatggcgtggaaagactcaagcgcatggccatctctggggacgactgtgttgtgaaacctattgatgaccggtttgcgacggccctgacagctcttaatgatatgggaaaggtcagaaaagacatcccccagtgggagccttccaagggctggaacgattggcagcaagtgcccttctgcagccatcactttcaccagctgattatgaaagacgggcgcgagatcgttgtgccttgtcggaatcaggatgaactcgtcggcagagcccgcgtgtctcagggagctggctggtccctgcgggagaccgcctgcctgggaaagagctacgctcaaatgtggcagctcatgtatttccatagacgcgacctgcggcttgccgcgaacgccatttgttccgctgtccccgtggattggatcccgacatctagaaccacgtggagcattcacgcccatcaccagtggatgaccacagaagacatgctgtccgtttggaatcgggtgtggatcgaggaaaacccttggatggaggataagacccatatcagctcttggggagacgtcccctacctcggcaaaagagaggaccaatggtgcgggtccctgattggacttacagcccgcgctacctgggccacaaatatccaggtggcgattaaccaggttcggagactgatcggcaatgaaaactacctcgattatatgaccagcatgaagcgctttaaaaatgagtctgaccccgaaggggctctgtggtga

SEQ ID NO: 19067 - RNA, 9879 nt, synthetic construct
  misc_feature 1..9879: note = derived and/or modified CDS sequence (opt5) from DENV-1__FJ882555__SS-prME
  source 1..9879: mol_type = other RNA
tccgtgacaatgctgctgatgctgatgcccacagcccttgctttccacctgacgacccggggaggggagcctcatatgattgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctgcgagccaagagacatggaatcgccaggaccttctggtgacctttaaaacagcccacgctaagaagcaggaagtcgtggttctcggatcccaagagggcgccatgcacaccgccctgaccggggctacagaaattcagacgagcggaaccacaaccatcttcgccggccatctgaaatgcagactcaagatggataaactgacacttaaggggatgtcttatgtgatgtgtaccggctccttcaaactggagaaggaagtcgcggagacgcagcacggaacagtgctcgttcagattaagtacgagggcaccgacgctccgtgcaaaatcccttttagcacccaagatgaaaagggggtgacacagaacggacggctgatcaccgccaatcccattgtcacagacaaagagaagcctgtgaacatcgaagccgagccgcccttcggcgagtcttatattgtgatcggggctggagaaaaagccctgaaacttagctggtttaagaaaggctcctctattgggaagatgttcgaggctacggccagaggcgcgcgccggatggccatcctcggagataccgcttgggactttggcagcatcgggggagttttcacatccgtcggcaaactggtgcatcagatttttgggaccgcctacggagtgctgttcagcggcgtctcttggacaatgaagatcgggattggcgtgctcctgacctggcttggactcaattccagaagcacgtctctctccatgacctgtatcgctgttggcctggtgacactgtaccttggggtcatggtgcaggccgatagcggatgcgttattaactggaaaggccgcgaactcaagtgtgggtccggaatctttgtgaccaatgaggtccacacatggaccgaacaatataagttccaggcggactctcctaaacggctgagcgccgctattggcaaggcctgggaggagggggtgtgcggcatcagatccgctacacgcctggaaaacatcatgtggaaacagatttctaacgagctcaatcatatcctgcttgaaaacgacatgaagctgaccgttgtggtcggagatgtggccggcattctcgcccaggggaaaaagatgatccggccgcaacccatggagtacaaatatagctggaagtcctggggaaaggctaaaattatcggcgcggacgtgcagaatacgacatttatcattgatgggcagaacacccctgaatgtcccgacgatcagagagcctggaatatctgggaggtcgaggactacggattcggcatttttaccacaaacatctggctgaagctgcgcgatagctatacccaagtttgcgaccaccggcttatgtctgctgccattaaagattccaaggccgtgcacgctgacatgggctactggatcgaaagcgagaaaaatgaaacgtggaagctcgccagagcgtctttcatcgaggtgaagacatgtatttggcctaaatcccataccctgtggagcaacggggtcctggaatctgagatgatcattcccaagatctatggaggcccgattagccagcacaattaccgccctgggtacttcacacagaccgctggaccctggcatctcggcaaactggagcttgattttgacctgtgcgaagggacaaccgtggttgtggatgagcactgcggaaaccggggcccttccctcagaacgaccacagtcaccggcaagatcatccacgaatggtgttgccggagctgtacactgccccctctgcgcttcaaaggggaggacggatgctggtatggcatggagattagacccgtgaaggaaaaggaggaaaatcttgttaaatctatggtgtccgccgggagcggagaggtcgactccttttctctcggcctgctgtgtatcagcattatgatcgaagaggtgatgcggtccagatggtctcgcaagatgctcatgaccgggacgctggccgttttctttcttctgattatgggacaactcacatggaacgatctgatccggctgtgcattatggtgggcgctaatgccagcgacagaatgggcatggggaccacataccttgcgctgatggctaccttcaaaatgcgcccgatgtttgccgtcggactcctgttcagacggctcacctcccgcgaggtgctgcttctgacaatcggcctctctctggtggccagcgtcgaactgcctaactcccttgaggaactgggggatggactcgctatgggcatcatgattctgaagctcctgacggactttcagagccatcagctttgggccaccctgctctctatgacattcatcagaaccacattttccctgcactatgcttggaaaaccatggccatggttctgagcattgtgtctcttttccccctgtgtctctccacgacaagccagaagaccacctggctgcccgtgctcctggggtctcttggatgcaagcctctgacaatgtttctgatcgcggagaataaaatttggggccggaagtcctggccgctcaacgaaggcatcatggccgtcgggatcgtgagcattctgctttccagcctgctcaaaaacgatgttcccctggctggacctctcatcgccggcgggatgctgattgcttgttacgtgatctctggaagctccgccgacctttctctggagaaggccgctgtcgtgagctgggaggaagaggcggaacattccggcgcctctcacaatattctggttgaggtgcaagatgacgggaccatgaaaatcaaggatgaagaaagagacgatacactcacgatcctgcttaaagctaccctgctcgccgtcagcggagtgtatcccctgtccattcctgccacactcttcgtctggtacttctggcagaagaagaaacagagatctggcgtgctgtgggacacccccagccctcccgaggttgaacgggctgtgcttgatgacggcatctatcgcattatgcagagagggctgctgggacggtcccaagtcggcgtgggggtttttcaggagaacgtgttccatacaatgtggcacgtcacccgcggagccgtgctcatgtaccagggcaagagactggaaccgagctgggcgtctgtgaaaaaggaccttatctcctacgggggaggctggcggctgcagggcagctggaatacgggggaggaggttcaagtcattgctgtggaacctggcaagaatcccaagaatgtgcagaccgcccctggcacatttaagacctctgagggggaagtcggagccatcgctctcgatttcaaacccggcacatccgggagcccgattgtgaacagagagggaaaggttgtgggcctgtatggcaatggggtcgtgaccacatccggaacgtacgtttctgccatcgcgcaggctaaagccagccaagaaggccctctccccgagatcgaggacgaagtgtttcgcaagcggaacctgaccattatggatcttcaccctgggtccggaaaaacaagacgctatctgcccgccatcgtccgggaggctattaagagaaagctgcgcaccctcatcctggcccccacccgggtggttgctagcgaaatggccgaggcgcttaaaggcatgcctattagataccagacaacggccgtgaagtctgaacataccgggaaagagatcgtcgacctgatgtgccacgctacattcaccatgcgcctcctgtccccggtgcgggtgcccaattataacatgatcattatggatgaggcccattttacagaccctagctctatcgctgccagaggctacattagcacccgggtcggaatgggcgaagccgctgcgatcttcatgacggccacaccccctgggtccgttgaggcttttccccagtctaatgccgtgattcaggatgaggaacgcgacatccctgaaagaagctggaactccggatatgagtggatcaccgatttcccgggcaagaccgtgtggtttgtcccctctattaaaagcgggaatgacatcgccaactgtctgcggaagaatggaaagcgcgtgattcaactctccagaaaaacattcgataccgagtaccagaagaccaagaacaacgactgggactacgttgtgaccacggatatcagcgaaatgggcgctaatttccgggccgacagagtcattgatcctcgccggtgccttaagcccgtgatcctgaaagacgggcctgagagagttattctggcgggccccatgccggtgacagtcgcttctgccgcccagcgccggggaagaatcggccgcaaccacaataaggaaggggatcagtatatctacatgggacaacctctcaacaatgacgaggatcatgctcactggaccgaggccaagatgctgcttgacaacattaatacacccgaaggcatcattcccgcgctgtttgagcctgaacgggagaaatccgccgctatcgatggggaatatagactccgcggagaggccagaaagaccttcgtggagctgatgcggcgcggcgacctgcccgtctggctcagctacaaagtggcttccgaagggtttcagtattctgatagacggtggtgcttcgacggcgagcgcaacaatcaggttcttgaagagaacatggatgtggaaatttggacgaaggagggagagcgcaagaagctgcggcctagatggctggacgcccgcacctacagcgacccgctcgctctgcgggaatttaaagagttcgccgcgggcagacgctccgtgtctggggatcttatcctggaaatcggaaagctcccccagcacctgacacaacgggcccagaatgctctggacaacctcgtcatgcttcataatagcgagcagggcgggagagcctatcggcacgctatggaggaactgcctgataccattgagacactgatgctcctggcccttatcgccgttctgaccggaggcgtgacactctttttcctgtccggccgcgggctgggaaagaccagcattggcctcctttgtgtgatggcttcttccgtcctgctgtggatggcgagcgtggaaccccattggatcgccgcttctattatcctcgagtttttcctgatggttcttctgatccctgaacccgacagacagcggacgccgcaagataaccagctcgcctacgtggtcattgggctgctgtttatgatcctcacagtggccgctaatgagatgggacttctggagaccaccaaaaaggacctgggcattgggcacgtcgccgtggaaaaccaccatcacgcggccatgctcgatgttgacctgcatcctgcttccgcctggacactttacgctgtggccaccacaatcattacgcccatgatgcgccacaccatcgagaacacaaccgcgaatattagcctgacagccatcgctaaccaggccgctatcctcatgggactggataaaggctggcctatttctaagatggacatcggcgtccccctgctcgcccttgggtgctatagccaagtgaatcctctgaccctgacggctgccgttctcatgctggtggcgcattacgccattatcggacccggccttcaggctaaagccaccagagaagctcagaagcggacagccgccgggattatgaagaacccgaccgtcgatggaatcgtggcgatcgacctggatcctgtggtttatgacgctaaattcgagaagcagctcggccaaattatgctgctgatcctctgtacatcccagattcttctgatgcgcaccacgtgggccctgtgcgaatctatcacactcgctaccgggcccctgacaaccctttgggagggaagccccggcaaattttggaataccacaattgccgtctccatggccaacatcttcagaggcagctacctggctggggccggactcgcgttctccctgatgaagtctctgggcgggggacggcgcggcacgggggcccagggagagaccctcggcgaaaaatggaagagacagcttaatcaactgagcaagtccgagtttaacacatataaacggtctggcatcatggaagtggacagaagcgaggctaaggaagggctgaaacgcggagagaccacaaagcacgccgtgtcccggggcaccgctaaactcagatggttcgtcgagcgcaatctggttaagcctgaagggaaggtgattgatcttggatgtggcagagggggatggtcttactattgcgccggcctgaaaaaggtgacggaggtcaaaggctacacaaaagggggaccgggccacgaggagcccatccctatggcgacctacgggtggaacctcgtgaaactgcatagcggaaaggacgtctttttcattccccctgaaaaatgtgataccctgctctgcgacatcggcgagtccagccccaatcctacaattgaggaagggagaacccttcgcgtgctgaagatggtcgagccgtggctgcggggaaaccagttttgtatcaagattctcaatccctatatgccttctgtggttgaaacactggagcagatgcagagaaaacacggcggcatgcttgtgcgcaaccccctgtcccggaatagcacgcatgagatgtactgggtctcttgcgggaccggaaacatcgtgtccgccgtgaatatgacaagcagaatgctcctgaaccgcttcaccatggctcaccggaagcctacatatgaaagagatgtcgacctgggcgccgggacccgccacgttgctgtggagcccgaagtggccaacctcgatatcattggacaaagaatcgagaatattaaacatgaacacaagtctacgtggcattacgacgaggataacccgtataaaacctgggcttaccacggctcctatgaggtcaagcctagcgggtccgccagctctatggtgaatggagttgtgaagctgcttacaaaaccctgggacgtcatccccatggtgacccagattgcgatgacagataccacaccttttggccagcaacgggttttcaaggaaaaagtggacacccgcacgcccaaggccaaaagaggcacagctcagatcatggaggtcaccgccaagtggctgtgggggtttctcagccggaacaagaaacctagaatctgtacccgggaagagttcacacgcaaggtgagatccaatgctgccattggagccgtttttgtggacgaaaaccagtggaactctgcgaaagaggctgtcgaggatgaacggttctgggacctggtgcatcgcgagagagaacttcacaagcagggcaaatgcgccacgtgcgtctacaacatgatggggaagcgggagaagaaactgggagaatttggcaaggccaaagggagccgcgctatctggtacatgtggctcggcgccagattcctggagttcgaggctctgggatttatgaatgaagatcactggttctcccgggagaactctctcagcggcgtggaaggggagggactgcataaacttggctatattctgcgcgacatctccaaaattcccgggggaaatatgtacgccgatgacaccgcgggctgggatacaagaatcaccgaggacgatctccaaaacgaagccaagatcacagacattatggagcccgaacacgctctgcttgccaaatctatctttaagctgacctatcagaataaggttgtgcgggtccagcgccctgctaaaaacgggacagtgatggatgtgattagcagacgggaccagcgcggctccggacaagttggcacctacgggctcaatacgttcaccaacatggaggcccagctgatcagacagatggaaagcgagggaatcttttctccctccgagctggaaacacctaacctcgcgggccgggccctggattggcttgagaagcatggggtggaaagactgaaacgcatggctatcagcggagacgactgtgtcgtgaagcccatcgatgaccggttcgccaccgctctcacagccctgaatgatatgggcaaagttagaaaggacattccgcagtgggagccttctaaggggtggaacgattggcaacaggtgcccttttgctcccaccacttccatcagcttatcatgaaagacggccgcgaaattgtcgtgccttgtcggaatcaggatgagctggtcggcagagctcgcgtgagccaaggagccgggtggtccctccgggagaccgcgtgcctgggaaagtcttatgcccagatgtggcagctgatgtactttcacagacgcgacctccggctggctgccaacgccatctgtagcgctgttcccgtggattgggtccctacgtccagaacaacctggagcattcatgcccaccatcaatggatgacaaccgaagacatgctttctgtgtggaatcgcgtttggatcgaggaaaacccctggatggaggataaaacgcacatttccagctggggcgacgtgccgtatctggggaagcgggaagaccagtggtgcggatctctcatcggcctgaccgcgagagctacatgggccaccaatatccaggtcgccattaaccaggtgcggagacttctggggaatgagaactacctcgattacatgacaagcatgaaacgcttcaagaatgagtccgaccctgaaggcgctctgtggtga

SEQ ID NO: 19068 - RNA, 9879 nt, synthetic construct
  misc_feature 1..9879: note = derived and/or modified CDS sequence (opt5) from DENV-1__GQ199821__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaagtgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgttgtgggcctggtcacactgtaccttggggtgatggttcaggccgatagcggatgcgtgatcaactggaagggccgcgaactcaagtgtgggtccggaatttttgtcaccaatgaggtgcacacatggaccgaacagtataaattccaagctgactctcctaagcggctgagcgccgcgatcggcaaagcctgggaggagggggtttgcggcattagatccgctacgcgcctggaaaacatcatgtggaagcagatctctaacgagctcaatcatattctgcttgaaaacgacatgaaatttacagtggtcgtgggagatgtggccggcatcctggctcaggggaagaaaatgattcggccgcagcccatggagtacaagtatagctggaagtcctggggaaaagccaagatcattggcgccgacgtccaaaataccaccttcatcatcgatgggcctaacacacccgaatgtcctgacgatcagagagcttggaatatttgggaggttgaggactacggatttggcatcttcaccacgaacatttggctcaaactgcgcgatagctatacacaggtgtgcgaccaccggctgatgtctgcggccatcaaggattccaaagctgtgcacgccgacatgggctactggattgaaagcgagaagaatgaaacctggaaacttgccagagcttctttcatcgaggtcaaaacatgtatctggcccaagtcccataccctctggagcaacggggtgctggaatctgagatgattatcccgaaaatttatggaggccctatcagccagcacaattaccgccccgggtactttacacaaaccgccggaccttggcatctgggcaagctcgagctggatttcgacctttgcgaagggacgaccgttgtggtcgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggttaaggaaaaagaggaaaatctggtgaagtctatggtctccgcggggagcggagaggtggactccttctctcttggcctcctgtgtattagcatcatgattgaagaggttatgcggtccagatggtctcgcaaaatgctgatgacagggaccctcgctgtgtttttcctgcttatcatgggacagctgacatggaacgatctcattcggctgtgcatcatggtcggcgccaatgccagcgacagaatgggcatggggaccacctacctggctcttatggccacatttaagatgcgccctatgttcgcggtgggactgctctttagacggctgacgtcccgcgaggtgctcctgcttaccattggcctgtctctcgtcgctagcgttgaactgcccaactccctggaggaacttggggatggactggccatgggcatcatgatcctcaaactgctcacagacttccagagccatcaactgtgggccacccttctgtctctcacatttattaagaccacgttctccctgcactatgcttggaagacaatggccatggtgctgagcatcgtgtctctttttcccctgtgtctctccaccaccagccagaaaacaacctggctgcctgtcctcctggggtctcttggatgcaagccgctgacaatgttcctgattgctgagaataaaatctggggcagaaagtcctggcccctcaacgaaggcattatggccgtggggatcgttagcatcctgctttccagcctgctcaaaaacgatgtgcctctggcgggacccctcattgccggcgggatgctgatcgcttgttacgtcatttctggaagctccgccgacctttctctggagaaggctgccgaggtgagctgggaagaggaagccgagcattccggcgcttctcacaatatcctggttgaagtgcaggatgacgggacgatgaaaattaaggatgaggagcgggacgataccctcacaatcctgcttaaggcgaccctgctcgccgtcagcggagtgtatcctctgtccatccccgctacactcttcgtctggtacttttggcagaaaaagaaacaacgctctggcgtgctgtgggacaccccttcccctcccgaagttgagagagccgtgcttgatgacggcatttatcggatcatgcagcgcgggctgctgggaagatcccaggtcggcgtgggggttttccaggaaaacgtgtttcatacgatgtggcacgtcacccggggagccgtgctcatgtaccaaggcaagcgcctggagcccagctgggcttctgtgaaaaaggaccttatttcctacgggggaggctggagactgcagggcagctggaatacaggggaggaagttcaggtcatcgccgtggagcccggaaagaaccctaaaaatgtgcagaccgcgcccggcacattcaagacctctgaaggggaggtcggagctattgccctcgattttaaaccgggcacatccgggagccctatcgtgaaccgggaaggaaagattgttggcctgtatggcaatggggtggtcacgacctccggaacatacgtgtctgccatcgctcaagccaaagcgagccaggagggccccctccctgagatcgaagacgaggttttcagaaagcgcaacctgaccattatggatcttcaccccgggtccggaaagacccggagatatctgcccgctatcgtgcgcgaagccattaaacggaagctgagaacactcatcctggcccctacgcgcgtcgtggctagcgagatggccgaagctcttaaaggcatgccgattcggtaccagaccacagccgttaagtctgagcataccgggaaagagatcgtggacctgatgtgccacgcgacatttaccatgagactcctgtcccccgtccgcgtgcctaattataacatgatcattatggatgaagcccatttcacggaccccagctctatcgctgcccggggctacattagcacaagagtgggaatgggcgaggctgccgccatctttatgaccgctacccctcccgggtccgtcgaagcgttccctcaatctaatgccgttattcaggatgaggaacgggacatcccggagcgcagctggaactccggatatgagtggatcacagattttcccggcaagaccgtgtggttcgtgccttctattaagagcgggaatgacatcgctaactgtctgcgcaagaatggaaagcgggtcattcagctctcccgcaaaacattcgataccgaataccagaagacgaaaaacaacgactgggactacgtggttacaaccgatatcagcgagatgggcgccaattttagagccgaccgggtgattgatcccagacgctgccttaagcctgtcatcctgaaggacgggcccgaacgggtgattctggctggcccgatgcctgttacagtggcctctgcggctcaaagacgcggacggatcggcagaaaccacaataaagagggggatcagtatatctacatgggacagcccctcaacaatgacgaggatcatgcccactggaccgaagccaagatgctgcttgacaacattaatacgcccgagggcatcattcctgctctgttcgaacccgagcgcgaaaaatccgccgcgatcgatggggagtatcggctcagaggagaggcccgcaagacctttgtcgaactgatgagacggggcgacctgcctgtgtggctcagctacaaagtcgcttccgaggggttccagtattctgatcgcagatggtgctttgacggcgaacggaacaatcaagtgcttgaggaaaacatggatgttgagatttggacaaaggagggagaacgcaaaaagctgagaccgcggtggctggacgccagaacctacagcgaccccctcgctctgcgcgagttcaaggaatttgccgctggccggagatccgtgtctggggatcttatcctggagatcggaaaactccctcagcacctgacacagcgcgcccagaatgcgctggacaacctcgtgatgcttcataatagcgaacaaggcgggcgggcctatagacacgctatggaggagctgcccgataccattgaaacactgatgctcctggcccttatcgctgtcctgaccggaggcgttacgctgttctttctgtccggccgggggctgggaaagacaagcattggcctcctttgtgtgatggcctcttccgccctgctgtggatcgctagcgtggagcctcattggattgcggcctctatcatcctcgagttctttctgatggtccttctgattcccgagccggaccgccagagaacccctcaggataaccagctcgcttacgtggttatcgggctgctgttcatgattctcaccgtggccgccaatgagatgggacttctggaaacaaccaaaaaggacctgggcatcgggcacgtcgctgtggagaaccaccatcacgccgcgatgctcgatgtcgacctgcatcccgcctccgcttggacactttacgccgtggctacgaccattatcacacctatgatgcggcacaccattgaaaacacaaccgccaatatcagcctgacggcgatcgccaaccaagctgccattctcatgggactggataaaggctggcccatctctaagatggacattggcgttcctctgctcgctcttgggtgctatagccaggtgaatcccctgaccctgacagccgctgtcctcatgctggtggcccattacgcgatcattggaccgggccttcaggccaaggctacccgcgaggcccagaagagaacagctgccgggatcatgaagaaccctaccgttgatggaatcgtggccattgacctggatcccgtcgtgtatgacgcgaaatttgaaaagcagctcggccagatcatgctgctgattctctgtacgtcccagatccttctgatgcggacaacctgggctctgtgcgagtctattacactcgccaccgggcccctgaccacactttgggagggaagccctggcaaattctggaatacgaccatcgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcattatggaggttgaccggagcgaagccaaggaggggctgaaaagaggagagaccacgaagcacgctgtctcccgcggcacagccaagctccggtggtttgtggaaagaaatctggtgaaaccggaggggaaggtcatcgatcttggatgtggccgcgggggatggtcttactattgcgctggcctgaaaaaggttaccgaagtgaaaggctacaccaaagggggacccggccacgaggaacctattcccatggccacatacgggtggaacctcgtgaaactgcatagcggaaaggacgtcttctttatccctcccgagaagtgtgataccctgctctgcgacattggcgagtccagccctaatccgacaatcgaagaggggcggacgcttagagtgctgaaaatggttgaaccctggctgcgcggaaaccagttctgtattaagatcctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatattatcggacagcgcattgaaaatatcaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttattcctatggtgacccagatcgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatttgtacgagagaggaatttacccggaaggtgcgctccaatgccgctatcggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaaaatccccgggggaaatatgtacgctgatgacaccgccggctgggatacacgcatcaccgaagacgatctccagaacgaggcgaagattacagacatcatggaacctgagcacgccctgcttgctaagtctattttcaaactgacctatcagaataaggtcgtgagagttcaacggcccgccaaaaacgggacggtgatggatgtcatcagccgcagagaccagcggggctccggacaggtgggcacctacgggctcaatacatttaccaacatggaagctcagctgattcgccaaatggagagcgagggaatcttctctccttccgaactggagacacccaacctcgccggcagagtgctggattggcttgaaaagcatggggttgagcggctgaaaagaatggcgatcagcggagacgactgtgtggtcaagccgattgatgaccgctttgccaccgctctcacggccctgaatgatatgggcaaggtgcggaaagacatccctcagtgggaaccctctaaggggtggaacgattggcagcaggttcctttctgctcccaccactttcatcaacttattatgaaagacggcagagagatcgtggtcccctgtcgcaatcaggatgagctggtgggacgggctagagtcagccagggcgccgggtggtccctccgcgaaacagcttgcctgggaaagtcttatgcccagatgtggcaactgatgtacttccaccggagagacctccgcctggcggccaacgctatttgtagcgccgtgcctgttgattgggtgcccacctcccggacaacctggagcatccatgcccaccatcagtggatgacgaccgaggacatgctttctgtctggaatagagtgtggattgaagagaacccgtggatggaagataaaacacacatctccagctggggcgacgttccttatctggggaagcgcgaggaccagtggtgcggatctctcatcggcctgaccgctcgggccacatgggcgaccaatattcaagtggctatcaaccaggtcagacggcttattgggaatgagaactacctggattacatgacaagcatgaagagatttaaaaatgaatccgaccccgagggcgccctctggtga

SEQ ID NO: 19069 - RNA, 9879 nt, synthetic construct
  misc_feature 1..9879: note = derived and/or modified CDS sequence (opt5) from DENV-1__FJ882556__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttatcgcgatggacctgggggaactctgtgaagataccatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcagcgacaaagagaagcctgtgaacatcgaagctgagccgccctttggcgagtcttatattgtgatcggggccggagaaaaagcccttaagctcagctggttcaagaaaggctcctctattgggaagatgtttgaggctacagccagaggcgctcgccggatggccatcctgggagataccgcgtgggacttcggcagcatcgggggagtttttacatccgtcggcaaactggtgcatcagattttcgggaccgcctacggagtgctctttagcggcgtctcttggacgatgaagatcgggattggcgtgctgcttacctggctgggactcaattccagaagcacatctctgtccatgacctgtatcgctgttggcctggtgacactttacctcggggtcatggtgcaggccgatagcggatgcgttattaactggaaaggccgcgaactgaagtgtgggtccggaatcttcgtgaccaatgaggtccacacatggaccgaacaatataagtttcaggctgactctcctaaacggctgagcgccgcgattggcaaggcctgggaggagggggtgtgcggcatcagatccgctacgcgcctcgaaaacatcatgtggaaacagatttctaacgagctgaatcatatccttctggaaaacgacatgaagttcacagttgtggtcggagatgtggccggcattctcgctcaggggaaaaagatgatccggccgcaacccatggagtacaaatatagctggaagtcctggggaaaggccaaaattatcggcgccgacgtgcagaataccacctttatcattgatgggcctaacacacccgaatgtcctgacgatcagagagcttggaatatctgggaggtcgaggactacggattcggcatttttaccacgaacatctggctgaagctgcgcgatagctatacacaggtttgcgaccaccggcttatgtctgcggccattaaagattccaaggctgtgcacgccgacatgggctactggatcgaaagcgagaaaaatgaaacctggaagctcgccagagcttctttcatcgaggtgaagacatgtatttggcccaaatcccataccctgtggagcaacggggtcctggaatctgagatgatcattccgaagatctatggaggccctattagccaacacaattaccgccccgggtacttcacacaggccgcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcagaggggaggacggatgctggtatggcatggagattcggccggtgaaagaaaaggaggaaaatcttgttaagtctatggtgtccgctgggagcggagaggtcgactccttttctctcggcctgctgtgtatcagcattatgatcgaagaggtgatgagatcccgctggtctcggagaatgctcatgacggggacactggccgttttctttcttctgattatgggacagctcacctggaacgatctgatccgcctgtgcattatggtgggcgccaatgctagcgacagaatgggcatggggacaacctaccttgccctgatggcgaccttcaaaatgcggcctatgtttgctgtcggactcctgttccgcagactcacatcccgggaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcatcaaaacaaccttttccctgcactatgcctggaagacgatggctatggttcttagcattgtgtctctgttccccctctgtctgtccacaaccagccagaaaaccacatggctccctgtgctgcttgggtctctgggatgcaagccgctgaccatgtttctcatcgccgagaataagatttggggccgcagatcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgaggtcagctgggaagaggaagctgagcattccggcgcgtctcacaatattctcgtggaagttcaggatgacgggacaatgaaaatcaaggatgaggagcgggacgatacgctgaccatccttctgaaagccacactcctggctgtgagcggagtctatcctctctccattcccgccaccctgttcgtgtggtacttctggcaaaagaaaaagcagcgctctggcgtcctttgggacacacctagccctcccgaagtggagagagccgttctggatgacggcatctatcggattatgcagcgcgggctgctcggaagatcccaggtgggcgtcggggtgtttcaagaaaacgttttccataccatgtggcacgtgacgcggggagctgtcctgatgtaccagggcaagagacttgagcccagctgggcctctgtgaaaaaggacctgatctcctacgggggaggctggcgcctccagggcagctggaataccggggaggaagtgcaggttattgcggtcgagcccggcaagaatcctaagaatgtgcaaacagctcccggcacctttaaaacaccggaaggggaggtgggagccatcgccctggatttcaagcctggcacctctgggtcccccattgtcaaccgggaaggaaagatcgtgggcctctatggcaatggggttgtgacaacgagcggaacctacgtctccgctatcgcccaggcgaaggcttctcaggagggccctctgcccgagattgaagacgaggtgtttagaaagcgcaaccttacaatcatggatctgcaccccgggagcggaaaaacccggagatatctgcctgccattgttcgcgaagccatcaagcggaaactcagaaccctgattcttgctccgacacgcgtggtcgcctccgagatggctgaagccctgaagggcatgcccatccggtaccaaacgaccgcggtgaaaagcgagcatacagggaaagagatcgttgacctcatgtgccacgccaccttcacaatgagactgctgtctcctgtgcgggtccccaattataacatgattatcatggatgaagctcattttaccgacccttccagcattgccgctcgcggctacatctctacgagagtgggaatgggcgaggccgccgctattttcatgacagcgacaccccctgggagcgtggaagcctttccgcagtccaatgctgtcatccaggatgaggaacgggacatccccgagcgctcttggaacagcggatatgagtggattaccgatttccctggcaagacagtttggtttgtgccctccatcaaatctgggaatgacattgccaactgtctcagaaagaatggaaaacgggtgatccagcttagcagaaagaccttcgatacagaataccaaaagaccaaaaacaacgactgggactacgtcgtgacgacagatatttccgagatgggcgccaatttccgcgctgaccgggttatcgatcctagacgctgcctgaagcccgtgattctgaaagacgggccggaacgggtcatcctcgccggccctatgcccgtgaccgttgcgagcgctgcccagagacgcggacggatcggcagaaaccacaataaggagggggatcagtatatttacatgggacagcccctgaacaatgacgaggatcatgcccactggacagaagctaaaatgcttctggacaacatcaatacccctgagggcattatccccgccctctttgaacctgagcgcgaaaagtctgcggccattgatggggagtatagactgcggggagaggctcgcaagacgttcgtggaactgatgagacggggcgacctcccggtctggctttcctacaaagtggccagcgaggggtttcaatattccgatcgcagatggtgcttcgacggcgaacggaacaatcaggtcctggaggaaaacatggatgtggagatctggaccaaggagggagaacgcaaaaagctgcgcccccggtggctcgacgctagaacatactctgaccctctggcccttcgcgagtttaaagagttcgctgccggccggagaagcgtttccggggatctgatcctcgagattggaaagctgccccagcacctgacccagcgggcgcaaaatgccctcgacaaccttgtgatgctgcataattctgaacagggcgggcgcgcttatagacacgccatggaggagctgcctgatacaatcgaaaccctcatgctgcttgctctgattgccgtgctcacaggaggcgtcaccctgtttttcctgagcggccgggggctcggaaaaacgtccatcggccttctgtgtgttatggccagctctgtgctgctctggatggcttccgtggagccccattggattgcggccagcatcatcctggaatttttccttatggtcctgctcattccggagcctgaccgccagagaacaccccaggataaccaactggcttacgtggttatcgggctgctctttatgattcttaccgtggccgccaatgagatgggactgctggaaaccacaaagaaggacctcggcatcgggcacgtcgctgtggagaaccaccatcacgccgcgatgctggatgtcgaccttcatcctgcctctgcttggaccctgtacgccgtggctacaacgattatcacccccatgatgcggcacacaattgaaaacaccacagccaatatctccctcaccgcgatcgccaaccaggctgccattctgatgggactggataaaggctggcctatcagcaagatggacattggcgttcccctccttgctctggggtgctattctcaggtgaatccgctgacgctcaccgccgctgtcctgatgcttgtggcccattacgcgatcattggacctggcctgcaagccaaagctacacgcgaggcccagaagagaaccgctgccgggatcatgaaaaaccccacagttgatggaatcgtggccattgacctcgatcccgtcgtgtatgacgcgaagttcgaaaagcagctgggccagatcatgctgctcattctttgtaccagccaaatcctgctgatgcggacgacatgggctctctgcgagtccattaccctggccacagggcctcttaccaccctgtgggagggatctccgggcaaattttggaatacaacgatcgctgtgagcatggccaacatcttccgcggctcctacctcgccggggctggactggccttcagcctgatgaagtccctcggcgggggaagacggggcaccggggcgcagggagaaacacttggcgagaaatggaagagacagctgaatcagctgtctaaaagcgaatttaacacctataagcgctccggcattatggaggttgaccggtctgaagccaaggaggggctcaaaagaggagagacaaccaagcacgctgtcagccgcggcacggccaaactgcggtggttcgtggaaagaaatcttgtgaagcccgaggggaaagtcatcgatctgggatgtggccgcgggggatggtcctactattgcgctggcctcaagaaggttacagaagtgaaaggctacaccaaagggggacctggccacgaggaacccattcctatggccacctacgggtggaacctggtgaaactgcattctggaaaggacgtctttttcattccccctgagaaatgtgatacactcctttgcgacattggcgagagctccccgaatcccaccatcgaagaggggcggacactgagagtgctgaagatggttgaaccttggctccgcggaaaccaattttgtattaaaatcctgaatccctatatgcctagcgtggtcgagacgcttgagcagatgcagcggaagcacggcggcatgctggtgagaaaccccctctctcgcaattccacccatgaaatgtactgggttagctgcgggacaggaaacatcgtgtctgcggtcaatatgacctcccggatgctgctgaacagattcacaatggcccaccgcaagccgacctatgagagagatgtggacctcggcgctgggacgcggcacgtggccgtcgaacctgaggttgctaacctggatattatcggacagcgcattgaaaatatcaaacatgagcacaagagcacctggcattacgacgaggataacccctataaaacatgggcctaccacggctcttatgaagtgaagccctccgggagcgcttccagcatggtgaatggagtcgtgaaacttctgaccaagccttgggacgttattcccatggtgacacaaatcgccatgaccgatacaaccccttttggccagcagagagtcttcaaggagaaagtggacacgcggacaccgaaggcgaaaagaggcaccgcccaaatcatggaagttaccgctaagtggctctgggggtttctgtctcggaacaaaaagccccgcatttgtacaagagaggagttcacgcggaaggtgcgcagcaatgccgctatcggagccgtctttgtggacgagaaccagtggaactccgccaaagaggcggttgaagatgagagattctgggaccttgtgcatcgggaacgcgagctgcacaagcagggcaaatgcgctacctgcgtctacaacatgatggggaagagagagaaaaagctcggagagtttggcaaggccaaagggtctcgggccatttggtacatgtggctgggcgctcgcttcctggagttcgaagccctcggatttatgaatgaggatcactggttcagcagagaaaactccctgtctggcgtggagggggagggacttcataagctgggctatatcctccgggacattagcaaaatccctgggggaaatatgtacgctgatgacacagccggctgggatacccgcatcacagaagacgatctgcagaacgaggcgagaattaccgacatcatggaacccgagcacgcccttctggctaagtccatttttaaactcacatatcaaaataaggtcgtgcgggttcagcgccctgccaaaaacgggaccgtgatggatgtcatctctagacgggaccagagaggcagcggacaggtgggcacgtacgggctgaataccttcacaaacatggaagctcaactgattcgccagatggagtccgagggaatctttagcccctctgaactcgagaccccgaacctggccgaacgggtgcttgattggctggagaagtatggcgttgaaagactcaagcgcatggcgatctccggggacgactgtgtggtcaaacctattgatgaccggttcgccacagctctgaccgcccttaatgatatgggaaaggtgagaaaagacatcccccagtgggagcctagcaagggctggaacgattggcagcaagttcccttttgctctcatcacttccaccagctgattatgaaagacgggcgcgagatcgtggtcccttgtcggaatcaggatgaactcgtgggcagagctcgcgtctcccagggagccggctggagcctgcgggagacggcttgcctggggaagtcctacgcccaaatgtggcagctcatgtattttcatagacgcgacctgcggcttgcggccaacgctatttgttctgccgtgcccgttgattggatcccgacaagcagaaccacatggtccattcacgcccatcaccagtggatgaccacggaagacatgctgagcgtgtggaatcgggtctggatcgaggaaaacccttggatggaggataagacccatatctcttcctggggagacgtgccctacctcggcaaaagagaggaccaatggtgcgggagcctgattggacttacagctcgcgccacctgggcgacaaatatccaggttgctattaaccaggtgcggagactgatcggcaatgaaaactacctcgattatatgacctctatgaagcgcttcaaaaatgagagcgaccccgaaggggccctgtggtga

SEQ ID NO: 19070 - RNA, 9879 nt, synthetic construct
  misc_feature 1..9879: note = derived and/or modified CDS sequence (opt5) from DENV-1__GQ199822__SS-prME
  source 1..9879: mol_type = other RNA
agcgtgaccatgctgctcatgctgatgcccacagcccttgctttccacctgacgaccagaggaggggaacctcatatgatcgtgacaaagcaggaacggggaaaatcccttctgtttaagacctctgccggcgttaacatgtgcacacttattgcgatggacctgggggaactctgtgaagataccatgacatacaaatgccccagaatcaccgaagctgaacccgacgatgtggactgttggtgcaatgccacggatacctgggtgacatatggaacctgtagccaaacaggcgaacacagacgggacaagcgctccgtggccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggcagagccaagatcattggagccgacgtccagaataccacctttatcatcgatgggcctaacacacccgaatgtcctgacgatcagcgcgcttggaatatttgggaggttgaggactatggattcggcatctttaccacgaacatttggctgaaactgcgggattcctacacacaggtgtgcgaccacagacttatgagcgcggccatcaaggattctaaagctgtgcatgccgacatgggctattggattgaatccgagaagaatgaaacctggaaactcgcccgcgctagcttcatcgaggtcaagacatgtatctggcccaagtctcacaccctgtggtccaacggggtgctggaaagcgagatgattatcccgaaaatttacggaggccctatctctcaacataattatcggcccgggtacttcacacagaccgccggaccttggcacctcggcaagctggagcttgattttgacctgtgcgaagggacgaccgttgtggtcgatgagcactgcggaaacagaggccccagcctccggacaaccacagtgaccggcaaaattatccatgaatggtgttgccgctcctgtacgctgcctcccctgagattcaagggggaggacggatgctggtacggcatggagatccggccggttaaagaaaaggaggaaaatcttgtcaagagcatggtctctgcggggtccggagaggtggacagcttttccctcggcctgctgtgtatttctatcatgattgaagaggttatgagaagccgctggtcccggaaaatgctcatgacagggaccctggctgtgttccttctgctcatcatgggacagctgacatggaacgatctgattagactttgcatcatggtcggcgccaatgcctctgaccgcatgggcatggggaccacctatctggctctcatggccacatttaagatgagacctatgttcgcggtgggactgctctttcggcgcctgacgagcagagaggtgcttctgctcaccattggcctgtccctggtcgcttctgttgaacttcccaacagcctggaggaactcggggatggactggccatgggcatcatgatcctcaaactgcttacagacttccaatcccaccagctgtgggccaccctcctgagcctgacatttattaagaccacgctttctctgcattacgcttggaaaacaatggccatggtgctctccatcgtgagcctgttccccctctgtctgtctaccacctcccagaagacaacctggcttcctgtcctgctggggagcctcggatgcaagccgctgacaatgtttcttattacggagaataaaatctggggccggaagtcttggcccctgaacgaaggcattatggctgtgggggttgtgtccatcctcctgagctccctcctgaaaaacgatgtccctcttgccggacccctgatcgcgggcgggatgctgattgcctgttatgtgatcagcggatctagcgctgacctctccctggagaaggccgctgaggtttcttgggaagaggaagccgagcacagcggcgcctcccataatattcttgtggaagtccaggatgacgggaccatgaaaatcaaggatgaggagcgcgacgatacactgaccattctcctgaaagctacactcctggcggtgtctggagtctaccctcttagcatccccgccaccctgttcgtgtggtatttttggcaaaagaagaaacagagatccggcgttctgtgggacacgccttctcccccggaagtggagcgggctgtcctcgatgacggcatctaccgcattatgcagagagggctgcttggacggagccaggtgggcgttggggtgttccaagaaaacgtcttccacaccatgtggcacgtgacacgcggagccgtgctgatgtatcagggcaagagactcgagccttcctgggccagcgttaaaaaggacctgatctcttacgggggaggctggcggctccagggctcctggaataccggggaggaagtccaggtgattgctgtggagcccggcaagaaccctaagaatgtccaaacagcccccggcacctttaagacaccggaaggggaggtgggagcgatcgctctggatttcaaacctggcacgagcgggtctcccattgttaacagagaaggaaagatcgtgggcctttacggcaatggggtcgtgaccacatccggaacctatgttagcgccattgcccaggctaaagcctcccaggagggccctctgcccgagatcgaagacgaggtgtttcgcaagcggaacctgaccatcatggatctccatcccgggtctggaaaaacaagacgctacctgcctgcgcttgtccgggaagctattaagagaaagctgcgcacgctcatcctggccccgacccgggtggttgccagcgagatggctgaagccctgaaaggcatgcccattagatatcaaacaaccgctgtgaagtccgagcacacagggaaagagatcgtcgacctcatgtgccatgccaccttcacgatgcgccttctgagccctgtgcgggtgcccaattacaacatgattatcatggatgaagcgcactttacagacccttcttccatcgccgctagaggctatattagcacccgggtcggaatgggcgaggccgctgccatcttcatgaccgccacaccccctgggtctgttgaggcttttccgcagagcaatgcggtgattcaggatgaggaacgcgacatccccgagagatcctggaactctggatacgagtggattaccgatttccctggcaagacagtgtggtttgtccccagcatcaaatccgggaatgacatcgccaactgtctgcggaagaatggaaagcgcgtgattcagctctctagaaaaaccttcgatacggaatatcaaaagaccaagaacaacgactgggactacgttgtgaccacagatatcagcgagatgggcgctaattttcgggccgacagagtcattgatcctcgccggtgcctgaagcccgtgatccttaaagacgggccggaaagagttattctggccggccctatgcccgtgaccgtcgcttccgccgcgcagcgccggggaagaatcggccgcaaccataataaggagggggatcagtacatttatatgggacagcccctcaacaatgacgaggatcacgctcactggacggaagccaagatgctgctggacaacatcaatacccctgagggcatcattcccgccctcttcgaacctgagcgggagaaaagcgctgccatcgatggggagtacagacttcgcggagaggcgagaaagacattcgtggaactgatgcggcgcggcgacctgccggtctggctctcttataaagtggcctccgaggggtttcaatacagcgatagacggtggtgcttcgacggcgaacgcaacaatcaggttctggaggaaaacatggatgtggagatttggaccaaggagggagaacgcaagaaacttcggcccagatggctggacgctcgcacatattccgaccctctcgccctgcgggagtttaaagagttcgctgccggcagacgctctgtgagcggggatctgatcctcgagattggaaaacttccccagcatctgacccagcgggctcaaaatgccctggacaacctcgtcatgctgcacaattccgaacagggcgggagagcgtaccggcatgccatggaggagcttcctgatacaatcgaaaccctgatgctcctggctctgatcgccgttctcacgggaggcgtgacactctttttcctgtctggccgcgggctgggaaagaccagcattggcctcctgtgtgtgatggcttccagcgtccttctgtggatggcctctgtggagccccactggatcgccgcttccattatcctcgaatttttcctgatggttctgctcattccggagcctgacagacagcggacaccccaggataaccaacttgcgtatgtggtcatcgggctgctgtttatgatcctcacagtggccgctaatgagatgggactgcttgaaaccaccaaaaaggacctgggcattgggcacgtcgccgtggagaaccatcaccatgccacgatgctcgatgttgacctgcaccctgctagcgcctggaccctgtacgcggtggccacaaccatcattacacccatgatgcgccataccatcgaaaacacgaccgctaatatttctctcacagccatcgctaaccaggccgcgattcttatgggactggataaaggctggcctatctccaagatggacatcggcgtccccctgctcgccctggggtgctacagccaggtgaatccgcttaccctgacagctgccgttctcatgctggtggctcactatgccattatcggacctggcctgcaagctaaagccaccagagaggcgcagaagcggacggccgctgggattatgaagaaccccacagtcgatggaatcgtggccattgacctcgatcccgtggtttacgacgctaaattcgaaaagcagcttggccagatcatgctgctgatcctctgtacctctcaaattctgcttatgcgcacaacctgggccctgtgcgagagcatcaccctcgccacagggcctctgacgaccctgtgggagggatccccgggcaaattttggaatacaaccattgcggtctctatggctaacatcttcagaggcagctatctcgccggggctggacttgccttttccctgatgaaaagcctgggcgggggacggcgcggcacaggggcccagggagaaaccctcggcgagaagtggaagagacagctgaatcagctttccaagtctgagttcaacatttacaaacggagcggcatcatggaggtggacagatccgaagctaaggaggggctgaaacgcggagagacgacacggcacgccgtgtctagaggcaccgcgaagctccgctggttcgtcgaacggaatctggttaaacccgaggggaaggtgatcgatctgggatgtggcagagggggatggagctattactgcgccggcctcaagaaagtgaccgaagtcaagggctatacaaaagggggacctggccatgaggaacccattcctatggctacctacgggtggaaccttgtgaagctgcactccggaaaagacgtctttttcacaccccctgagaagtgtgatacgctgctctgcgacatcggcgagtctagcccgaatcccaccattgaagaggggcgcacactgcgggtgcttaaaatggtcgaaccttggctgagaggaaaccaattttgtatcaagattctcaatccctacatgccttccgtggttgagaccctggagcagatgcagcgcaagcatggcggcatgctggtgcggaaccccctcagcagaaattctacacacgaaatgtattgggtctcctgcgggaccggaaacatcgtgagcgccgtgaatatgacgtctcgcatgctgcttaaccggttcaccatggctcacagaaaaccgacatacgagcgcgatgtcgacctgggcgccgggaccagacatgttgcggtggaacctgaggtggccaacctcgatattatcggacagcggatcgaaaatattaagcacgagcataaatccacatggcactatgacgaggataacccctacaagacctgggcttatcatggcagctacgaagtcaaaccctctgggtccgccagctccatggtgaatggagttgtgaagctgcttacaaagccttgggacgtcatccccatggtgacccaaattgctatgacggatacaaccccttttggccagcagcgcgttttcaaagagaaggtggacaccagaacaccgaaagccaagcggggcacggctcaaatcatggaagtcaccgccagatggctgtgggggtttctcagccggaacaaaaagccccgcatttgtacaagagaggagttcacccggaaggtgcgctctaatgcggccatcggagctgtttttgtggacgagaaccagtggaatagcgccaaagaggctgtcgaagatgagagattctgggacctggtgcagaaggaacgggagctgcacaaacagggcaagtgcgccacatgcgtctataacatgatggggaaacgcgaaaagaagctcggagagtttggcaaagccaaggggtccagagcgatctggtacatgtggctgggcgctcggttccttgagtttgaagccctgggattcatgaatgaggatcactggttctctcgcgaaaacagcctctccggcgtggagggggagggactgcataaacttggctacattctgagagacatctctaagattcctgggggaaatatgtatgccgatgacaccgctggctgggatacacggatcaccgaagacgatctccaaaacgaggccaaaattacggacatcatggaacccgagcacgctctgctggccaccagcatctttaagctcacataccagaataaagttgtgcgcgtccagagacctgcgaagaacgggaccgtgatggatgtgatttcccggcgcgaccagagaggctctggacaagttggcacatatgggctgaataccttcacgaacatggaagcccagcttatccggcagatggagagcgagggaatttttctgccctccgaactcgagacaccgaacctggctgaaagagtgcttgattggctggagaagtacggcgtcgaacgcctcaaacggatggccatcagcggggacgactgtgtggttaagcctattgatgacagattcgctaccgccctgacagcgctgaatgatatgggaaaagtgcgcaaggacatcccccagtgggagccttctaaaggctggaacgattggcaacaggtccccttttgctcccatcacttccaccagctcatcatgaaggacgggcgggagattgtggtcccttgtagaaatcaggatgaactggtgggccgcgcccgggttagccaaggagctggctggtctcttagagagaccgcctgcctggggaagtcctatgctcagatgtggcagctcatgtactttcatcgccgggacctgagacttgccgctaacgccatctgtagcgcggtgcccgtcgattgggtgccgacgtcccgcaccacatggtctattcacgcccatcaccaatggatgaccacagaagacatgctgagcgtttggaatcgggtgtggatcgaggaaaacccttggatggaggataaaacccatgtctccagctggggagacgtgccctatctcggcaagagagaggaccagtggtgcgggtctctgattggactgacagctcgggccacctgggcctccaatatccaggtggctattaaccaggttagacgcctcatcggcaatgaaaactacctggattacatgacgagcatgaaacggttcaagaatgagggggaccccgaaggcgccctttggtga

SEQ ID NO: 19071 - RNA, 9879 nt, synthetic construct
  misc_feature 1..9879: note = derived and/or modified CDS sequence (opt5) from DENV-1__FJ882557__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaagtctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactgattcatcagatcttcgggaccgcttacggagtgctcttttccggcgtgagctggacgatgaagattgggatcggcgtcctgcttacctggctgggactcaattctagatccacaagcctgtctatgacctgtattgccgtgggcctggttacactttacctcggggtgatggtccaggctgattccggatgcgtgatcaactggaaaggccgcgaactgaagtgtgggagcggaattttcgttaccaatgaggtgcacacatggaccgaacaatataagtttcaggccgactcccctaaacggctgtctgcggccatcggcaaggcttgggaggagggggtctgcggcatcagaagcgccacgcgcctcgaaaacattatgtggaaacagatctccaacgagctgaatcatattcttctggaaaacgacatgaagctcacagtggttgtgggagatgtcgctggcatcctggggcagggcaagaagatgattcggccgcaacccatggagtacaaatattcttggaaaagctggggcaaggccaagatcatcggggccgacgctcagaataccaccttcattatcgatggacctaacacacccgaatgtcctgacgatcagagagcgtggaatatttgggaggtggaggactacggctttggcatcttcaccacgaacatttggctgaaacttcgcgattcctatacacaggtgtgcgaccaccggctcatgagcgccgctatcaaagattctaaggccgtccacgccgacatggggtactggatcgaatccgagaaaaatgaaacctggaagctggctagagccagctttattgaggttaagacatgtatctggcccaaatctcataccctgtggtccaacggagtgctcgaaagcgagatgattatcccgaagatttatggcgggcctatctctcaacacaattaccgccccggatacttcacacagaccgcgggcccttggcatctggggaaacttgagctggatttcgacctctgcgaaggaacgaccgtggtcgtggatgagcactgcggcaaccggggccccagcctgagaacaaccacagttaccgggaagatcattcacgaatggtgttgccggtcctgtacgctgcctccccttcgctttagaggagaggacggctgctggtatgggatggagatccggccggtgaaagaaaaggaggaaaatctcgtcaagagcatggtgtctgctggatccggcgaggttgacagcttctccctggggctgctctgtatttctatcatgattgaagaggtgatgagaagccgctggtcccggaaaatgctgatgacaggaacccttgccgtctttttcctgctcatcatgggccagctgacatggaacgatctgattagactttgcatcatggtgggcgccaatgcttttgaccgcatggggatgggaaccacctacctggccctcatggcgacattcaagatgagacctatgtttgctgttggcctcctgttccggcgcctgacgtctagagaggtgcttctgctcaccatcgggctgagcctggtcgcctccgtggaacttcccaactctctggaggaactcggagatggcctggccatggggattatgatcctcaaactgcttacagactttcaaagccatcagctgtgggctaccctcctgtccctgacattcattaagaccacgtttagccttcactatgcctggaaaacaatggctatggtgctgtctatcgtctccctcttccccctgtgtctcagcaccacctctcagaagacaacctggctgcctgttcttctgggatccctgggctgcaagccgctcacaatgtttctgattgccgagaataaaatctggggccggaagtcctggccccttaacgaagggatcatggcggtgggaattgtgtctatcctgctctccagcctgctcaaaaacgatgtccctctggccggcccccttattgctgggggaatgctgatcgcctgttacgtgatttccggcagctctgctgacctgagcctcgagaaggccgccgaggtttcctgggaagaggaagctgagcattctggggcgagccacaatatcctggtggaagtccaggatgacggaacgatgaaaatcaaggatgaggagcgcgacgatacccttacaattctgctcaaagccaccctgctcgctgtgtccggcgtttatcctctgtctatccccgccacacttttcgtgtggtacttctggcaaaagaagaaacagagaagcggcgtcctgtgggacacccctagccctcccgaagtggagcgggccgtcctggatgacgggatttatcgcatcatgcagagaggactcctgggccggtctcaggtgggggttggagtgtttcaagaaaacgtcttccatacgatgtggcacgtgacccgcggcgctgttcttatgtaccaggggaagagactggagcccagctgggcctccgtgaaaaaggacctcattagctacggaggcggctggcggctgagagggtcttggaatacaggagaggaagtccaggtgatcgcggtggagcccggcaaaaaccctaagaatgttcagaccgctcccgggacatttaagaccccggaaggagaggtcggcgccattgccctcgatttcaaacctgggacatccggaagccccatcgtgaaccgcgaaggcaagatcgtgggcctgtatgggaatggagtcgtgacgacctctggcacatacgtttccgctattgcccaagcgaaagctagccaggaggggcctcttcccgagatcgaagacgaggtgtttcggaagagaaacctgaccattatggatctgcaccccggatccggcaaaacccgccggtatctccctgccatcgtcagagaagccattaagcgcaagctgcggacacttatcctggctccgacgagagtggttgcctctgagatggctgaagccctcaaagggatgcccatccgctaccagaccacagcggtcaagagcgagcataccggcaaagagattgtcgacctgatgtgccacgccacattcaccatgcggctgctctcccctgtgagagttcccaattataacatgatcattatggatgaagctcattttacggaccctagctctatcgccgctcggggatacatttccacacgcgtgggcatgggggaggccgccgctatcttcatgaccgcgacaccccctggaagcgtcgaagcctttccgcaatctaatgctgtgatccaggatgaggaaagagacattcccgagcggagctggaactccggccacgagtggatcacagatttccctgggaagaccgtgtggtttgtcccctctattaaaagcggaaatgacatcgccaactgtcttcgcaagaatggcaagagagttattcagctgtcccggaaaacattcgataccgaatatcagaagacgaaaaacaacgactgggactacgtggtgacaaccgatatctctgagatgggggccaatttcagagctgaccgcgtcattgatcctcggagatgcctgaagcccgtgatcctcaaagacggcccggaacgcgttatcctggccggacctatgcccgtgacagtcgcgagcgctgcccaacggagaggccgcattgggcggaaccataataaggagggagatcagtacatctatatgggccagccccttaacaatgacgaggatcacgcccactggaccgaagctaagatgctgctcgacaacattaatacgcctgaggggatcattcccgccctgtttgaacctgagagagaaaaatccgcggccgtggatggagagtaccgcctgagaggcgaggctcggaagaccttcgttgaactcatgcgcagaggggaccttccggtgtggctgagctataaagtcgcctctgagggctttcagtactccgatcggcgctggtgcttcgacggagaaagaaacaatcaagtgctggaggaaaacatggatgtcgagatctggacaaaggagggcgaacggaaaaagctcagaccccgctggctggacgctcggacctatagcgaccctcttgccctgagagagtttaaagagttcgctgccgggcgccggtccgtgtctggagatctcatcctggagattggcaagctgccccagcatctcacacagagagcgcagaatgcccttgacaacctggttatgctgcacaatagcgaacaagggggacgggcttaccgccatgccatggaggagctccctgataccatcgaaacactgatgcttctggctctcattgccgtgctgaccggcggcgtgacgctgtttttcctctccgggagaggacttggcaagacatctatcgggctgctgtgtgtcatggccagctccgttctcctgtggatggctagcgtggagccccactggattgcggcctctatcatccttgaatttttcctgatggtgctcctgattccggagcctgaccggcagcgcacaccccaggataaccagctggcttatgtcgtgatcggactcctttttatgattctgaccgttgccgccaatgagatgggcctgctcgaaacaaccaaaaaggacctggggatcggacacgtggctgtcgagaaccatcaccatgccgcgatgcttgatgtggacctgcaccctgcctccgcttggacactctacgccgtcgctacgaccattatcacacccatgatgagacataccattgaaaacacaaccgccaatatcagcctgacggcgatcgccaaccaagctgccattctgatgggcctcgataaaggctggcctatctctaagatggacattggggtgccccttctggctctgggatgctactcccaggttaatccgctcaccatgacagccgctgtgctgatgcttgtcgcccactatgcgatcattggccctgggctgcaggccaaagctacccgggaggcccaaaagcgcacagctgccggaatcatgaagaaccccaccgtggatggcatcgttgccattgacctcgatcccgtggtctacgacgcgaaattcgaaaagcagctggggcagatcatgctgctcattctttgtacgagccagatcctgctgatgagaacaacctgggctctctgcgagtctattacactggccaccggacctcttaccacactgtgggagggcagcccgggcaaattttggaatacgaccatcgctgtgtccatggccaacatcttccgggggtcttatctcgccggagctggcctggccttcagcctgatgaagtccctcgggggaggccgcagagggacaggagcgcaaggcgaaacccttggcgagaaatggaagcggcagctgaatcagctgagcaagtccgaatttaacacatacaaaagatctgggattatggaggtggaccgcagcgaagccaaggagggactcaaacggggcgagaccacgaagcacgctgtttccagagggacagccaaactgcgctggttcgtcgaacggaatcttgtgaagcccgagggaaaggtgatcgatctgggctgtgggagaggaggctggtcttattactgcgctggcctcaaaaaggtcaccgaagttaaagggtataccaagggaggccctgggcatgaggaacccattcctatggccacatacggatggaacctggtgaaactgcacagcggcaaggacgtgtttttcattccccctgagaaatgtgataccctcctttgcgacatcggggagtcctctccgaatcccacaatcgaagagggacgcacgctgcgggtcctgaagatggtggaaccttggctcagaggcaaccagttttgtattaagatcctgaatccctacatgcctagcgttgtggagacccttgagcaaatgcagcgcaaacatggcgggatgctggtccggaaccccctctccagaaatagcacacacgaaatgtattgggtgtcttgcggaaccggcaacatcgtttccgcggtgaatatgacaagccgcatgctgctgaaccggttcaccatggcccacagaaagccgacgtacgagcgcgatgtcgacctcgggaccggaacaagacatgtggctgtggaacctgaggtcgccaacctggatattatcggccagcggattgaaaatatcaaacacgagcataagtctacctggcactatgacgaggataacccctacaaaacatgggcttatcatgggtcctacgaagttaagcccagcggatctgcctccagcatggtgaatggcgtggtcaaacttctgaccaaaccttgggacgtgattcccatggttacacagatcgctatgaccgatacgacaccttttggccaacagcgcgtgttcaaggagaaagtcgacaccagaaccccgaaggccaaacgggggacagcgcagatcatggaagtgacggccagatggctctggggatttctgtcccggaacaagaagccccgcatttgtaccagagaggagttcacacggaaagttcgcagcaatgctgccatcggcgctgtgtttgtcgacgagaaccaatggaactctgccaaggaggccgtggaagatgagagattctgggaccttgttcaccgggaacgcgagctgcacaaacaggggaagtgcgcgacctgcgtgtataacatgatgggaaaaagagaaaagaagctcggcgagtttgggaaagctaagggcagccgggccatttggtacatgtggctgggagcccgcttcctggagttcgaagctctcggctttatgaatgaggatcattggttctccagagaaaactctctgagcggggtcgagggagagggccttcacaaactggggtacatcctccgggacatttccaagatccctggaggcaatatgtatgccgatgacacagctgggtgggatacccgcatcacagaagacgatctgcagaacgaggccaaaattaccgacatcatggaacccgagcatgcgcttctggccaaggctatttttaaactcacgtaccagaataaggtggtcagagtgcaacggcctgccaagaacggcaccgttatggatgtgatctctcgcagagaccagcggggaagcggccaggtcgggacatatggactgaataccttcacaaacatggaagctcagctgattagacaaatggagtccgagggcatcttttctcccagcgaactcgagaccccgaacctggccgaacgcgcgcttgattggctggagaaatacggggtggaacggctcaagagaatggccatctccggagacgactgtgtggttaaacctattgatgaccgcttcgctacggccctgacagctcttaatgatatgggcaaggtgcggaaagacatcccccagtgggagcctagcaaggggtggaacgattggcagcaggtccccttttgctctcaccacttccatcaactgattatgaaggacggcagagagatcgtggttccttgtcgcaatcaggatgaactcgtgggacgggccagagtctcccagggcgctgggtggagcctgcgcgagaccgcctgcctgggaaaatcttatgcgcagatgtggcaactcatgtactttcaccggagagacctgcgccttgccgctaacgccatttgttccgccgtgcccgtcgattgggtgccgacaagccggaccacgtggtccatccatgctcaccatcagtggatgaccacagaagacatgctgtctgtttggaatagagtgtggattgaggaaaacccttggatggaggataagacccacatcagctcctgggaggacgtcccctatctcggcaaacgggaagaccagtggtgcgggagcctgatcggacttacagccagagcgacctgggctacaaatattcaagtggccatcaaccaggttcgccggctgattggcaatgagaactacctcgattacatgacctctatgaagagattcaaaaatgaatccgaccccgagggggccctgtggtga

SEQ ID NO: 19072 - RNA, 9879 nt, synthetic construct
  misc_feature 1..9879: note = derived and/or modified CDS sequence (opt5) from DENV-1__FJ882558__SS-prME
  source 1..9879: mol_type = other RNA
agcgtgaccatgctgctgatgctgatgcccaccgcccttgctttccacctgacgaccagaggaggggagcctcatatgatcgtctccaagcaggaacggggaaagtctctcctgtttaagacaagcgccggcgttaacatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcacagtgagcggagtctatcctctgtccatccccgctaccctcttcgtgtggtacttttggcagaaaaagaaacaacgctctggcgtcctgtgggacacgccttcccctcccaaggtggaaagagccgttcttgatgacggcatttatcggatcatgcagcgcgggctgctgggaagatcccaggtgggcgtcggggtgttccaggagaacgtttttcataccatgtggcacgtgacacggggagccgtcctcatgtaccaaggcaaacgcctggaacccagctgggcttctgtgaagaaggaccttatttcctacgggggaggctggagactgcagggcagctggaataccggggaggaggtgcaggttatcgccgtcgaacccggcaagaatcctaagaatgtgcagacagcgcccggcaccttcaaaacatctgagggggaagtgggagctattgccctcgattttaagccgggcacgtccgggagccctatcgtcaaccgggagggaaaaattgtgggcctgtatggcaatggggttgtgaccacatccggaacctacgtctctgccatcgctcaagccaaggcgagccaggaaggccccctccctgagatcgaggacgaagtgttcagaaagcgcaacctgaccattatggatcttcaccccgggtccggaaaaacacggagatatctgcccgctatcgttcgcgaggccattaagcggaaactgagaacgctcatcctggcccctacccgcgtggtcgctagcgaaatggccgaggctcttaagggcatgccgattcggtaccagacaaccgccgtgaaatctgaacatacagggaaggagatcgttgacctgatgtgccacgcgacctttacgatgagactcctgtcccccgtgcgcgtccctaattataacatgatcattatggatgaggcccatttcacagaccccagctctatcgctgcccggggctacattagcaccagagtgggaatgggcgaagctgccgccatctttatgaccgctacacctcccgggtccgtggaggcgttccctcaatctaatgccgtcattcaggatgaagaacgggacatcccggaacgcagctggaactccggatatgagtggatcaccgattttcccggcaagacagtttggttcgtgccttctattaaaagcgggaatgacatcgctaactgtctgagaaagaatggaaaacgggtgattcagctctcccgcaagaccttcgatacggagtaccagaaaacaaagaacaacgactgggactacgtcgtgaccacagatatcagcgaaatgggcgccaattttagagccgaccgggttattgatcccagacgctgccttaagcctgtgatcctgaaagacgggcccgagcgggtcattctggctggcccgatgcctgtgaccgttgcctctgcggctcaaagacgcggacggatcggcagaaaccacaataaggaaggggatcagtatatctacatgggacagcccctcaacaatgacgaggatcatgcccactggacggaggccaaaatgctgcttgacaacattaatacccccgaaggcatcattcctgctctgttcgagcccgaacgcgagaagtccgccgcgatcgatggggaatatcggctcagaggagaggcccgcaaaacatttgtggagctgatgagacggggcgacctgcctgtctggctcagctacaaggtggcttccgaagggttccagtattctgatcgcagatggtgctttgacggcgagcggaacaatcaagtccttgaagagaacatggatgtggaaatttggaccaaagagggagagcgcaagaagctgagaccgcggtggctggacgccagaacatacagcgaccccctcgctctgcgcgagttcaaagagtttgccgctggccggagatccgtttctggggatcttatcctggaaatcggaaagctccctcagcacctgacccagcgcgcccagaatgcgctggacaacctcgtgatgcttcataatagcgagcaaggcgggcgggcctatagacacgctatggaggaactgcccgatacaattgagaccatgatgctgctcgccctgatcgctgtgcttacgggaggcgtcacactgttctttctctccggccgggggctgggaaaaaccagcattggcctgctctgtgttatggcctcttccgtgcttctgtggatggccagcgtggaacctcattggatcgctgcgtctattatcctggagttctttctcatggtcctgcttatccccgaaccggaccgccagagaacccctcaggataaccagctggcctacgtggttattgggctcctgttcatgatcctgacagtggctgccaatgagatgggactccttgagaccacaaagaaagacctgggcattgggcacgtcgccgtggaaaaccaccatcacgctgccatgctggatgtcgacctccatcccgcgtccgcctggacgctgtacgctgtggccaccacaatcattacccctatgatgcggcacacaatcgagaacaccacggctaatattagccttaccgccatcgcgaaccaagccgctatcctgatgggactcgataagggctggcccatttctaagatggacatcggcgttcctctgctggccctcgggtgctatagccaggtgaatccccttacactgaccgctgccgtcctgatgctcgtggctcattacgccattatcggaccgggcctgcaggcgaaagccacacgcgaagctcaaaagagaaccgccgctgggattatgaaaaaccctacggttgatggaatcgtggccatcgaccttgatcccgtcgtgtatgacgccaagtttgagaaacagctgggccagattatgctcctgatcctgtgtacatcccagattctccttatgcggaccacatgggcgctgtgcgaatctatcaccctggctaccgggcccctcacaacgctgtgggagggaagccctggcaagttctggaataccacaattgccgtgtccatggctaacatcttccgcggcagctaccttgccggggccggactggctttttccctcatgaagtctctgggcgggggaagacggggcaccggggcccaaggagagacactgggcgaaaaatggaagcgccagctcaatcagcttagcaaatccgagttcaacacctataagagatctggcatcatggaagttgaccggagcgaggcgaaagaagggctgaagagaggagagacgacaaagcacgccgtctcccgcggcaccgctaaactgcggtggtttgtggagagaaatctcgtgaagccggaagggaaagtcattgatctgggatgtggccgcgggggatggtcttactattgcgccggccttaagaaagttaccgaggtgaagggctacacaaaagggggacccggccacgaggaacctatccccatggctacctacgggtggaacctggtgaagctccatagcggaaaggacgtcttctttattcctcccgaaaaatgtgatacactgctgtgcgacatcggcgagtccagccctaatccgacgattgaggaagggcggaccctcagagtgcttaagatggttgagccctggctgcgcggaaaccagttctgtatcaaaattctgaatccttatatgccctctgtggtcgaaacactcgagcaaatgcagcggaagcacggcggcatgctggtgagaaaccctctttcccgcaatagcacccatgagatgtactgggtttcttgcgggacaggaaacatcgtgtccgccgtcaatatgaccagccggatgctgctcaacagatttacgatggcgcaccgcaaacccacctatgaacgggatgtggacctgggcgccgggacaagacacgtggctgtcgagccggaagttgccaacctggatatcattggacagcgcatcgagaatattaagcatgaacacaagtctacctggcattacgacgaggataacccttataaaacatgggcttaccacggctcctatgaggtgaagcccagcgggtccgccagctctatggtgaatggagtcgtgaaactcctgaccaagccctgggacgttatccctatggtgacacagattgctatgaccgatacgacacccttcggccaacagagagtctttaaagaaaaggtggacacccggacccctaaggccaaacgcggcacagcgcagatcatggaggttacggccaagtggctttgggggttcctgagcagaaacaaaaagccgcggatctgtaccagagaagagtttacacggaaagtgcgctccaatgctgccattggagctgtcttcgtggacgaaaaccaatggaactctgccaaggaggccgttgaggatgaaagattttgggacctcgtgcatcgggagcgcgaactgcacaagcagggcaaatgcgcgacctgcgtctacaacatgatggggaagagagagaagaaacttggagagttcggcaaagctaaagggagccgggccatctggtacatgtggctgggcgcccgcttcctcgagtttgaggctctgggattcatgaatgaagatcactggttttccagagagaactctctgagcggcgtggaaggggagggactccataaactgggctatattcttcgggacatctccaagattcccgggggaaatatgtacgccgatgacacagctggctgggatacccgcatcacagaggacgatctgcagaacgaagccaagatcaccgacattatggagcctgaacacgcgctcctggccaaatctatcttcaaacttacgtatcagaataaagtcgtgagagttcaacggcccgctaagaacgggaccgtgatggatgtcattagccgcagagaccagcggggctccggacaggtgggcacatacgggctgaatacctttacaaacatggaggcccagctcatccgccaaatggaaagcgagggaattttctctccttccgagctggaaacccccaacctggctagacgggtgctcgattggctggagaaacatggcgttgaaagacttaagcgcatggccatcagcggggacgactgtgtggtcaagccgatcgatgaccggtttgcgacggccctgacagctctcaatgatatgggaaaagtgagaaaggacattcctcagtgggagccctctaaaggctggaacgattggcagcaggttcctttctgctcccaccactttcatcaactgatcatgaaggacgggcgcgaaattgtggtcccctgtcggaatcaggatgagcttgtgggcagagcccgcgtcagccagggagctggctggtccctgcgggagaccgcctgcctcgggaaatcttatgctcagatgtggcaactgatgtacttccacagacgcgacctgcggctcgccgcgaacgccatctgtagcgctgtgcctgttgattgggtgcccacatccagaaccacgtggagcattcatgcccaccatcagtggatgaccacagaagacatgctgtctgtctggaatcgcgtgtggatcgaggaaaacccgtggatggaggataagacccacatttccagctggggagacgttccttatcttggcaagcgggaagaccagtggtgcgggtctctgatcggactcacagccagagctacctgggccacaaatatccaagtggcgattaaccaggtccggagactgatcggcaatgagaactaccttgattacatgaccagcatgaaacgctttaagaatgagtccgaccccgaaggggctctgtggtga

SEQ ID NO: 19073 - RNA, 9879 nt, synthetic construct
  misc_feature 1..9879: note = derived and/or modified CDS sequence (opt5) from DENV-1__GQ199824__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatcctcaacgagctgaatcatattcttctggaaaacgacatgaaatttacagttgtggtcggagatgtggctggcatcctcgcccaggggaagaaaatgattcggccgcagcccatggagtacaagtattcttggaaaagctggggaaaggccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctgaaactgcgcgattcctatacacaggtttgcgaccaccggcttatgagcgccgctatcaaggattctaaagccgtgcacgccgacatgggctactggattgaatccgagaagaatgaaacctggaagctcgctagagccagcttcatcgaggtgaaaacatgtatctggcccaagtctcataccctgtggtccaacggggtcctggaaagcgagatgattatcccgaaaatttatggaggccctatctctcagcacaattaccgccccgggtactttacacaaaccgcgggaccttggcatctcggcaagctggagcttgatttcgacctgtgcgaagggacgaccgtggttgtggatgagcactgcggaaaccggggccccagcctcagaacaaccacagtcaccggcaaaattatccacgaatggtgttgccggtcctgtacgctgcctcccctgcgctttaagggggaggacggatgctggtatggcatggagatcagaccggtgaaggaaaaagaggaaaatcttgttaagagcatggtgtctgctgggtccggagaggtcgacagcttctccctcggcctgctgtgtatttctatcatgattgaagaggtgatgcggagcagatggtcccgcaaaatgctcatgacagggaccctggccgtctttttccttctgatcatgggacagctcacatggaacgatctgattcggctgtgcatcatggtgggcgccaatgcttctgacagaatgggcatggggaccacctaccttgccctgatggcgacatttaagatgcgccctatgttcgctgtcggactcctgtttagacggctcacgagccgcgaggtgctgcttctgaccattggcctctccctggtggcctctgtcgaactgcccaacagccttgaggaactgggggatggactcgccatgggcatcatgatcctgaaactcctgacagacttccagtcccatcaactttgggctaccctgctcagcctgacatttattaagaccacgttctctctgcactatgcctggaagacaatggctatggttctttccatcgtgagcctgtttcccctctgtctgtctaccacctcccagaaaacaacctggctccctgtgctgcttgggagcctgggatgcaagccgctgacaatgttcctcattgccgagaataaaatctggggcagaaagtcttggcccctgaacgaaggcattatggcggtcgggatcgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacgatgaaaattaaggatgaggagcgggacgataccctgacaatccttctgaaggccaccctcctggctgtgtctggagtctatcctctcagcatccccgccacactgttcgtgtggtacttttggcagaaaaagaaacaacgctccggcgtcctttgggacaccccttctcccccggaagtggagagagccgttctggatgacggcatttatcggatcatgcagcgcgggctgctcggaagaagccaggtgggcgtcggggtgttccaggaaaacgtttttcatacgatgtggcacgtgacccggggagctgtcctgatgtaccaaggcaagcgccttgagccttcctgggccagcgtgaaaaaggacctgatttcttacgggggaggctggagactccagggctcctggaatacaggggaggaagtgcaggttatcgcggtcgagcccggaaagaaccctaaaaatgtgcagaccgctcccggcacattcaagaccagcgaaggggaggtgggagccattgccctggattttaaaccgggcacatctgggtcccctatcgtcaaccgggaaggaaagattgtgggcctctatggcaatggggttgtgacgaccagcggaacatacgtctccgctatcgcccaagcgaaggcttctcaggagggccccctgcctgagatcgaagacgaggtgttcagaaagcgcaaccttaccattatggatctgcaccccgggagcggaaagacccggagatatctgcccgccatcgttcgcgaagccattaaacggaagctcagaacactgatccttgctcctacgcgcgtggtcgcctccgagatggctgaagccctgaaaggcatgccgattcggtaccagaccacagcggtgaagtccgagcataccgggaaagagatcgttgacctcatgtgccacgccacatttaccatgagactgctgtctcccgtgcgcgtccctaattataacatgatcattatggatgaagctcatttcacggacccctccagcatcgccgctcggggctacatttctacaagagtgggaatgggcgaggccgccgctatctttatgaccgcgacccctcccgggagcgtggaagccttccctcaatccaatgctgtcattcaggatgaggaacgggacatcccggagcgctcttggaacagcggatatgagtggatcacagattttcccggcaagaccgtttggttcgtgccttccattaagtctgggaatgacatcgccaactgtctccgcaagaatggaaagcgggtgattcagcttagccgcaaaacattcgataccgaataccagaagacgaaaaacaacgactgggactacgtcgtgacaaccgatatctccgagatgggcgccaattttagagctgaccgggttattgatcccagacgctgcctgaagcctgtgatcctgaaggacgggcccgaacgggtcattctcgccggcccgatgcctgtgacagttgcgagcgctgcccaaagacgcggacggatcggcagaaaccacaataaagagggggatcagtatatctacatgggacagcccctgaacaatgacgaggatcatgcccactggaccgaagctaagatgcttctggacaacattaatacgcccgagggcatcattcctgccctcttcgaacccgagcgcgaaaaatctgcggccatcgatggggagtatcggctgagaggagaggctcgcaagacctttgtggaactgatgagacggggcgacctccctgtctggctttcctacaaagtggccagcgaggggttccagtattccgatcgcagatggtgctttgacggcgaacggaacaatcaagtcctggaggaaaacatggatgtggagatttggacaaaggagggagaacgcaaaaagctgagaccgcggtggctcgacgctagaacctactctgaccccctggcccttcgcgagttcaaggaatttgctgccggccggagaagcgtttccggggatctgatcctcgagatcggaaaactgcctcagcacctgacacagcgcgcgcagaatgccctcgacaaccttgtgatgctgcataattctgaacaaggcgggcgggcttatagacacgccatggaggagctgcccgataccattgaaacactcatgctgcttgctctgatcgccgtgctcaccggaggcgtcacgctgttctttctgagcggccgggggctcggaaagacatccattggccttctgtgtgttatggccagctctgtgctgctctggatggcttccgtggagcctcattggatcgcggccagcattatcctggagttctttcttatggtcctgctcatccccgagccggaccgccagagaacccctcaggataaccagctggcttacgtggttattgggctgctgttcatgatccttaccgtggccgccaatgagatgggactgctggaaacaaccaaaaaggacctcggcattgggcacgtcgctgtggagaaccaccatcacgccgcgatgctggatgtcgaccttcatcccgcctctgcttggacactgtacgccgtggctacgaccatcattacacctatgatgcggcacaccatcgaaaacacaaccgccaatatttccctcacggcgatcgccaaccaagctgccatcctgatgggactggataaaggctggcccattagcaagatggacatcggcgttcctctccttgctctggggtgctattctcaggtgaatcccctgaccctcacagccgctgtcctgatgcttgtggcccattacgcgattatcggaccgggcctgcaggccaaggctacccgcgaggcccagaaaagaacagctgccgggattatgaagaaccctaccgttgatggaatcgtggccatcgacctcgatcccgtcgtgtatgacgcgaaatttgaaaagcagctgggccagattatgctgctcatcctttgtacgagccagattctgctgatgcggacaacctgggctctctgcgagtccatcacactggccaccgggccccttaccacactgtgggagggatctcctggcaaattctggaatacgaccattgctgtgagcatggccaacatcttccgcggctcctacctcgccggggctggactggcctttagcctgatgaagtccctcggcgggggaagacggggcacaggggcgcaaggagaaacccttggcgagaagtggaaacgccagctgaatcagctgtctaagagcgagttcaacacatataaaagatccggcatcatggaggttgaccggtctgaagccaaggaggggctcaaaagaggagagaccacgaagcacgctgtcagccgcggcacagccaagctgcggtggtttgtggaaagaaatcttgtgaaaccggaggggaaggtcattgatctgggatgtggccgcgggggatggtcctactattgcgctggcctcaaaaaggttaccgaagtgaaaggctacaccaaagggggacccggccacgaggaacctatccccatggccacatacgggtggaacctggtgaaactgcattctggaaaggacgtcttctttattcctcccgagaagtgtgataccctcctttgcgacatcggcgagagctcccctaatccgacaattgaagaggggcggacgctgagagtgctgaaaatggttgaaccctggctccgcggaaaccagttctgtatcaagattctgaatccttatatgcccagcgtggtcgagacccttgagcaaatgcagcggaaacacggcggcatgctggtgagaaaccctctctctcgcaattccacacatgaaatgtactgggttagctgcgggaccggaaacatcgtgtctgcggtcaatatgacatcccggatgctgctgaacagatttaccatggcccaccgcaagcccacgtatgagcgggatgtggacctcggcgctgggaccagacacgtggccgtcgaaccggaggttgctaacctggatatcattggacagcgcatcgaaaatattaaacatgagcacaagagcacatggcattacgacgaggataacccttataagacctgggcctaccacggctcttatgaagtgaaaccctccgggagcgcttccagcatggtgaatggagtcgtgaaacttctgacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctctgggggttcctgtctagaaacaagaaaccgcggatctgtacgagagaggaatttacccggaaggtgcgcagcaatgccgctattggagccgtcttcgtggacgagaaccaatggaactccgccaaagaggcggttgaagatgagagattttgggaccttgtgcatcgggaacgcgagctgcacaagcagggcaagtgcgctacatgcgtctacaacatgatggggaaaagagaaaagaaactcggagagttcggcaaggccaaagggtctcgggccatctggtacatgtggctgggcgctcgcttcctggagtttgaagccctcggattcatgaatgaggatcactggtttagcagagaaaactccctgtctggcgtggagggggagggacttcataagctgggctatattctccgggacatcagcaaaattcccgggggaaatatgtacgctgatgacaccgccggctgggatacacgcatcaccgaagacgatctgcagaacgaggcgaagatcacagacattatggaacctgagcacgcccttctggctaagtccatcttcaaactcacctatcagaataaggtcgtgagagttcaacggcccgccaaaaacgggacggtgatggatgtcatttctcgcagagaccagcggggcagcggacaggtgggcacctacgggctgaatacatttaccaacatggaagctcagctgatccgccaaatggagtccgagggaattttcagcccttctgaactcgagacacccaacctggccggcagagtgcttgattggctggaaaagcatggggttgagcggctcaaaagaatggcgatctccggagacgactgtgtggtcaagccgatcgatgaccgctttgccaccgctctgacggcccttaatgatatgggcaaggtgcggaaagacattcctcagtgggaacccagcaaggggtggaacgattggcagcaggttcctttctgctctcaccactttcatcaactgatcatgaaagacggcagagagattgtggtcccctgtcgcaatcaggatgagctcgtgggacgggctagagtctcccagggcgccgggtggagcctgcgcgaaacagcttgcctgggaaagtcctatgcccagatgtggcaactcatgtacttccaccggagagacctgcgccttgcggccaacgctatctgttctgccgtgcctgttgattgggtgcccaccagccggacaacctggtccattcatgcccaccatcagtggatgacgaccgaggacatgctgagcgtctggaatagagtgtggatcgaagagaacccgtggatggaagataaaacacacatttcttcctggggcgacgttccttatctcgggaagcgcgaggaccagtggtgcggaagcctgatcggccttaccgctcgggccacatgggcgaccaatatccaagtggctattaaccaggtcagacggctgatcgggaatgagaactacctcgattacatgacatctatgaagagatttaaaaatgaaagcgaccccgagggcgccctgtggtga

SEQ ID NO: 19074 - RNA, 9879 nt, synthetic construct
  misc_feature 1..9879: note = derived and/or modified CDS sequence (opt5) from DENV-1__FJ882559__SS-prME
  source 1..9879: mol_type = other RNA
agcgtgaccatgctgctgatgctgatgcccacagcccttgctttccacctgacgaccagaggcggggaacctcatatgatcgtctccaagcaagaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagtttacggttgtggtcggagatgtggctggcattctggcccaggggaaaaagatgatccggccgcaacccatggagtacaaatatagctggaagtcctggggaaaggccagaattatcggcgctgacgtgcagaatacaaccttcatcattgatgggcctaacacccccgaatgtcctgacgatcagcgcgcgtggaatatctgggaggtcgaggactacggatttggcattttcacaaccaacatctggctccggctgagagatagctatacgcaggtttgcgaccaccgcctgatgtctgccgctattaaagattccaaggccgtgcacgccgacatgggctactggatcgaaagcgagaaaaatgaaacatggaaacttgctcgggcctctttcatcgaggtgaaaacctgtatttggcccaagtcccatacactctggagcaacggggtcctggaatctgagatgatcattccgaagatctatggaggccctattagccaacacaattacagacccgggtactttacccagacagcgggaccttggcatctgggcaaactcgagctggatttcgacctttgcgaagggaccacggtggttgtggatgagcactgcggaaaccggggcccctccctgcgcaccacaaccgtcacaggcaagatcgtgcacgaatggtgttgcagaagctgtaccctccctcccctgcggtttaaaggggaggacggatgctggtatggcatggagatcagaccggttaaggaaaaagaggaaaatctggtgaagtctatggtctccgctgggagcggagaggtggactccttctctcttggcctcctgtgtattagcatcatgattgaagaggttatgcgctcccggtggtctagaaagatgctgatgacggggacactcgccgtgtttttcctgcttatcatgggacagctgacctggaacgatctcattcgcctgtgcatcatggtcggcgccaatgctagcgacagaatgggcatggggatgacatacctggcccttatggcgacctttaaaatgcggcctatgttcgctgtgggactgctctttcgcagactgacctcccgggaggtgctcctgcttacaattggcctgtctctcgtcgccagcgccgaactgcccaactccctggaggaacttggggatggactggctatgggcatcatgatcctcaagctgctcacggacttccaaagccatcagctgtgggccacccttctgtctctcacatttattaaaaccacattctccctgcactatgcttggaagaccatggccatggttctgagcatcgtgtctctttttcccctgtgtctctccacgacaagccagaaaaccacctggctgcctgtgctcctggggtctcttggatgcaagccgctgacaatgttcctgattgcggagaataagatctggggccgcaaatcctggcccctcaacgaaggcattatggccgtcgggatcgtgagcatcctgctttccagcctgctcaagaacgatgttcctctggctggacccctcattgccggcgggatgctgatcgcttgttacgtgatttctggaagctccgccgacctttctctggagaaagccgctgaggtcagctgggaagaggaagcggagcattccggcgcctctcacaatatcctggtggaagttcaggatgacgggaccatgaagattaaagatgaggagagagacgatacactcacgatcctgcttaaggctaccctgctcgccgtgagcggagtctatcctctgtccatccccgccacactcttcgtgtggtacttttggcagaagaagaagcagcggtctggcgtcctgtgggacaccccttcccctcccgaagtggagcgcgctgttcttgatgacggcatttatagaatcatgcagcgggggctgctgggacgctcccaggtgggcgtcggggtgttccaagaaaacgtttttcatacaatgtggcacgtgaccagaggagccgtcctcatgtaccagggcaaacggctggagcccagctgggcgtctgtgaagaaagaccttatttcctacgggggaggctggagactgcagggcagctggaatacgggggaggaagtgcaggttatcgctgtcgagcccggaaagaaccctaaaaatgtgcaaaccgcccccggcacattcaagacctctgaaggggaggtgggagccattgctctcgattttaagccgggcacatccgggagccctatcgtcaaccgcgaaggaaaaattgtgggcctgtatggcaatggggttgtgaccacatccggaacgtacgtctctgccatcgcgcaggctaaggccagccaggagggccccctccctgagatcgaagacgaggtgttccggaaaagaaacctgaccattatggatcttcaccccgggtccggaaagacacgccggtatctgcccgccatcgttagagaagctattaaacgcaagctgcggaccctcatcctggcccctaccagagtggtcgctagcgagatggccgaagcgcttaagggcatgccgattcgctaccaaacaacggccgtgaaatctgagcataccgggaaggagatcgttgacctgatgtgccacgctacatttaccatgcggctcctgtcccccgtgagagtccctaattataacatgatcattatggatgaagcccatttcacagaccccagctctatcgctgcccggggctacattagcacccgcgtgggaatgggcgaggccgctgcgatctttatgacggccacacctcccgggtccgtggaggctttccctcagtctaatgccgtcattcaggatgaagaaagagacatcccggagcggagctggaactccggatatgagtggatcaccgattttcccggcaaaaccgtttggttcgtgccttctattaagagcgggaatgacatcgccaactgtctgcgcaaaaatggaaagagagtgattcagctctcccggaagacattcgataccgaataccagaagacaaagaacaacgactgggactacgtcgtgaccacggatatcagcgagatgggcgctaattttagagccgaccgcgttattgatccccggagatgccttaaacctgtgatcctgaaggacgggcccgaacgcgtcattctggcgggcccgatgcctgtgacagttgcttctgccgcccagcggagaggacgcatcggccggaaccacaataaagagggggatcagtatatctacatgggacagcccctcaacaatgacgaggatcatgctcactggaccgaagccaagatgctgcttgacaacattaatacacccgagggcatcattcctgcgctgttcgaacccgagagagaaaagtccgccgctatcgatggggagtatcgcctcagaggagaggcccggaaaacctttgtggaactgatgcgcagaggcgacctgcctgtctggctcagctacaaggtggcttccgaggggttccaatattctgatcggcgctggtgctttgacggcgaaagaaacaatcaggtccttgaggaaaacatggatgtggagatttggacgaaagagggagaacggaagaaactgagaccgcgctggctggacgcccggacctacagcgaccccctcgctctgagagagttcaaggaatttgccgcgggccgccggtccgtttctggggatcttatcctggagatcggaaaactccctcagcacctgacacagagagcccaaaatgctctggacaacctcgtgatgcttcataatagcgaacagggcgggcgggcctatcgccacgctatggaggagctgcccgataccattgaaacactgatgctcctggcccttatcgccgtgctgaccggaggcgtcacactcttctttctgtccggcagagggctgggaaagaccagcattggcctcctttgtgttatggcttcttccgtgctgctgtggatggcgagcgtggagcctcattggatcgccgcttctattatcctcgagttctttctgatggtccttctgatccccgagccggaccggcagcgcacgcctcaggataaccaactcgcctacgtggttattgggctgctgttcatgatcctcacagtggccgctaatgagatgggacttctggaaaccaccaagaaagacctgggcattgggcacgtcgccgtggagaaccaccatcacgcggccatgctcgatgtcgacctgcatcccgcttccgcctggacactttacgctgtggccaccacaatcattacgcctatgatgagacacaccatcgaaaacacaaccgcgaatattagcctgacagccatcgctaaccaggccgctatcctcatgggactggataagggctggcccatttctaaaatggacatcggcgttcctctgctcgcccttgggtgctatagccaggtgaatcccctgaccctgacggctgccgtcctcatgctggtggcgcattacgccattatcggaccgggccttcaagctaaggccacccgggaggctcagaaacgcacagccgccgggattatgaagaaccctaccgttgatggaatcgtggcgatcgacctggatcccgtcgtgtatgacgctaagtttgaaaaacagctcggccagattatgctgctgatcctctgtacatcccaaattcttctgatgagaaccacgtgggccctgtgcgagtctatcacactcgctaccgggcccctgacaaccctttgggagggaagccctggcaagttctggaataccacaattgccgtgtccatggccaacatcttccggggcagctacctggctggggccggactcgcgttttccctgatgaaatctctgggcgggggacgcagaggcacgggggcccagggagaaaccctcggcgagaagtggaaacggcagcttaatcagctgagcaagtccgagttcaacacatataagagatctggcatcatggaggttgaccgcagcgaagctaaagaggggctgaagcggggagagaccacaaaacacgccgtctccagaggcaccgctaagctccgctggtttgtggaacggaatctggtgaaaccggaggggaaggtcattgatcttggatgtggcagagggggatggtcttactattgcgccggcctgaagaaagttacggaagtgaagggctacacaaaagggggacccggccacgaggaacctatccccatggcgacctacgggtggaacctcgtgcgcctgcatagcggaaaggacgtcttctttacccctcccgagaaatgtgatacactgctctgcgacattggcgagtccagccctaatccgaccatcgaagaggggcggacacttagagtgctgaagatggttgaaccctggctgcgcggaaaccaattctgtattaaaatcctcaatccttatatgccctctgtggtcgagacgctggagcagatgcagcggaagcacggcggcatgcttgtgagaaaccctctgtcccgcaatagcacccatgaaatgtactgggtttcttgcgggacaggaaacattgtgtccgccgtcaatatgaccagccggatgctcctgaacagatttacaatggctcaccgcaagcccacctatgagagagatgtggacctgggcgccgggacgcggcacgtggctgtcgaaccggaggttgccaacctcgatatcatcggacagcgcattgaaaatatcaaacatgagcacaagtctacctggcattacgacgaggataacccttataaaacatgggcttaccacggctcctatgaagtgaagcccagcgggtccgccagctctatggtgaatggagtcgtgaaactgcttaccaagccctgggacgttattcctatggtgacacaaatcgcgatgaccgatacaacccccttcggccagcagagagtctttaaggagaaagtggacacgcggacacctaaggccaaaagaggcaccgttcaaattatggaagtgaccgctaagtggctgtgggggttcctcagccggaacaaaaagccgcgcatctgtacaagagaggaatttacgcggaaggtccgctccaatgccgctatcggagccgtgttcgttgacgagaaccagtggaactctgccaaagaggcggtggaagatgagagattttgggacctggtccatcgggaacgcgagcttcacaagcagggcaaatgcgctacctgcgtgtacaacatgatggggaagagagagaagaagctgggagagttcggcaaggccaaagggagccgggccatttggtacatgtggctcggcgctcgcttcctggagtttgaagccctgggattcatgaatgaggatcactggttttccagagaaaactctctcagcggcgtcgagggggagggactgcataaacttggctatatcctgcgggacatttccaaaatccccgggggaaatatgtacgctgatgacacagccggctgggatacccgcattacagaagacgatctccagaacgaggcgaagatcaccgacatcatggaacctgagcacgccctgcttgctaaatctattttcaagctgacatatcaaaataaagtggttagagtgcagcggcccgccaagaacgggaccgtcatggatgtgatcagccgcagagaccagcggggctccggacaggtgggcacgtacgggctcaatacctttacaaacatggaagctcaactgattagacagatggagagcgagggaatcttctctccttccgaactggagacccccaacctcgccgaacgcgcgctggattggcttgagaagcatggcgttgaacggctgaaaagaatggccattagcggggacgactgtgtggtcaagccgatcgatgaccgctttgctacagccctcaccgctctgaatgatatgggaaaagtgcggaaggacatccctcagtgggagccctctaaaggctggaacgattggcagcaagttcctttctgctcccaccactttcatcagcttattatgaaggacgggagagagatcgtggtcccctgtcgcaatcaggatgaactggtgggccgggccagagtcagccagggagctggctggtccctccgcgagacggcctgcctggggaagtcttatgcgcaaatgtggcagctgatgtacttccaccggagagacctccgcctggccgctaacgccatttgtagcgccgtgcctgttgattgggtgcccacatcccggaccacatggagcatccatgctcaccatcagtggatgaccacggaagacatgctttctgtctggaatagagtgtggattgaggaaaacccgtggatggaggataaaacccacatctccagctggggagacgttccttatctgggcaagcgggaggaccaatggtgcgggtctctcattggactgacagccagagcgacctgggctacaaatatccaggtggccatcaaccaggtccgccggcttattggcaatgaaaactacctggattacatgaccagcatgaaaagatttaagaatgagtccgaccccgaaggggccctctggtga

SEQ ID NO: 19075 - RNA, 9879 nt, synthetic construct
  misc_feature 1..9879: note = derived and/or modified CDS sequence (opt5) from DENV-1__GQ199828__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagacaagcgccggcgttaatatgtgcacccttattgcgatggacctgggggaactctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtgtgtggcccaaatctcataccctgtggtccaacggagtccgcgaaagcgagatgattatcccgaagatttatggcgggcctatctctcaacacaattaccggcccggatacttcacacagaccgcgggcccttggcatctcgggaaactggagcttgatttcgacctgtgcgaaggaacgaccgtggttgtggatgagcactgcggcaacagaggccccagcctccggacaaccacagtcaccgggaagattatccacgaatggtgttgccgctcctgtacgctgcctcccctgagatttcggggagaggacggctgctggtatgggatggagatcagaccggtgaaagaaaaggaggaaaatcttgttaagagcatggtgtctgctggatccggcgaggtcgacagcttctccctcgggctgctgtgtatttctatcatgattgaagaggtgatgcgcagccggtggtccagaaaaatgctcatgatcggaacactggccgtctttttccttctgattatgggccagctcacctggaacgatctgatccgcctgtgcattatggtgggcgccaatgcttctgacagaatggggatgggaacaacctaccttgccctgatggcgacctttaagatgcggcctatgttcgctgtcggcctcctgtttcgcagactcacaagccgggaggtgctgcttctgacgatcgggctctccctggtggcctctgtcgaactgcccaacagccttgaggaactgggagatggcctcgccatggggatcatgattctgaaactcctgaccgacttccaatcccatcagctttgggctacactgctcagcctgacctttatcaagacaaccttctctctgcactatgcctggaaaacgatggctatggttctttccattgtgagcctgtttcccctctgtctgtctacaacctcccagaagaccacatggctccctgtgctgcttggaagcctgggctgcaagccgctgaccatgttcctcatcgccgagaataaaatttggggccgcaagtcttggcccctgaacgaagggatcatggcggtcggaatcgtgtccattcttctgagctccctcctgaaaaacgatgttcctctcgccggccccctgatcgctgggggaatgcttattgcctgttacgtgatcagcggctctagcgctgacctgtccctggagaaggccgccgaggtctcttgggaagaggaagctgagcatagcggggcgtcccacaatattctcgtggaagttcaggatgacggaacaatgaaaatcaagaacgaggagagagatgacacgctgaccatccttctgaaagccacactcctggctgtgtctggcgtctatcctctcagcattcccgccaccctgtttgtgtggtacttctggcaaaagaagaaacagcggtccggcgtcctttgggatacaccttctcccccggaagtggagcgcgccgttctggacgatgggatctatagaattatgcagcggggactgctcggccgcagccaggtgggggtcggagtgttccaagaaaatgtttttcataccatgtggcacgtgacgagaggcgctgtcctgatgtaccaggggaagcggcttgagccttcctgggccagcgtgaaaaaggacctgatctcttacggaggcggctggagactccgcgggtcctggaacaccggagaggaagtgcaggttattgcggtcgagcccggcaaaaatcctaagaacgtgcagacagctcccgggaccttcaagacaccggaaggagaggtgggcgccatcgccctggactttaaacctgggaccagcggatctcccattgtcaatcgggaaggcaagatcgtgggcctctatgggaacggagttgtgacaacgtccggcacctacgtcagcgctatcgcccaagcgaaggcttcccaggaggggcctctgcccgagattgaagatgaggtgttcagaaagcgcaatcttacaatcatggacctgcaccccggatctggcaaaacccggagatatctgcctgccattgttcgcgaagccatcaagcggaagctcagaaccctgattcttgctccgacacgcgtggtcgccagcgagatggctgaagccctgaaagggatgcccatccggtaccagacgaccgcggtgaagtccgagcatacaggcaaagagatcgttgatctcatgtgccacgccacctttacaatgagactgctgagccctgtgcgggtccccaactataatatgattatcatggacgaagctcatttcaccgatccttcttccattgccgctcgcggatacatcagcacgagagtgggcatgggggaggccgccgctatttttatgacagcgacaccccctggatctgtggaagccttcccgcaaagcaacgctgtcatccaggacgaggaacgggatatccccgagcgctcctggaactctggctatgagtggattaccgactttcctgggaagacagtttggttcgtgcccagcatcaaatccggaaacgatattgccaattgtctcagaaagaacggcaagcgggtgatccagctttctagaaaaacctttgacacagaataccagaagaccaaaaacaatgattgggactacgtcgtgacgacagacattagcgagatgggggccaacttccgcgctgatcgggttatcgaccctagacgctgcctgaagcccgtgattctgaaagatggcccggaacgggtcatcctcgccggacctatgcccgtgaccgttgcgtccgctgcccaaagacgcggccggatcgggagaaatcacaacaaggagggagaccagtatatttacatgggccagcccctgaataacgatgaggaccatgcccactggacagaagctaagatgcttctggataatatcaacacccctgaggggattatccccgccctcttcgaacctgagcgcgaaaagagcgcggccgtggacggagagtatagactgcggggcgaggctcgcaagacgtttgtcgagctgatgagaagaggggatctcccggtgtggctttcttacaaagtcgcctccgagggcttccagtatagcgaccgcagatggtgctttgatggagaacggaataaccaagtgctggaggaaaatatggacgttgagatttggaccaaggagggcgaacgcaagaagctgcgcccccggtggctcgatgctagaacatactccgaccctctggcccttcgcgagttcaaagaatttgctgccgggcggagatctgtgagcggagacctgatcctcgagatcggcaagctgccccagcacctgacccagcgggcgcagaacgccctcgataatcttgtgatgctgcataactccgaacaagggggacgcgcttatagacacgccatggaggagctgcctgacacaattgaaaccctcatgctgcttgctctgatcgccgtcctcacaggcggcgttaccctgttctttctgtctgggcggggactcggcaagacgagcattgggcttctgtgtgtgatggcctccagcgtgctgctctggatggcttctgtcgagccccattggatcgcggcctccattatcctggagttctttcttatggtgctgctcatcccggagcctgatcgccagagaacaccccaggacaatcagctggcttacgttgtgattggactcctgttcatgatccttaccgtcgccgccaacgagatgggcctgctggaaaccaccaaaaaggatctcgggattggacacgtggctgtcgagaaccaccatcacgccgcgatgctggacgtggatcttcatcctgccagcgcttggaccctgtacgccgttgctacaacgatcattacccccatgatgcggcacacaatcgaaaataccacagccaacatttctctcaccgcgatcgccaatcaagctgccatcctgatgggcctggacaaaggctggcctatttccaagatggatatcggggtgcccctccttgctctgggatgctatagccaggtcaacccgctgacgctcaccgccgctgtgctgatgcttgttgcccattacgcgattatcggccctgggctgcaggccaaagctacacgcgaggcccaaaagagaaccgctgccggaattatgaagaatcccacagtggacggcatcgtcgccatcgatctcgaccccgtggtgtatgatgcgaaatttgaaaagcagctggggcagattatgctgctcatcctttgtacctctcagattctgctgatgcggacgacatgggctctctgcgagagcatcaccctggccacaggacctcttaccaccctgtgggagggctccccgggcaaattctggaacacaacgattgctgtttctatggccaatatctttcgcgggagctacctcgccggagctggcctggccttctccctgatgaaaagcctcgggggaggcagacgggggaccggagcgcaaggcgaaacacttggcgagaaatggaagagacagctgaaccagctgtccaagtctgagttcaatacctataaacgcagcgggatcatggaggtcgaccggtccgaagccaaggagggactcaaaagaggcgagacaaccaagcacgctgtgtctcgcgggacggccaaactgcggtggtttgtggaaagaaaccttgtcaagcccgagggaaaggttattgacctgggctgtgggcgcggaggctggagctactattgcgctggcctcaaaaaggtgacagaagtgaaagggtacaccaagggaggccctgggcacgaggaacccatccctatggccacctacggatggaatctggtcaaactgcattccggcaaggatgtgttctttattccccctgagaaatgtgacacactcctttgcgatatcggggagtctagcccgaaccccaccattgaagagggacggacactgagagttctgaagatggtggaaccttggctccgcggcaatcagttctgtatcaagattctgaacccctatatgccttccgtcgtggagacgcttgagcaaatgcagcggaaacacggcgggatgctggttagaaatcccctcagccgcaactctacccatgaaatgtactgggtgtcctgcggaacaggcaatatcgtcagcgcggtgaacatgacctctcggatgctgctgaacagatttacaatggcccaccgcaagccgacctatgagagagacgtggatctcgggacgggaacccggcacgtcgctgttgaacctgaggtggccaatctggacatcattggccagcgcatcgaaaacattaaacatgagcacaagtccacatggcattacgatgaggacaatccctataaaacctgggcttaccacgggagctatgaagtgaagccctctggatccgccagctccatggtcaacggcgtggttaaacttctgacaaaaccttgggatgtgatccccatggtcacccagattgctatgacagacaccacgcctttcggccaacagagagtgtttaaggagaaagttgatacacggaccccgaaggccaaaagagggaccgcgcagatcatggaagtgacagcccggtggctctggggattcctgagccgcaataagaagcccagaatctgtacgcgggaggaatttacccgcaaagtcagatctaacgctgccattggcgctgtgttcgttgacgagaatcaatggaacagcgccaaggaggccgtggaagacgagcggttttgggatcttgtccatcgcgaaagagagctgcacaaacaggggaagtgcgcgacatgcgtgtacaatatgatgggaaaacgggaaaagaagctcggcgagttcgggaaagctaagggctcccgcgccatctggtacatgtggctgggagccagatttctggagttcgaagctctcggcttcatgaacgaggaccactggttttctcgggaaaatagcctgtccggggtcgagggagagggccttcataaactggggtatattctccgcgatatctctaagattcctggaggcaacatgtacgccgacgataccgctgggtgggacacaagaatcaccgaagatgacctgcagaatgaggccaaaatcacagatattatggaacccgagcacgcgcttctggccaaggctatcttcaaactcacctatcagaacaaggtggttcgggtgcaacgccctgccaagaatggcacggtcatggacgtgattagcagacgggatcagagaggatccggccaggtggggacctacggactgaacacatttaccaacatggaagctcagctgatccgccaaatggagtctgaggaaattttcagcccctccgagctcgaaacaccgaatctggccgagcgggcgcttgactggctggaaaaatatggcgttgagagactcaagcgcatggccatcagcggggatgactgtgtggtcaaacctatcgacgatcggtttgctaccgccctgacggctcttaacgacatgggaaaggtgagaaaagatattccccagtgggagccttctaagggctggaatgactggcagcaggttcccttctgctcccatcactttcaccaactgatcatgaaggatgggcgcgaaattgtggtcccttgtcggaaccaggacgagctcgtgggcagagcccgcgtcagccagggagctggctggtctctgcgggaaacagcctgcctggggaaatcctacgcgcagatgtggcaactcatgtatttccatagacgcgatctgcggcttgccgacaaggctatcggaagcgccgtgcccgttgattgggtgccgacctccagaacaacctggtctattcacgcccatcaccagtggatgacgaccgaggacatgctgagcgtctggaatcgggtgtggatcgaagagaacccttggatggaggataaaacacatatttccagctgggaagacgttccctacctcggcaagagagaggaccagtggtgtgggtctctgatcggacttaccgctcgcgccacatgggcgaccaatatccaagtggctattaaccaggtccggagactgatcggcaatgaaaactacctcgattatatgacatccatgaaacgctttaagaatgagagcgaccccgagggggccctgtggtga

SEQ ID NO: 19076 - RNA, 9879 nt, synthetic construct
  misc_feature 1..9879: note = derived and/or modified CDS sequence (opt5) from DENV-1__GQ199829__SS-prME
  source 1..9879: mol_type = other RNA
agcgtgaccatgctgctgatgctgatgcccaccgcccttgctttccacctgacgacccggggcggggaacctcatatgatcgtctccaagcaggaacggggaaagtctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcaccggcgggacaagcgctctgttgccctggcccctcatgtggggctgggactcgagacccggacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcaccctcgtcgatagaggctggggcaatgggtgtggactgtttggcaaagggtctcttattacatgcgctaagttcaagtgcgtgacgaaactggagggaaagatcgttcagtacgaaaacctcaaatattccgtgatcgtcaccgtgcacacaggcgaccagcatcaagttgggaatgagagcaccgaacacggaacaaccgccacgattacaccccaagctcctaccaccgagatccagctgacagactacggcgccctgaccctcgattgttctccccggacgggcctggactttaacgaaatggtgcttctgacaatgaaggagaaatcctggctcgtccataagcagtggttcctggatcttcctctgccctggaccagcggggcctccacatctcaagagacctggaatcgccaggacctcctggtgacctttaaaacagctcacgcgaagaagcaggaagtcgtggttctgggaagccaagagggcgccatgcacacggctctcaccggggccacagaaattcagacctccggaacaaccacgatcttcgccggccatctgaaatgcagacttaagatggataaactgacactcaaggggatgagctatgtgatgtgtaccggctcttttaaactggagaaggaagtcgctgagacccagcacggaacagtgctggttcagattaagtacgagggcaccgacgccccgtgcaaaatccctttctccacacaagatgaaaagggggtgacgcagaacggacggcttatcaccgcgaatcccattgtcacagacaaagagaagcctgtgaacatcgaagctgagccgcccttcggcgagagctatattgtgatcggggccggagaaaaagccctcaagctgtcttggtttaagaaaggcagctccattgggaagatgttcgaggctaccgccagaggcgctcgccggatggccatcctgggagatacagcgtgggactttggctctatcgggggagttttcaccagcgtcggcaaactcgtgcatcagatttttgggacggcctacggagtgctgttctccggcgtcagctggaccatgaagatcgggattggcgtgcttctgacatggctcggactcaattctagatccaccagcctgtctatgacatgtatcgctgttggccttgtgaccctctacctgggggtcatggtgcaggccgattccggatgcgttattaactggaaaggccgcgaactgaagtgtgggagcggaatctttgtgacaaatgaggtccacacctggacggaacaatataagttccaggctgactcccctaaacggctctctgccgcgattggcaaggcctgggaggagggggtgtgcggcatcagaagcgctacacgcctggaaaacatcatgtggaaacagatttccaacgagcttaatcatatcctgctcgaaaacgacatgaagtttaccgttgtggtcggagatgtggccggcattctggctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtcgaggactacggatttggcattttcacgacaaacatctggctgaaacttcgcgattcctatacccaggtttgcgaccaccggctcatgagcgcggccattaaagattctaaggctgtgcacgccgacatgggctactggatcgaatccgagaaaaatgaaacatggaagctggccagagctagctttatcgaggtgaagacctgtatttggccccgctctcatacactgtggtccaacggggtcctcgaaagcgagatgatcattccgaaaatctatggaggccctatttctcaacacaattaccggcccgggtacttcacccaggccgcgggaccttggcatctgggcaaacttgagctggatttcgacctctgcgaagggacgaccgtggttgtggatgagcactgcggaaacagaggccccagcctgcggacaaccacagtcaccggcaaaatcatccacgaatggtgttgccgctcctgtacgctgcctccccttagatttagaggggaagacggatgctggtatggcatggagattagaccggtgaaggaaaaagaggaaaatctcgttaagagcatggtgtctgctgggtccggagaggtcgacagcttctccctgggcctgctctgtatctctattatgatcgaagaggtgatgcgcagccggtggtccagacgcatgctgatgacagggacccttgccgtctttttcctgctcattatgggacagctgacatggaacgatctgatcagactttgcattatggtgggcgccaatgcttctgaccggatgggcatggggaccacctacctggccctcatggcgacatttaagatgcgccctatgttcgctgtcggactgctctttagacggctgacgagccgcgaggtgcttctgctcaccatcggcctgtccctggtggcctctgtcgaacttcccaacagcctggaggaactcggggatggactggccatgggcatcatgattctcaaactgcttacagacttccaatcccatcagctgtgggctaccctcctgagcctgacatttatcaagaccacgttctctcttcactatgcctggaaaacaatggctatggttctgtccattgtgagcctctttcccctgtgtctctctaccacctcccagaagacaacctggctgcctgtgcttctggggagcctgggatgcaaaccgctcacaatgttcctgatcgccgagaataagatttggggcagacggtcttggccccttaacgaaggcatcatggcggtcgggatcgtgtccattctgctcagctccctgctcaagaacgatgttcctctggccggaccccttatcgctggcgggatgctgattgcctgttacgtgatcagcggatctagcgctgacctgtccctcgagaaagccgccgaggtctcttgggaagaggaagctgagcatagcggcgcgtcccacaatattctggtggaagttcaggatgacgggacgatgaagatcaaagatgaggagcgcgacgatacccttacaatcctgctcaaggccaccctgctcgctgtgtctggagtctatcctctgagcattcccgccacactttttgtgtggtacttctggcagaagaagaaacagagatccggcgtcctgtgggacaccccttctcccccggaagtggagcgggccgttctggatgacggcatctatcgcattatgcagagagggctcctgggacggagccaggtgggcgtcggggtgttccaagaaaacgtttttcatacgatgtggcacgtgaccagaggagctgtccttatgtaccagggcaagcgcctggagccttcctgggccagcgtgaagaaagacctcatctcttacgggggaggctggcggctgcagggctcctggaatacaggggaggaagtgcaggttattgcggtcgagcccggaaagaaccctaaaaatgtgcaaaccgctcccggcacattcaagaccccggaaggggaggtgggagccatcgccctcgattttaaacctggcacaagcgggtctcccattgtcaacagagaaggaaagatcgtgggcctgtatggcaatggggttgtgacgacctccggaacatacgtcagcgctatcgcccaggcgaaggcttcccaggagggccctcttcccgagattgaagacgaggtgttccgcaaacggaacctgaccatcatggatctgcaccccgggtctggaaagaccagacgctatctccctgccattgttcgggaagccatcaaaagaaagctgcgcacacttattctggctccgacgcgggtggtcgccagcgagatggctgaagccctcaaaggcatgcccatcagataccaaaccacagcggtgaagtccgagcataccgggaaggagatcgttgacctgatgtgccacgccacatttaccatgcggctgctcagccctgtgcgcgtccccaattataacatgattatcatggatgaagctcatttcacggacccttcttccattgccgctagaggctacatcagcacacgggtgggaatgggcgaggccgccgctatttttatgaccgcgacaccccctgggtctgtggaagccttcccgcagagcaatgctgtcatccaggatgaggaacgcgacatccccgagagatcctggaactctggatatgagtggattacagattttcctggcaaaaccgtttggttcgtgcccagcatcaagtccgggaatgacattgccaactgtcttcggaaaaatggaaagagagtgatccagctgtctcgcaaaacatttgataccgaataccaaaagacgaagaacaacgactgggactacgtcgtgacaaccgatattagcgagatgggcgccaatttccgggctgacagagttatcgatcctcgccggtgcctgaaacccgtgattctcaaggacgggccggaaagagtcatcctggccggccctatgcccgtgacagttgcgtccgctgcccagcgccggggaagaatcggccgcaaccacaataaagagggggatcagtatatttacatgggacagccccttaacaatgacgaggatcatgcccactggaccgaagctaagatgctgctcgacaacatcaatacgcctgagggcattatccccgccctgttcgaacctgagagagaaaagagcgcggccattgatggggagtatcggctgcgcggagaggctagaaagacctttgtggagctcatgcggcgcggcgaccttccggtctggctgtcttacaaggtggcctccgaggggttccaatatagcgatagacggtggtgctttgacggcgaaagaaacaatcaggtcctggaggaaaacatggatgtggagatctggacaaaagagggagaacgcaagaaactccggcccagatggctggacgctcgcacctactccgaccctcttgccctgcgggagttcaaggaatttgctgccggcagacggtctgttagcggggatctcatcctggagattggaaaactgccccagcacctcacacagcgcgcgcaaaatgcccttgacaacctggtgatgctgcataattccgaacagggcgggagagcttatcggcacgccatggaggagctccctgataccatcgaaacactgatgcttctggctctcattgccgtgctgaccggaggcgtcacgctgttctttctctctggccgcgggcttggaaagacaagcatcggcctgctgtgtgttatggcctccagcgtgctcctgtggatggcttctgtggagccccattggattgcggcctccatcatccttgagttctttctgatggtcctcctgattccggagcctgacagacagcggacaccccaggataaccaactggcttacgtggttatcgggctccttttcatgattctgaccgtggccgccaatgagatgggactgctcgaaacaaccaaaaaggacctgggcatcgggcacgtcgctgtggagaaccaccatcacgccgcgatgcttgatgtcgacctgcatcctgccagcgcttggacactctacgccgtggctacgaccattatcacacccatgatgcgccacaccattgaaaacacaaccgccaatatctctctgacggcgatcgccaaccaggctgccattctgatgggactcgataagggctggcctatctccaaaatggacattggcgttccccttctggctctggggtgctatagccaggtgaatccgctcaccctgacagccgctgtccttatgctggtggcccattacgcgatcattggacctggcctccaagccaaggctaccagagaggcccagaaacggacagctgccgggatcatgaagaaccccaccgttgatggaatcgtggccattgacctggatcccgtcgtgtatgacgcgaaatttgaaaagcagctgggccagatcatgctccttattctgtgtacgtctcaaatcctgctcatgcgcacaacctgggctctgtgcgagagcattacacttgccaccgggcctctgaccacactctgggagggatccccgggcaagttctggaatacgaccatcgctgtgtctatggccaacatctttagaggcagctacctggccggggctggactggccttctccctcatgaaaagccttggcgggggacggagaggcacaggggcgcagggagaaaccctgggcgagaagtggaaacgccagctgaatcagctctccaagtctgagttcaacacatataaacggagcggcattatggaggttgacagatccgaagccaaggaggggctgaagcgcggagagaccacgaaacacgctgtctctcggggcacagccaaacttagatggtttgtggaacgcaatctggtgaaacccgaggggaaggtcatcgatctcggatgtggcagagggggatggagctactattgcgctggcctgaaaaaggttaccgaagtgaagggctacaccaaagggggacctggccacgaggaacccattcctatggccacatacgggtggaacctggtgaagctccattccggaaaagacgtcttctttattccccctgagaagtgtgatacccttctgtgcgacatcggcgagtctagcccgaatcccacaatcgaagaggggagaacgctgcgcgtgctcaaaatggttgaaccttggctgcggggaaaccaattctgtattaagatccttaatccctatatgccttccgtggtcgagaccctggagcagatgcagagaaaacacggcggcatgctcgtgcgcaaccccctgagcagaaattctacacatgaaatgtactgggtttcctgcgggaccggaaacatcgtgagcgcggtcaatatgacatctagaatgctgctcaaccgctttaccatggcccacagaaagccgacgtatgagcgggatgtggacctgggcgctgggacccgccacgtggccgtcgaacctgaggttgctaaccttgatattatcggacagagaattgaaaatatcaagcatgagcacaaatccacatggcattacgacgaggataacccctataagacctgggcctaccacggcagctatgaagtgaaaccctctgggtccgctagctccatggtgaatggagtcgtgaagctgctcacaaaaccttgggacgttattcccatggtgacccaaatcgccatgacagataccacgcctttcggccagcagcgggtctttaaggagaaggtggacacaagaaccccgaaagcgaagcggggcaccgcccaaatcatggaagttacagctaaatggctgtgggggttccttagccgcaacaagaaacccagaatttgtacgcgggaggaatttacccgcaaggtgagatctaatgccgctatcggagccgtcttcgtggacgagaaccagtggaatagcgccaaggaggcggttgaagatgagcggttttgggacctggtgcatcgcgaaagagagctccacaaacagggcaagtgcgctacatgcgtctacaacatgatggggaaacgggaaaagaaactgggagagttcggcaaggccaaggggtcccgcgccatttggtacatgtggctgggcgctagatttctcgagttcgaagccctgggattcatgaatgaggatcactggttttctcgggaaaacagcctttccggcgtggagggggagggactgcataaactcggctatatcctgcgcgacatttctaagatccctgggggaaatatgtacgctgatgacaccgccggctgggatacaagaatcaccgaagacgatcttcagaacgaggcgcggattacagacatcatggaacccgagcacgccctgctcgctaaaagcattttcaagctgacctatcaaaataaagtcgtgcgcgttcagagacctgccaagaacgggacggtgatggatgtcatctcccggagagaccagcgcggctctggacaggtgggcacctacgggctgaatacatttaccaacatggaagctcaactcattcggcagatggagagcgagggaatcttctcccccagcgaactggagacaccgaaccttgccgaaagagtgctggattggctcgagaaatatggcgttgaacgcctgaagcggatggcgatctctggggacgactgtgtggtcaagcctattgatgacagatttgccaccgctcttacggccctgaatgatatgggaaaagtgcgcaaggacatcccccagtgggagccttccaaaggctggaacgattggcagcaagttcccttctgcagccatcactttcaccagctcattatgaaggacgggcgggagatcgtggtcccttgtagaaatcaggatgaactggtgggccgcgctcgggtctctcagggagccggctggtccctgagagagacagcttgcctcgggaaaagctacgcccaaatgtggcagctgatgtatttccatcgccgggaccttagactggcggccaacgctatttgttccgccgtgcccgttgattggatcccgacctctcggacaacctggagcattcacgcccatcaccagtggatgacgaccgaagacatgctctccgtgtggaatagagtctggatcgaggaaaacccttggatggaggataagacacatatcagctcttggggagacgtgccctacctgggcaagcgcgaggaccaatggtgcgggtcccttattggactgaccgctcgggccacatgggcgaccaatatccaggttgctattaaccaggtgagacgcctcatcggcaatgaaaactacctggattatatgacaagcatgaaaagatttaagaatgagtctgaccccgaaggggccctgtggtga

SEQ ID NO: 19077 - RNA, 9879 nt, synthetic construct
  misc_feature 1..9879: note = derived and/or modified CDS sequence (opt5) from DENV-1__FJ882562__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagaccagcgccggcgttaacatgtgcacccttatcgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcaccggcgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggactgtttacaagcgttggcaaactcgtccatcagattttcgggaccgcttacggagtgctgttttccggcgtgagctggacgatgaagatcgggattggcgtccttctgacctggctcggactcaattctagatccacaagcctgtctatgacctgtatcgccgtgggccttgttacactctacctgggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctctctgcggccattggcaaggcttgggaggagggggtctgcggcatcagaagcgccacgcgcctggaaaacatcatgtggaaacagatttccaacgagcttaatcatatcctgctcgaaaacgacatgaagctgacagtggttgtgggagatgtcgctggcattctggcccaggggaaaaagatgatccggccgcaacccatggagtacaaatattcttggaaaagctggggaaaggccaagattatcggcgctgacgcgcagaataccaccttcatcattgatgggcctaacacacccgaatgtcctgacgatcagagagcctggaatatctgggaggtggaggactacggatttggcattttcaccacgaacatctggcttaagctccgcgattcctatacacaggtgtgcgaccaccggctgatgagcgctgccattaaagattctaaggccgtccacgctgacatgggctactggatcgaatccgagaaaaatgaaacctggaagctggccagagcgagctttatcgaggttaagacatgtatttggcccaaatctcataccctctggtccaacggggtgctggaaagcgagatgatcattccgaagatctatggaggccctatttctcaacacaattaccgccccgggtacttcacacagaccgctggaccttggcatcttggcaaactggagctcgatttcgacctgtgcgaagggacgaccgtggtcgtggatgagcactgcggaaaccggggccccagcctgagaacaaccacagttaccggcaagatcatccacgaatggtgttgccggtcctgtacgcttcctcccctccgctttagaggggaggacggatgctggtatggcatggagattcggccggtgaaagaaaaggaggaaaatctggtcaagagcatggtgtctgccgggtccggagaggttgacagcttctccctgggcctcctgtgtatctctattatgatcgaagaggtgatgagaagccgctggtcccggaaaatgcttatgacagggaccctggccgtctttttcctcctgattatgggacagctgacatggaacgatcttatcagactgtgcattatggtgggcgctaatgcctctgaccgcatgggcatggggaccacctacctcgcgctgatggctacatttaagatgagacctatgttcgccgttggactcctgtttcggcgccttacgagcagagaggtgctgctcctgaccatcggcctgtcccttgtcgcctctgtggaactgcccaacagcctcgaggaactgggggatggactcgctatgggcatcatgattctgaaacttctgacagacttccaatcccatcagctctgggccaccctgctgagccttacatttatcaagaccacgttctctctgcactatgcttggaaaacaatggccatggtgctctccattgtcagcctgtttcccctctgtctgtctaccacctcccagaagacaacctggcttcctgttctgctggggagcctcggatgcaagccgctgacaatgttccttatcgcggagaataaaatttggggccggaagtcttggcccctgaacgaaggcatcatggccgtggggatcgtgtccattctcctgagctccctcctgaaaaacgatgtccctcttgctggacccctgatcgccggcgggatgctgattgcttgttacgtgatcagcggatctagcgccgacctctccctggagaaggccgctgaggtttcttgggaagaggaagcggagcatagcggcgcctcccacaatattcttgtggaagtccaggatgacgggacgatgaaaatcaaggatgaggagcgcgacgataccctgacaatcctcctgaaagctaccctcctggccgtgtctggagtttatcctcttagcattcccgccacactgtttgtgtggtacttctggcaaaagaagaaacagagatccggcgtcctgtgggacaccccttctcccccggaagtggagcgggctgtcctcgatgacggcatctatcgcattatgcagagagggctgcttggacggagccaggtgggcgttggggtgttccaagaaaacgtctttcatacgatgtggcacgtgacccgcggagccgttctgatgtaccagggcaagagactcgagccttcctgggcgagcgtgaaaaaggacctgatctcttacgggggaggctggcggctccagggctcctggaatacaggggaggaagtccaggtgattgctgtggagcccggcaagaaccctaagaatgttcaaaccgcccccggcacattcaagaccccggaaggggaggtcggagccatcgctctggattttaaacctggcacaagcgggtctcccattgtgaacagagaaggaaagatcgtgggcctttatggcaatggggtcgtgacgacctccggaacatacgttagcgccatcgcgcaggctaaagcctcccaggagggccctctgcccgagattgaagacgaggtgttccgcaagcggaacctgaccatcatggatctccaccccgggtctggaaaaaccagacgctatctgcctgccattgtccgggaagctatcaagagaaaacttcgcacactgattctcgccccgacgcgggtggttgctagcgagatggccgaagcgctgaaaggcatgcccatcagataccaaaccacagccgtgaagtccgagcataccgggaaagagatcgtcgacctgatgtgccacgctacatttaccatgcgcctccttagccctgtgcgggttcccaattataacatgattatcatggatgaagcccatttcacggacccttcttccattgctgccagaggctacatcagcacacgggtgggaatgggcgaggccgctgcgatttttatgaccgccacaccccctgggtctgtcgaggctttcccgcagagcaatgccgtgatccaggatgaggaacgcgacatccccgagagatcctggaactctggatatgagtggattacagattttcctggcaagaccgtgtggttcgtccccagcatcaaatccgggaatgacattgccaactgtctgcggaagaatggaaagcgcgttatccagctgtctagaaaaacatttgataccgaataccaaaagacgaaaaacaacgactgggactacgtggtgacaaccgatattagcgagatgggcgctaatttccgggccgacagagtcatcgatcctcgccggtgcctcaagcccgtgattctgaaagacgggccggaaagagttatccttgcgggccctatgcccgtgacagtcgcttccgccgcccagcgccggggaagaatcggccgcaaccacaataaggagggggatcagtatatttacatgggacagcccctgaacaatgacgaggatcatgctcactggaccgaagccaagatgctcctggacaacatcaatacgcctgagggcattatccccgcgctgttcgaacctgagcgggaaaagagcgccgctattgatggggagtatagactccgcggagaggccagaaagacctttgtggagcttatgcggcgcggcgacctgccggtttggctgtcttacaaagtggcttccgaggggttccaatatagcgatagacggtggtgctttgacggcgaacgcaacaatcaggtcctcgaggaaaacatggatgtggagatctggacaaaggagggagaacgcaagaagctgcggcccagatggcttgacgcccgcacctactccgaccctctggctctccgggagttcaaagaatttgccgcgggcagacgctctgtcagcggggatctgatcctggagattggaaagctcccccagcaccttacacagcgggcccaaaatgctctggacaacctggtgatgctccataattccgaacagggcgggagagcctatcggcacgctatggaggagctgcctgataccatcgaaacacttatgctgctcgccctgattgccgttctgaccggaggcgtgacgctgttctttctttctggccgcgggctgggaaagacaagcatcggcctgctctgtgtgatgacctccagcgtcctgctttggatggcttctgttgagccccattggattgcggcctccatcatcctggagttctttctcatggtgctgctgattccggagcctgacagacagcggacaccccaggataaccaactcgcttacgtggtcatcgggcttctgttcatgattctgacagtggccgccaatgagatgggactcctggaaaccaccaaaaaggaccttggcatcgggcacgttgctgtggagaaccaccatcacgccgcgatgctggatgtcgacctccatcctgccagcgcttggacgctgtacgccgtggctaccacaattatcacccccatgatgcgccacacaattgaaaacaccacggccaatatctctctgaccgcgatcgccaaccaggctgccattctcatgggacttgataaaggctggcctatctccaagatggacattggcgtccccctgctggctctcgggtgctatagccaggtgaatccgctgacacttaccgccgctgttctgatgctcgtggcccattacgcgatcattggacctggcctgcaagccaaagctacaagagaggcccagaagcggaccgctgccgggatcatgaagaaccccacggtcgatggaatcgtggccattgacctggatcccgttgtgtatgacgcgaaatttgaaaagcagctcggccagatcatgcttctgattctgtgtacatctcaaatcctcctgatgcgcaccacatgggctctttgcgagagcattaccctggccaccgggcctctcacaacgctgtgggagggatccccgggcaaattctggaataccacaatcgctgtctctatggccaacatctttagaggcagctacctggccggggctggactcgccttctcccttatgaaaagcctgggcgggggacggcgcggcaccggggcgcagggagaaacactgggcgagaaatggaagagacagctcaatcagctgtccaagtctgagttcaacacctataaacggagcggcattatggaggtggacagatccgaagccaaggaggggcttaaacgcggagagacgacaaagcacgctgtgtctcggggcaccgccaaactgagatggtttgttgaacgcaatctcgtcaagcccgaggggaaggtgatcgatctgggatgtggcagagggggatggagctactattgcgctggcctgaaaaaggtgaccgaagtcaaaggctacacaaaagggggacctggccacgaggaacccattcctatggccacctacgggtggaacctcgttaaacttcattccggaaaggacgtgttctttattccccctgagaaatgtgatacactgctgtgcgacattggcgagtctagcccgaatcccacgatcgaagaggggagaaccctccgcgtgctgaagatggtcgaaccttggcttcggggaaaccaattctgtattaagatcctgaatccctatatgccttccgtggttgagacactcgagcagatgcagagaaaacacggcggcatgctggtgcgcaaccccctgagcagaaattctacccatgaaatgtactgggtctcctgcgggacaggaaacatcgtgagcgcggttaatatgacctctagaatgctcctgaaccgctttacgatggcccaccggaagccgacctatgagagagatgtggaccttggcacagggacccgccacgtcgctgtggaacctgaggtggccaacctggatattatcggacagagaattgaaaatatcaaacatgagcacaagtccacatggcattacgacgaggataacccctataaaacctgggcttaccacggcagctatgaagtcaagccctctgggtccgccagctccatggttaatggagtggtgaagctcctgacaaaaccttgggacgtcattcccatggtgacccaaatcgctatgacggatacaacccctttcggccagcagcgggtttttaaggagaaagtggacacccgcacaccgaaggccaaaagaggcacggcgcaaatcatggaagtcaccgcccggtggctttgggggttcctgagcagaaacaagaagccccggatttgtacacgcgaggaatttaccagaaaagtgcggtctaatgctgccatcggagctgttttcgtggacgagaaccagtggaatagcgccaaggaggccgtcgaagatgagcgcttttgggacctcgtgcatagagaacgggagctgcacaaacagggcaagtgcgcgacatgcgtttacaacatgatggggaaacgcgaaaagaagctgggagagttcggcaaagctaaggggtccagagccatttggtacatgtggctcggcgcccggtttctggagttcgaagctcttggattcatgaatgaggatcactggttttctcgcgaaaacagcctgtccggcgtggagggggagggactccataaactgggctatatccttagagacatttctaagatccctgggggaaatatgtacgccgatgacaccgctggctgggatacacggatcaccgaagacgatctgcagaacgaggccaaaattacggacatcatggaacccgagcacgcgctcctggccaaggctattttcaaactgacctatcaaaataaggtcgtgcgcgtccagagacctgccaagaacgggacagtgatggatgttatcagccggcgcgaccagagaggctccggacaggtgggcacctacgggctcaatacatttaccaacatggaagctcaactgattcggcagatggagtctgagggaatcttcagcccctccgaacttgagacgccgaacctggccgaaagagcgctcgattggctggagaaatatggcgtcgaacgccttaagcggatggccatcagcggggacgactgtgtggtgaaacctattgatgacagatttgctacagccctgaccgctctcaatgatatgggaaaggttcgcaaagacatcccccagtgggagccttctaagggctggaacgattggcagcaagtgcccttctgctcccatcactttcaccagctgattatgaaggacgggcgggagatcgtcgtgccttgtagaaatcaggatgaactggttggccgcgcccgggtgagccagggagctggctggtctctcagagagacagcctgcctggggaaatcctacgcgcaaatgtggcagcttatgtatttccatcgccgggacctgagactcgccgctaacgccatttgtagcgccgtccccgtggattgggtcccgacctcccgcacgacctggtctatccacgctcatcaccagtggatgacaaccgaagacatgctgagcgtgtggaatcgggtttggattgaggaaaacccttggatggaggataagacacatatctccagctgggaggacgtgccctaccttggaaaaagagaagaccaatggtgcggctctctgatcgggctcaccgcccgggcgacatgggctaccaatattcaggtcgccatcaaccaggtgagacgcctgattggaaatgagaactacctggattatatgacgtccatgaagcggtttaaaaatgaaagcgaccccgagggcgccctctggtga

SEQ ID NO: 19078 - RNA, 9879 nt, synthetic construct
  misc_feature 1..9879: note = derived and/or modified CDS sequence (opt5) from DENV-1__FJ882564__SS-prME
  source 1..9879: mol_type = other RNA
agcgtgaccatgctgctcatgctgatgcccaccgcccttgctttccacctgacgacccggggaggggagcctcatatgatcgtcacaaagcaggaacggggaaaatccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatggtcgcggtgggcctgctgttcagacggctgaccagccgcgaggtgcttctgctcacaattgggctgtccctggtcgcttctgttgaacttcccaacagcctggaggaactcggagacggcctggccatggggatcatgatcctcaagctgcttaccgattttcaatcccaccagctgtgggccacactcctgagcctgaccttcattaaaacgacactttctctgcattacgcttggaagaccatggccatggtgctctccatcgtgagcctgtttcccctctgtctgtctaccacatcccagaagaccacatggcttcctgtcctgctgggaagcctcggctgcaaaccgctgacgatgttccttattgctgagaataagatctggggcagaaaatcttggcccctgaacgaagggattatggccgtgggagttgtgtccatcctcctgagctccctcctgaagaacgacgtccctcttgcgggccccctgatcgccgggggaatgctgattgcttgttatgtgatcagcggctctagcgccgatctctccctggagaaagctgccgaggtttcttgggaagaggaagccgagcacagcggggcttcccataatattcttgtggaagtccaggacgatggaaccatgaagatcaaagacgaggagcgggatgacacactgaccattctcctgaaggcgacactcctggccgtgtctggcgtctaccctcttagcatccccgctaccctgtttgtgtggtatttctggcaaaagaaaaagcagcgctccggcgttctgtgggatacgccttctcccccggaagtggagagagccgtcctcgacgatgggatctaccggattatgcagcgcggactgcttggcagaagccaggtgggggttggagtgtttcaagaaaacgtcttccacaccatgtggcacgtgacacggggcgccgtgctgatgtatcaggggaaacgcctcgagccttcctgggctagcgttaagaaagacctgatctcttacggaggcggctggagactccaggggtcctggaataccggagaggaagtccaggtgattgccgtggagcccggcaagaaccctaagaatgtccaaacagcgcccgggaccttcaaaacaccggaaggagaggtgggcgctatcgccctggactttaagcctgggacgagcggatctcccattgttaaccgggaaggcaaaatcgtgggcctttacgggaatggagtcgtgaccacatccggcacctatgttagcgccattgctcaggccaaggcgtcccaggaggggcctctgcccgagatcgaagatgaggtgttcagaaaacgcaacctgaccatcatggacctccatcccggatctggcaagacacggagatacctgcctgctattgtccgcgaagccatcaagcggaaacttagaacgctgattctcgccccgacccgcgtggttgctagcgagatggccgaagctctgaaggggatgcccatccggtatcaaacaaccgccgtgaaatccgagcacacaggcaaggagattgtcgatctgatgtgccatgcgacctttacgatgagactccttagccctgtgcgcgtgcccaattacaacatgatcatcatggacgaagcccacttcacagatccttcttccattgctgcccggggatatatcagcaccagagtcggcatgggggaggctgccgccatttttatgaccgctacaccccctggatctgttgaagcgttcccgcagagcaatgccgtgatccaggacgaggaacgggatattcccgagcgctcctggaactctggctacgagtggatcaccgactttcctgggaaaacagtgtggttcgtccccagcatcaagtccggaaatgatattgctaactgtctgagaaagaatggcaaacgggtgatccagctgtctcgcaagacctttgacacggaatatcagaaaaccaagaacaacgattgggactacgttgtgaccacagacattagcgagatgggggccaatttcagagccgatcgggtcatcgaccctagacgctgcctcaaacccgtgattctgaaggatggcccggaacgggttatccttgctggacctatgcccgtgaccgtcgcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgtttgaacctgagcgcgaaaagagcgccgcgattgacggagagtaccggctcagaggcgaggcccgcaaaacattcgtggaacttatgagaagaggggatctgccggtctggctgtcttataaggtggcttccgagggcttccaatacagcgaccgcagatggtgctttgatggagaacggaacaatcaggttctcgaggaaaacatggacgtggagatctggaccaaagagggcgaacgcaagaaactgagaccccggtggcttgatgccagaacatattccgaccctctggctctccgcgagttcaaggaatttgccgctgggcggagatctgtgagcggagacctgattctggagatcggcaagctcccccagcatcttacccagcgcgcccaaaatgcgctggataacctggtcatgctccacaattccgaacaagggggacgggcctacagacatgctatggaggagctgcctgacacaatcgaaacccttatgctgctcgccctgattgctgttctgacgggcggcgtgacactcttctttctttctgggcggggactgggcaaaaccagcatcgggctgctctgtgtgatggcctccagcgtcctgctttggatggcctctgtggagccccactggattgctgcgtccatcattctggagttctttctcatggttctgctgatcccggagcctgatcgccagagaacaccccaggacaaccaactcgcctatgtggtcatcggacttctgttcatgattctgacagtggctgccaatgagatgggcctcctggaaaccacaaagaaagatcttgggatcggacacgtcgccgtggagaaccatcaccatgctacgatgctggacgttgatctccaccctgccagcgcgtggaccctgtacgccgtggctacaaccattatcacacccatgatgcggcataccattgaaaacacgaccgccaatatctctctgacagctattgccaaccaggcggccatcctcatgggccttgacaagggctggcctatctccaaaatggatattggggtccccctgctggctctcggatgctacagccaggtgaatccgctgacccttacagccgctgttctgatgctcgtggcccactatgctatcattggccctgggctgcaagccaaggcgacccgcgaggcccagaagagaacggctgccggaatcatgaaaaaccccacagtcgacggcattgtggctatcgatctggaccccgtggtttacgatgccaagtttgaaaaacagctcgggcagatcatgcttctgattctgtgtacctctcaaatcctcctgatgcggacaacctgggccctttgcgagagcattaccctggcgacaggacctctcacgaccctgtgggagggctccccgggcaagttctggaatacaaccatcgctgtctctatggccaacatttttcgcgggagctatctggctggagccggcctcgccttctcccttatgaaaagcctcgggggaggcagacgggggacaggagctcagggcgaaaccctgggcgagaagtggaagcgccagctcaatcagctgtccaaatctgaatttaacatctacaagagaagcgggatcatggaggtggaccggtccgaagccaaagagggacttaagagaggcgagacgacacgccacgcggtgtctcgggggaccgccaaactgagatggttcgtcgaacgcaatctcgttaagcccgagggaaaggtgattgacctgggctgtgggcggggaggctggagctattactgcgctggcctgaaaaaggtgaccgaagtcaaagggtatacaaagggaggccctgggcatgaggaacccatccctatggccacctacggatggaacctcgtgaaacttcactccggcaaggatgttttctttacaccccctgagaaatgtgacacgctgctgtgcgatattggggagtctagcccgaatcccaccatcgaagagggaagaacactccgcgtgctgaagatggtcgaaccttggcttcggggcaaccaattctgtattaagatcctgaatccctacatgccttccgtggttgagaccctcgagcagatgcagagaaaacatggcgggatgctggtgcgcaaccccctgagcagaaattctacacacgaaatgtattgggtctcctgcggaaccggcaacattgtgagcgctgtgaatatgacgtctagaatgctcctgaaccgctttaccatggcccaccggaagccgacatacgagagagacgtcgatcttggggcgggaacccgccatgttgccgtggaacctgaggtggctaacctggacatcatcggccagagaattgaaaatatcaaacacgagcataagtccacatggcactatgatgaggacaacccctacaaaacctgggcctatcatgggagctacgaagtcaagccctctggatccgctagctccatggtgaatggcgttgtgaagctcctgacaaaaccttgggatgtcattcccatggtgacccaaatcgccatgacggacacaacccctttcggccagcagcgggtttttaaggagaaagtggatacccgcacaccgaaggctaaaagagggacggcccaaattatggaagtcaccgcgcggtggctttggggattcctgagcagaaacaagaagccccggatctgtacacgcgaggaatttaccagaaaagtgcggtctaatgccgctatcggcgccgttttcgtggacgagaaccagtggaatagcgctaaggaggccgtcgaagacgagcgcttttgggatctcgtgcagaaagaaagagagctgcacaagcaggggaaatgcgccacatgcgtctataacatgatgggaaagcgggaaaagaaactgggcgagttcgggaaggcgaaaggctcccgcgctatttggtacatgtggctcggagccagatttctggagttcgaagcccttggctttatgaatgaggaccactggttctctcgggaaaacagcctgtccggggtggagggagagggcctccataagctggggtacatccttcgcgatatttctaaaatccctggaggcaatatgtatgctgacgataccgccgggtgggacacaagaattaccgaagatgacctgcaaaacgaggctaagatcacggatatcatggaacccgagcacgccctcctggcgaccagcattttcaaactgacataccagaataaggttgtgcgggtccagcgccctgccaagaacggcaccgtgatggacgtgatctccagacgggatcagcgcggatctggccaagttgggacatatggactcaatacctttacgaacatggaagctcagctgattagacagatggagagcgagggcatcttccttccctccgaactggagacaccgaacctcgccgaacgggtgctggactggcttgagaaatacggggtcgaaagactgaagcgcatggctattagcggagatgactgtgtggttaaacctatcgacgatcggtttgccaccgcgctcacagccctgaatgacatgggcaaggtgagaaaagatatcccccagtgggagccttctaaggggtggaacgactggcaacaggtccccttctgctcccatcactttcaccagctgattatgaaggatggccgcgagatcgtggtcccttgtcggaatcaggacgaactcgtgggacgggctcgcgttagccaaggcgccgggtggtctctgcgggagaccgcttgccttggaaaatcctatgcccagatgtggcagctgatgtacttccatagacgcgatctccggctggctgccaacgcgatttgtagcgccgtgcccgtcgactgggtgccgacgtccagaaccacatggtctatccacgctcatcaccaatggatgaccacagaagatatgcttagcgtttggaatcgcgtgtggattgaggaaaacccttggatggaggacaagacccatgtctccagctggggcgatgtgccctatctggggaaacgggaggaccagtggtgcggatctctcatcggcctgacagccagagccacctgggcttccaatattcaggtggccatcaaccaggttcggagactgatcgggaatgaaaactacctcgactacatgacgagcatgaagcgctttaaaaatgagggcgatcccgaaggagcgctgtggtga

SEQ ID NO: 19079 - RNA, 9879 nt, synthetic construct
  misc_feature 1..9879: note = derived and/or modified CDS sequence (opt5) from DENV-1__FJ882565__SS-prME
  source 1..9879: mol_type = other RNA
agcgtgaccatgctgctgatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcggctcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtatctctattatgatcgaagaggtgatgcggagcagatggtcccgcaagatgctcatgacaggaaccctggctgttttccttctgctcattatgggccagctgacatggaacgacctgatccggctttgcattatggtgggcgccaatgcctctgatagaatggggatgggaaccacctatctggctctcatggccacatttaaaatgcgccctatgttcgcggtcggcctgctctttagacggctgacgagccgcgaggtgcttctgctcaccatcgggctgtccctggtggcttctgtcgaacttcccaacagcctggaggaactcggagacggcctggccatggggatcatgattctcaagctgcttacagatttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctgggaagcctcggctgcaaaccgctgacaatgtttcttatcgctgagaataagatttggggcagaaaatcttggcccctgaacgaagggatcatggccgtcggagtggtttccatcctcctgagctccctcctgaagaacgacgtgcctcttgcgggccccctgattgccgggggaatgctgatcgcttgttatgtcattagcggctctagcgccgatctctccctggagaaagctgccgaggtgtcttgggaagaggaagccgagcacagcggggcttcccataatatccttgttgaagtgcaggacgatggaacgatgaagattaaagacgaggagcgggatgacaccctgacaatcctcctgaaggcgaccctcctggccgtctctggcgtgtaccctcttagcatccccgctacactgttcgtctggtatttttggcaaaagaaaaagcagcgctccggcgtgctgtgggataccccttctcccccggaagttgagagagccgtgctcgacgatgggatttaccggatcatgcagcgcggactgcttggcagaagccaggtcggggtgggagttttccaagaaaacgtgttccacacgatgtggcacgtcacccggggcgccgtgctgatgtatcaggggaaacgcctcgagccttcctgggctagcgtgaagaaagacctgatttcttacggaggcggctggagactccaggggtcctggaatacaggagaggaagttcaggtcatcgccgtggagcccggcaagaaccctaagaatgtgcaaaccgcgcccgggacatttaaaaccccggaaggagaggtcggcgctattgccctggacttcaagcctgggacaagcggatctcccatcgtgaaccgggaaggcaaaattgttggcctttacgggaatggagtggtcacgacctccggcacatatgtgagcgccatcgctcaggccaaggcgtcccaggaggggcctctgcccgagatcgaagatgaggtttttagaaaacgcaacctgaccattatggacctccatcccggatctggcaagacccggagatacctgcctgctatcgtgcgcgaagccattaagcggaaacttagaacactgatcctcgccccgacgcgcgtcgtggctagcgagatggccgaagctctgaaggggatgcccattcggtatcaaaccacagccgttaaatccgagcacaccggcaaggagatcgtggatctgatgtgccatgcgacattcaccatgagactccttagccctgtccgcgtgcccaattacaacatgatcattatggacgaagcccactttacggatccttcttccatcgctgcccggggatatattagcacaagagtgggcatgggggaggctgccgccatcttcatgaccgctacaccccctggatctgtcgaagcgtttccgcagagcaatgccgttattcaggacgaggaacgggatatccccgagcgctcctggaactctggctacgagtggatcacagacttccctgggaaaaccgtgtggtttgtgcccagcattaagtccggaaatgatatcgctaactgtctgagaaagaatggcaaacgggtcattcagctgtctcgcaagacattcgacaccgaatatcagaaaacgaagaacaacgattgggactacgtggttacaaccgacatcagcgagatgggggccaattttagagccgatcgggtgattgaccctagacgctgcctcaaacccgtcatcctgaaggatggcccggaacgggtgattcttgctggacctatgcccgttacagtggcctccgcggctcagagacgcggccggatcgggagaaaccataataaggagggagaccagtacatctatatgggccagcccctgaacaatgatgaggaccacgcccactggaccgaagccaaaatgctcctggataacattaatacgcctgaggggatcattcccgctctgttcgaacctgagcgcgaaaagagcgccgcgatcgacggagagtaccggctcagaggcgaggcccgcaaaaccttcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatttggacaaaagagggcgaacgcaagaaactgagaccccggtggcttgatgccagaacctattccgaccctctggctctccgcgagtttaaggagttcgccgctgggcggagatctgtgagcggagacctgatcctggagatcggcaagctcccccagcatcttacacagcgcgcccaaaatgcgctggataacctggtgatgctccacaattccgaacaagggggacgggcctacagacatgctatggaggagctgcctgacaccattgaaacacttatgctgctcgccctgatcgctgtcctgaccggcggcgttacgctctttttcctttctgggcggggactgggcaaaacaagcattgggctgctctgtgtgatggcctccagcgtgctgctttggatggcctctgtcgagccccactggatcgctgcgtccattatcctggaatttttcctcatggtgctgctgatcccggagcctgatcgccagagaacaccccaggacaaccaactcgcctatgttgtgattggacttctgtttatgatcctgaccgtcgctgccaatgagatgggcctcctggaaacaaccaagaaagatcttgggattggacacgtggccgtcgagaaccatcaccatgctacaatgctggacgtggatctccaccctgccagcgcgtggacgctgtacgccgttgctaccacaatcattacccccatgatgcggcatacaatcgaaaacaccacggccaatatttctctgaccgctatcgccaaccaggcggccatcctcatgggccttgacaagggctggcctatttccaaaatggatatcggggtgcccctgctggctctcggatgctacagccaggtcaatccgctgacacttaccgccgctgtgctgatgctcgttgcccactatgctattatcggccctgggctgcaagccaaggcgacacgcgaggcccagaagagaaccgctgccggaattatgaaaaaccccacggtggacggcatcgtcgctatcgatctggaccccgtggtgtacgatgccaagttcgaaaaacagctcgggcagattatgcttctgatcctgtgtacatctcaaattctcctgatgcggaccacatgggccctttgcgagagcatcaccctggcgaccggacctctcacaacgctgtgggagggctccccgggcaagttttggaataccacaattgctgtttctatggccaacatcttccgcgggagctatctggctggagccggcctcgccttttcccttatgaaaagcctcgggggaggcagacgggggaccggagctcagggcgaaacactgggcgagaagtggaagcgccagctcaatcagctgtccaaatctgagttcaacatctacaagagaagcgggattatggaggtcgaccggtccgaagccaaagagggacttaagagaggcgagaccacgcgccacgcggtgtctcgggggacagccaaactgagatggttcgtggaacgcaatctcgtcaagcccgagggaaaggttatcgacctgggctgtgggcggggaggctggagctattactgcgctggcctgaaaaaggtgaccgaagtgaaagggtataccaagggaggccctgggcatgaggaacccattcctatggccacatacggatggaacctcgtcaaacttcactccggcaaggatgtgtttttcacaccccctgagaaatgtgacacactgctgtgcgatatcggggagtctagcccgaatcccacgattgaagagggaagaaccctccgcgttctgaagatggtggaaccttggcttcggggcaaccaattttgtatcaagattctgaatccctacatgccttccgtcgtggagacactcgagcagatgcagagaaaacatggcgggatgctggttcgcaaccccctgagcagaaattctacccacgaaatgtattgggtgtcctgcggaacaggcaacatcgtcagcgctgtgaatatgacctctagaatgctcctgaaccgcttcacgatggcccaccggaagccgacctacgagagagacgtggatcttggggcgggaacacgccatgtcgccgttgaacctgaggtggctaacctggacatcattggccagagaatcgaaaatattaaacacgagcataagtccacctggcactatgatgaggacaacccctacaaaacatgggcctatcatgggagctacgaagtgaagccctctggatccgctagctccatggtcaatggcgtggttaagctcctgaccaaaccttgggatgtgatccccatggtcacacaaattgccatgaccgacacgacaccttttggccagcagcgggtgttcaaggagaaagttgatacccgcaccccgaaggctaaaagagggacagcccaaatcatggaagtgacggcgcggtggctttggggatttctgagcagaaacaagaagccccggatctgtacccgcgaggagttcacaagaaaagtccggtctaatgccgctattggcgccgtgtttgttgacgagaaccagtggaatagcgctaaggaggccgtggaagacgagcgcttctgggatctcgtccagaaagaaagagagctgcacaagcaggggaaatgcgcgacctgcgtgtataacatgatgggaaagcgggaaaagaaactgggcgagtttgggaaggcgaaaggctcccgcgctatctggtacatgtggctcggagccagattcctggagtttgaagcccttggcttcatgaatgaggaccactggttctctcgggaaaacagcctgtccggggtcgagggagagggcctccataagctggggtacattcttcgcgatatctctaaaattcctggaggcaatatgtatgctgacgatacagccgggtgggacaccagaatcacagaagatgacctgcaaaacgaggctaagatcaccgatattatggaacccgagcacgccctcctggcgacgagcatctttaaactgacctaccagaataaggtggttcgggtgcagcgccctgccaagaacggcacagtcatggacgtgatttccagacgggatcagcgcggatctggccaagtggggacctatggactcaatacattcaccaacatggaagctcagctgatcagacagatggagagcgagggcatttttcttccctccgaactggagacgccgaacctcgccgaacgggttctggactggcttgagaaatacggggtggaaagactgaagcgcatggctatcagcggagatgactgtgtcgtgaaacctatcgacgatcggttcgccacagcgctcaccgccctgaatgacatgggcaaggttagaaaagatattccccagtgggagccttctaaggggtggaacgactggcaacaggtgcccttttgctcccatcacttccaccagctgatcatgaaggatggccgcgagattgtcgtgccttgtcggaatcaggacgaactcgtcggacgggctcgcgtgagccaaggcgccgggtggtctctgcgggagacagcttgccttggaaaatcctatgcccagatgtggcagctgatgtactttcatagacgcgatctccggctggctgccaacgcgatctgtagcgccgttcccgtggactgggtcccgacctccagaacgacctggtctattcacgctcatcaccaatggatgacaaccgaagatatgcttagcgtgtggaatcgcgtttggatcgaggaaaacccttggatggaggacaagacacatgtgtccagctggggcgatgtcccctatctggggaaacgggaggaccagtggtgcggatctctcattggcctgaccgccagagccacatgggcttccaatatccaggtggccatcaaccaggtgcggagactgattgggaatgaaaactacctcgactacatgaccagcatgaagcgcttcaaaaatgagggcgatcccgaaggagcgctgtggtga

SEQ ID NO: 19080 - RNA, 9879 nt, synthetic construct
  misc_feature 1..9879: note = derived and/or modified CDS sequence (opt5) from DENV-1__FJ882567__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaaaaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaagggggacgggcctacagacatgctatggaggagctgcctgacacaatcgaaacccttatgctgctcgccctgattgctgtcctgacgggcggcgttacactctttttcctttctgggcggggactgggcaaaaccagcatcgggctgctctgtgtgatggcctccagcgtgctgctttggatggcctctgtcgagccccactggattgctgcgtccatcattctggaatttttcctcatggtgctgctgatcccggagcctgatcgccagagaacaccccaggacaaccaactcgcctatgttgtgatcggacttctgtttatgattctgacagtcgctgccaatgagatgggcctcctggaaaccacaaagaaagatcttgggatcggacacgtggccgtcgagaaccatcaccatgctacgatgctggacgtggatctccaccctgccagcgcgtggaccctgtacgccgttgctacaaccattatcacacccatgatgcggcataccattgaaaacacgaccgccaatatctctctgacagctattgccaaccaggcggccatcctcatgggccttgacaagggctggcctatctccaaaatggatattggggtgcccctgctggctctcggatgctacagccaggtcaatccgctgacccttacagccgctgtgctgatgctcgttgcccactatgctatcattggccctgggctgcaagccaaggcgacccgcgaggcccagaagagaacggctgccggaatcatgaaaaaccccacagtggacggcattgtcgctatcgatctggaccccgtggtgtacgatgccaagttcgaaaaacagctcgggcagatcatgcttctgattctgtgtacctctcaaatcctcctgatgcggacaacctgggccctttgcgagagcattaccctggcgacaggacctctcacgaccctgtgggagggctccccgggcaagttttggaatacaaccatcgctgtttctatggccaacattttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatctacaagagaagcgggatcatggaggtcgaccggtccgaagccaaagagggacttaagagaggcgagacgacacgccacgcggtgtctcgggggaccgccaaactgagatggttcgtggaacgcaatctcgtcaagcccgagggaaaggttattgacctgggctgtgggcggggaggctggagctattactgcgctggcctgaaaaaggtgaccgaagtgaaagggtatacaaagggaggccctgggcatgaggaacccatccctatggccacctacggatggaacctcgtcaaacttcactccggcaaggatgtgtttttcacaccccctgagaaatgtgacacgctgctgtgcgatattggggagtctagcccgaatcccaccatcgaagagggaagaacactccgcgttctgaagatggtggaaccttggcttcggggcaaccaattttgtattaagatcctgaatccctacatgccttccgtcgtggagaccctcgagcagatgcagagaaaacatggcgggatgctggttcgcaaccccctgagcagaaattctacacacgaaatgtattgggtgtcctgcggaaccggcaacattgtcagcgctgtgaatatgacgtctagaatgctcctgaaccgcttcaccatggcccaccggaagccgacatacgagagagacgtggatcttggggcgggaacccgccatgtcgccgttgaacctgaggtggctaacctggacatcatcggccagagaattgaaaatatcaaacacgagcataagtccacatggcactatgatgaggacaacccctacaaaacctgggcctatcatgggagctacgaagtgaagccctctggatccgctagctccatggtcaatggcgtggttaagctcctgacaaaaccttgggatgtgattcccatggtcacccaaatcgccatgacggacacaaccccttttggccagcagcgggtgttcaaggagaaagttgatacccgcacaccgaaggctaaaagagggacggcccaaattatggaagtgaccgcgcggtggctttggggatttctgagcagaaacaagaagccccggatctgtacacgcgaggagttcaccagaaaagtccggtctaatgccgctatcggcgccgtgtttgttgacgagaaccagtggaatagcgctaaggaggccgtggaagacgagcgcttctgggatctcgtccagaaagaaagagagctgcacaagcaggggaaatgcgccacatgcgtgtataacatgatgggaaagcgggaaaagaaactgggcgagtttgggaaggcgaaaggctcccgcgctatttggtacatgtggctcggagccagattcctggagtttgaagcccttggcttcatgaatgaggaccactggttctctcgggaaaacagcctgtccggggtcgagggagagggcctccataagctggggtacatccttcgcgatatttctaaaatccctggaggcaatatgtatgctgacgataccgccgggtgggacacaagaattaccgaagatgacctgcaaaacgaggctaagatcacggatatcatggaacccgagcacgccctcctggcgaccagcatttttaaactgacataccagaataaggtggttcgggtgcagcgccctgccaagaacggcaccgtcatggacgtgatctccagacgggatcagcgcggatctggccaagtggggacatatggactcaataccttcacgaacatggaagctcagctgattagacagatggagagcgagggcatctttcttccctccgaactggagacaccgaacctcgccgaacgggttctggactggcttgagaaacatggggtggaaagactgaagcgcatggctattagcggagatgactgtgtcgtgaaacctatcgacgatcggttcgccaccgcgctcacagccctgaatgacatgggcaaggttagaaaagatatcccccagtgggagccttctaaggggtggaacgactggcaacaggtgcccttttgctcccaccacttccatcagctgattatgaaggatggccgcgagatcgtcgtgccttgtcggaatcaggacgaactcgtcggacgggctcgcgtgagccaaggcgccgggtggtctctgcgggagaccgcttgccttggaaaatcctacgcccagatgtggcagctgatgtattttcacagacgcgatctccggctggctgccaacgcgatttgtagcgccgttcccgtggactgggtcccgacgtccagaaccacatggtctatccatgctcaccatcaatggatgaccacagaagatatgcttagcgtgtggaatcgcgtttggattgaggaaaacccttggatggaggacaagacccacgtgtccagctggggcgatgtcccctacctggggaaacgggaggaccagtggtgcggatctctcatcggcctgacagccagagccacctgggcttccaatattcaggtggccatcaaccaggtgcggagactgatcgggaatgaaaactatctcgactacatgacgagcatgaagcgcttcaaaaatgagggcgatcccgaaggagcgctgtggtga

SEQ ID NO: 19081 - RNA, 9879 nt, synthetic construct
  misc_feature 1..9879: note = derived and/or modified CDS sequence (opt5) from DENV-1__GQ199831__SS-prME
  source 1..9879: mol_type = other RNA
agcgtgaccatgctgctcatgctgatgcccacagcccttgctttccacctgacgacccggggcggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaaacggaacccgacgatgtggactgttggtgcaatgctaccgatacatgggtgacctatggaacatgtagccaaaccggcgagcaccggcgggacaagcgctccgtcgccctggcccctcatgtggggctgggactcgagacgagaacagaaacctggatgtctagcgagggcgcttggaaacagattcagcgggttgaaacatgggccctgcgccaccccggcttcaccgtgatcgctctttttctggcccatgcgattgggacctccatcacacagaagggaatcattttcatcctcctgatgcttgtcacgccttctatggccatgagatgcgtgggcattgggagccgggattttgttgagggactgtccggcgctacctgggtggacgtcgtgctcgagcacgggagctgtgtgacaaccatggccaaggataaacccacactggacatcgaactgctcaagaccgaggtcacgaaccctgctgttctgcgcaaactttgcattgaagccaagatctctaatacaaccaccgattccagatgtccgacacaaggagaggcgaccctgatggaagaacaagacgccaacttcgtgtgccggcgcacatttgtggatagaggctggggcaatgggtgtggactcttcggcaaagggagcctgattacgtgcgctaagtttaagtgcgtcaccaaacttgagggaaagatcgtgcagtacgaaaacctgaaatattctgttatcgtgacagtccacaccggcgaccagcatcaagtggggaatgagtccacagaacacggaaccacggccaccattacaccccaggctcctaccagcgagatccagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaattcagacctccggaacaaccacgatctttgccggccatctcaaatgcagactgaagatggataaacttacactgaaggggatgagctatgttatgtgtaccggctctttcaaactcgagaaggaagtggctgagacccagcacggaacagtcctggtgcagattaagtacgagggcaccgacgccccgtgcaaaatccctttctccacacaagatgaaaagggggttacgcagaacggacggctgatcaccgcgaatcccattgtgacagacaaagagaagcctgtcaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtgtttaccagcgttggcaaactggtccatcagattttcgggacggcctacggagtgctcttttccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagttcaccgtggttgtgggagatgtcgtgggcattctcgcccaggggaaaaagatgatccggccgcaacccatggagcacaaatactcttggaaaagctggggaaaggctaagattatcggcgccgacgtgcagaataccacatttatcattgatgggcctaacacccccgaatgtcctgacgatcagagagcctggaatatctgggaggtcgaggactatggattcggcatttttacgacaaacatctggctgaagctgcgcgattcctacacccaggtttgcgaccaccggcttatgagcgctgcgattaaagattctaaggccgtgcatgctgacatgggctattggatcgaatccgagaaaaatgaaacatggaagctcgccagagccagcttcatcgaggtgaagacctgtatttggcccaaatctcacacactgtggtccaacggggtcctggaaagcgagatgatcattccgaagatctacggaggccctatttctcaacataattatcgccccgggtacttcacccagacggctggaccttggcacctcggcaaactggagcttgattttgacctgtgcgaagggaccacagtggttgtggatgagcactgcggaaaccggggccccagcctcagaaccacaaccgtcacgggcaagatcatccatgaatggtgttgccggtcctgtacactgcctcccctgcgcttcaaaggggaggacggatgctggtacggcatggagattagaccggtgaaggaaaaggaggaaaatcttgttaaaagcatggtgtctgccgggtccggagaggtcgacagcttttccctcggcctgctgtgtatctctattatgatcgaagaggtgatgcggagcagatggtcccgcaagatgctcatgaccgggacactggcggttttccttctgctcattatgggacagctgacctggaacgatctgatccggctttgcattatggtgggcgctaatgcctctgacagaatgggcatggggaccacatatctggccctcatggctacgtttaaaatgcgccctatgttcgccgtcggactgctctttagacggctgaccagccgcgaggtgcttctgctcacaatcggcctgtccctggtggcgtctgtcgaacttcccaacagcctggaggaactcggggatggactggctatgggcatcatgattctcaagctgcttaccgacttccaatcccaccagctgtgggccacactcctgagcctgacctttatcaaaacgacactttctctgcattacgcctggaagaccatggctatggttctctccattgtgagcctgttccccctctgtctgtctaccacatcccagaagaccacatggcttcctgtgctgctggggagcctcggatgcaaaccgctgacgatgtttcttatcgccgagaataagatttggggcagaaaatcttggcccctgaacgaaggcatcatggctgtcggggtggtttccatcctcctgagctccctcctgaagaacgatgtgcctcttgccggacccctgattgcgggcgggatgctgatcgcctgttatgtcattagcggatctagcgctgacctctccctggagaaagccgctgaggtgtcttgggaagaggaagccgagcacagcggcgcctcccataatatccttgttgaagtgcaggatgacgggaccatgaagattaaagatgaggagcgggacgatacactgaccatcctcctgaaggctacactcctggcggtctctggagtgtaccctcttagcatccccgccaccctgttcgtctggtatttttggcaaaagaaaaagcagcgctccggcgtgctgtgggacacgccttctcccccggaagttgagagagctgtgctcgatgacggcatttaccggatcatgcagcgcgggctgcttggaagaagccaggtcggcgtgggggttttccaagaaaacgtgttccacaccatgtggcacgtcacacggggagccgtgctgatgtatcagggcaaacgcctcgagccttcctgggccagcgtgaagaaagacctgatttcttacgggggaggctggagactccagggctcctggaataccggggaggaagttcaggtcatcgctgtggagcccggaaagaaccctaagaatgtgcaaacagcccccggcacctttaaaacaccggaaggggaggtcggagcgattgctctggatttcaagcctggcacgagcgggtctcccatcgtgaaccgggaaggaaaaattgttggcctttacggcaatggggtggtcaccacatccggaacctatgtgagcgccatcgcccaggctaaggcctcccaggagggccctctgcccgagatcgaagacgaggtttttagaaaacgcaacctgaccattatggatctccatcccgggtctggaaagacacggagatacctgcctgcgatcgtgcgcgaagctattaagcggaaacttagaacgctgatcctcgccccgacccgcgtcgtggccagcgagatggctgaagccctgaagggcatgcccattcggtatcaaacaaccgctgttaaatccgagcacacagggaaggagatcgtggacctgatgtgccatgccaccttcacgatgagactccttagccctgtccgcgtgcccaattacaacatgatcattatggatgaagcgcactttacagacccttcttccatcgccgctcggggctatattagcaccagagtgggaatgggcgaggccgctgccatcttcatgaccgccacaccccctgggtctgtcgaggcttttccgcagagcaatgcggttattcaggatgaggaacgggacatccccgagcgctcctggaactctggatacgagtggatcaccgatttccctggcaaaacagtgtggtttgtgcccagcattaagtccgggaatgacatcgccaactgtctgagaaagaatggaaaacgggtcattcagctgtctcgcaagaccttcgatacggaatatcagaagaccaagaacaacgactgggactacgtggttaccacagatatcagcgagatgggcgctaattttagagccgaccgggtgattgatcctagacgctgcctcaaacccgtcatcctgaaggacgggccggaacgggtgattcttgccggccctatgcccgttaccgtggcttccgccgcgcagagacgcggacggatcggcagaaaccataataaggagggggatcagtacatctatatgggacagcccctgaacaatgacgaggatcacgctcactggacggaagccaaaatgctcctggacaacattaatacccctgagggcatcattcccgccctgttcgaacctgagcgcgaaaagagcgctgccatcgatggggagtaccggctcagaggagaggcgcgcaaaacattcgtcgaacttatgagacggggcgacctgccggtgtggctgtcttataaggtcgcctccgaggggtttcaatacagcgatcgcagatggtgcttcgacggcgaacggaacaatcaggtgctcgaggaaaacatggatgttgagatttggaccaaagagggagaacgcaagaaactgagaccccggtggcttgacgctagaacatattccgaccctctggccctccgcgagtttaaggagttcgctgccggccggagatctgtgagcggggatctgatcctggagatcggaaagctcccccagcatcttacccagcgcgctcaaaatgccctggacaacctggtgatgctccacaattccgaacagggcgggcgggcgtacagacatgccatggaggagctgcctgatacaattgaaacccttatgctgctcgctctgatcgccgtcctgacgggaggcgttacactctttttcctttctggccgggggctgggaaaaaccagcattggcctgctctgtgtgatggcttccagcgtgctgctttggatggcctctgtcgagccccactggatcgccgcttccattatcctggaatttttcctcatggtgctgctgatcccggagcctgaccgccagagaacaccccaggataaccaactcgcgtatgttgtgattgggcttctgtttatgatcctgacagtcgccgctaatgagatgggactcctggaaaccacaaagaaagaccttggcattgggcacgtggccgtcgagaaccatcaccatgccacgatgctggatgtggacctccaccctgctagcgcctggaccctgtacgcggttgccacaaccatcattacacccatgatgcggcataccatcgaaaacacgaccgctaatatttctctgacagccatcgctaaccaggccgcgatcctcatgggacttgataagggctggcctatttccaaaatggacatcggcgtgcccctgctggccctcgggtgctacagccaggtcaatccgctgacccttacagctgccgtgctgatgctcgttgctcactatgccattatcggacctggcctgcaagctaaggccacccgcgaggcgcagaagagaacggccgctgggattatgaaaaaccccacagtggatggaatcgtcgccatcgacctggatcccgtggtgtacgacgctaagttcgaaaaacagctcggccagattatgcttctgatcctgtgtacctctcaaattctcctgatgcggacaacctgggccctttgcgagagcatcaccctggccacagggcctctcacgaccctgtgggagggatccccgggcaagttttggaatacaaccattgcggtttctatggctaacatcttccgcggcagctatctggccggggctggactcgccttttcccttatgaaaagcctgggcgggggaagacggggcacaggggcccagggagaaaccctgggcgagaagtggaagcgccagctcaatcagctgtccaaatctgagttcaacatctacaagagaagcggcattatggaggtcgaccggtccgaagctaaagaggggcttaagagaggagagacgacacgccacgccgtgtctcggggcaccgcgaaactgagatggttcgtggaacgcaatctcgtcaagcccgaggggaaggttatcgatctgggatgtggcagagggggatggagctattactgcgccggcctgaaaaaggtgaccgaagtgaaaggctatacaaaagggggacctggccatgaggaacccattcctatggctacctacgggtggaacctcgtcaaacttcactccggaaaggacgtgtttttcacaccccctgagaaatgtgatacgctgctgtgcgacatcggcgagtctagcccgaatcccaccattgaagaggggagaacactccgcgttctgaagatggtggaaccttggcttcggggaaaccaattttgtatcaagattctgaatccctacatgccttccgtcgtggagaccctcgagcagatgcagagaaaatatggcggcatgctggttcgcaaccccctgagcagaaattctacacatgaaatgtactgggtgtcctgcgggaccggaaacatcgtcagcgccgtgaatatgacgtctagaatgctcctgaaccgcttcaccatggctcaccggaagccgacatatgagagagatgtggaccttggcgccgggacccgccacgtcgcggttgaacctgaggtggccaacctggatatcattggacagagaatcgaaaatattaaacatgagcacaagtccacatggcattacgacgaggataacccctataaaacctgggcttaccacggcagctatgaagtgaagccctctgggtccgccagctccatggtcaatggagtggttaagctcctgacaaaaccttgggacgtgatccccatggtcacccaaattgctatgacggatacaaccccttttggccagcagcgggtgttcaaggagaaagttgacacccgcacaccgaaggccaaaagaggcacggctcaaatcatggaagtgaccgcccggtggctttgggggtttctgagcagaaacaagaagccccggatctgtacacgcgaggagttcaccagaaaagtccggtctaatgcggccattggagctgtgtttgttgacgagaaccagtggaatagcgccaaggaggctgtggaagatgagcgcttctgggacctcgtccagaaagaaagagagctgcataagcagggcaaatgcgccacatgcgtgtacaacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtcgagggggagggactccacaagctgggctatattcttcgcgacatctctaaaattcctgggggaaatatgtacgccgatgacaccgctggctgggatacaagaatcaccgaagacgatctgcaaaacgaggccaagatcacggacattatggaacccgagcatgctctcctggccaccagcatctttaaactgacatatcagaataaggtggttcgggtgcagcgccctgcgaagaacgggaccgtcatggatgtgatttccagacgggaccagcgcggctctggacaagtgggcacatacgggctcaataccttcacgaacatggaagcccagctgatcagacagatggagagcgagggaatttttcttccctccgaactggagacaccgaacctcgctgaacgggttctggattggcttgagaaatatggcgtggaaagactgaagcgcatggccatcagcggggacgactgtgtcgtgaaacctatcgatgaccggttcgctaccgccctcacagcgctgaatgatatgggaaaggttagaaaagacattccccagtgggagccttctaagggctggaacgattggcaacaggtgcccttttgctcccaccatttccaccagctgatcatgaaggacgggcgcgagattgtcgtgccttgtcggaatcaggatgaactcgtcggcagagcccgcgtgagccaaggagctggctggtctctgcgggagaccgcctgccttgggaaatcctacgctcagatgtggcagctgatgtattttcacagacgcgacctccggctggccgctaacgccatctgtagcgcggatcccgttgactgggtgccgacgtccagaaccacatggtctattcatgcccaccatcaatggatgaccacagaagatatgcttagcgtctggaatcgcgtgtggatcgaggaaaacccttggatggaggacaagacccacgtttccagctggggagacgtgccctacctgggcaaacgggaggatcagtggtgcgggtctctcattggactgacagctagagccacctgggcctccaatatccaggtcgctatcaaccaggtgcggagactgattggcaatgaaaactacctcgactatatgacgagcatgaagcgcttcaaaaatgagggggatcccgaaggcgccctgtggtga

SEQ ID NO: 19082 - RNA, 9879 nt, synthetic construct
  misc_feature 1..9879: note = derived and/or modified CDS sequence (opt5) from DENV-1__GQ199832__SS-prME
  source 1..9879: mol_type = other RNA
agcgtgaccatgctgctgatgctgatgcccacagcccttgctttccacctgacgacccggggaggggaacctcatatgatcgtcacaaagcaggaacggggaaaatccctcctgtttaagacctctgccggcgttaacatgtgcacacttatcgccatggacctgggggaactctgtgaagataccatgacatacaaatgcccccgcatcaccgaagctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaagaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaagaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaagggggacgggcctacaaacatgctatggaggagctgcctgacacaatcgaaacccttatgctgctcgccctgattgctgtcctgacgggcggcgttacactctttttcctttctgggagaggactgggcaagaccagcatcgggctgctctgtgtgatggcctccagcgtgctgctttggatggcctctgtcgagccccactggattgctgcgtccatcattctggaatttttcctcatggtgctgctgatcccggagcctgatcggcagcgcacaccccaggacaaccaactcgcctatgttgtgatcggacttctgtttattatcctgacagtcgctgccaatgagatgggcctcctggaaaccaccaaaaaggatcttgggattggacacgtggccgtcgagaaccatcaccatgctacgatgctggacgtggatctccaccctgccagcgcgtggaccctgtacgccgttgctacaaccatcattacacccatgatgagacataccatcgaaaacacgaccgccaatatttctctgacagctatcgccaaccaggcggccatcctcatgggccttgacaaaggctggcctatttccaagatggatatcggggtgcccctgctggctctcggatgctacagccaggtcaatccgctgacccttacagccgctgtgctgatgctcgttgcccactatgctattatcggccctgggctgcaagccaaggcgacccgggaggcccagaaacgcacggctgccggaattatgaagaaccccacagtggacggcatcgtcgctatcgatctggaccccgtggtgtacgatgccaaattcgaaaagcagctcgggcagattatgcttctgatcctgtgtacctctcaaattctcctgatgagaacaacctgggccctttgcgagagcatcaccctggcgacaggacctctcacgaccctgtgggagggctccccgggcaaattttggaatacaaccattgctgtttctatggccaacatcttccgggggagctatctggctggagccggcctcgccttttcccttatgaaaagcctcgggggaggccgcagagggacaggagctcagggcgaaaccctgggcgagaagtggaaacggcagctcaatcagctgtccaagtctgagttcaacatctacaaacgcagcgggattatggaggtcgacagatccgaagccaaggagggacttaaacggggcgagacgacaagacacgcggtgtctcgcgggaccgccaagctgcggtggttcgtggaaagaaatctcgtcaagcccgagggaaaagttatcgacctgggctgtgggcgcggaggctggagctattactgcgctggcctgaagaaagtgaccgaagtgaaggggtatacaaaaggaggccctgggcatgaggaacccattcctatggccacctacggatggaacctcgtcaaacttcactccggcaaagatgtgtttttcattccccctgagaagtgtgacacactgctgtgcgatattggggagtctagcccgaatcccacgatcgaagagggacggaccctcagagttctgaagatggtggaaccttggcttcgcggcaaccaattttgtattaaaatcctgaatccctacatgccttccgtcgtggagacactcgagcagatgcagcggaagcatggcgggatgctggttagaaaccccctgagccgcaattctacccacgaaatgtattgggtgtcctgcggaacaggcaacatcgtcagcgctgtgaatatgacctctcggatgctcctgaacagattcacgatggcccaccgcaaaccgacctacgagcgggacgtggatcttggggcgggaacaagacatgtcgccgttgaacctgaggtggctaacctggacattatcggccagcgcattgaaaatatcaagcacgagcataaatccacctggcactatgatgaggacaacccctacaagacatgggcctatcatgggagctacgaagtgaagccctctggatccgctagctccatggtcaatggcgtggttaaactcctgaccaagccttgggatgtgattcccatggtcacacaaatcgccatgaccgacacgacaccttttggccagcagagagtgttcaaagagaaggttgatacccggaccccgaaagctaagcgcgggacagcccaaatcatggaagtgacggcgagatggctttggggatttctgagccggaacaagaaacccagaatttgtacccgggaggagttcacacgcaaggtcagatctaatgccgctatcggcgccgtgtttgttgacgagaaccagtggaatagcgctaaagaggccgtggaagacgagcggttctgggatctcgtccagaaggaacgcgagctgcacaaacaggggaagtgcgcgacctgcgtgtataacatgatgggaaagagagagaaaaagctgggcgagtttgggaaagcgaagggctcccgggctatttggtacatgtggctcggagcccgcttcctggagtttgaagcccttggcttcatgaatgaggaccactggttctctagagaaaacagcctgtccggggtcgagggagagggcctccataaactggggtacatccttcgggatatttctaagatccctggaggcaatatgtatgctgacgatacagccgggtgggacacccgcatcacagaagatgacctgcaaaacgaggctaaaattaccgatatcatggaacccgagcacgccctcctggcgacgagcatttttaagctgacctaccagaataaggtggttagagtgcagcggcctgccaaaaacggcacagtcatggacgtgatctcccgcagagatcagcggggatctggccaagtggggacctatggactcaatacattcaccaacatggaagctcagctgattcgccagatggagagcgagggcatctttcttccctccgaactggagacgccgaacctcgccgaaagagttctggactggcttgagaagtacggggtggaacggctgaaaagaatggctatcagcggagatgactgtgtcgtgaagcctattgacgatcgcttcgccacagcgctcaccgccctgaatgacatgggcaaagttcggaaggatatcccccagtgggagccttctaaggggtggaacgactggcaacaggtgcccttttgctcccatcacttccaccagctgattatgaaagatggcagagagatcgtcgtgccttgtcgcaatcaggacgaactcgtcggacgggctagagtgagccaaggcgccgggtggtctctgcgcgagacagcttgccttggaaagtcctatgcccagatgtggcagctgatgtactttcatcggagagatctccgcctggctgccaacgcgatttgtagcgccgttcccgtggactgggtcccgacctcccggacgacctggtctatccacgctcatcaccaatggatgacaaccgaagatatgcttagcgtgtggaatagagtttggattgaggaaaacccttggatggaggacaaaacacatgtgtccagctggggcgatgtcccctatctggggaagcgcgaggaccagtggtgcggatctctcatcggcctgaccgcccgggccacatgggcttccaatatccaggtggccattaaccaggtgagacggctgatcgggaatgaaaactacctcgactacatgaccagcatgaaaagattcaagaatgagggcgatcccgaaggagcgctgtggtga

SEQ ID NO: 19083 - RNA, 9879 nt, synthetic construct
  misc_feature 1..9879: note = derived and/or modified CDS sequence (opt5) from DENV-1__FJ882568__SS-prME
  source 1..9879: mol_type = other RNA
tccgtgaccatgctgctgatgctgatgcccaccgcccttgctttccacctgacgaccagaggaggggagcctcatatgatcgtcacaaagcaggaacggggaaagtccctcctgtttaagacctctgccggcgttaatatgtgcacacttattgcgatggacctgggggagctctgtgaagataccatgacatacaagtgcccgcgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcaccgtggtcgatagaggctggggcaatgggtgtggactctttggcaaagggagcctgattacatgcgccaagttcaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgctacgattacaccccaggcccctacaagcgagatccagctcaccgactacggcgccctgacactggattgttctccccggaccggcctcgactttaacgaaatggtgctgcttacgatgaaggagaaatcctggctggtccataagcagtggttcctcgatctgcctcttccctggacaagcggggcttccacctctcaagagacatggaatcgccaggacctgctcgtgacctttaaaaccgcgcacgccaagaagcaggaagtcgtggttctgggaagccaagagggcgctatgcacacagccctgacgggggccaccgaaattcagacatccggaaccacaaccatcttcgctggccatctcaaatgcagactgaagatggataaacttacgctgaaggggatgagctatgtgatgtgtacaggctcttttaaactcgagaaggaagtcgccgagacccagcacggaaccgtgctggttcagattaagtacgagggcacagacgcgccgtgcaaaatccctttcctgacccaagatgaaaagggggtgacacagaacggacggcttatcacggctaatcccattgtcaccgacaaagagaagcctgtgaacatcgaagccgagccgcccttcggcgagtcctatattgtgatcggggccggagaaaaagctctcaagctgagctggtttaagaaaggctctagcattgggaagatgttcgaggccacagctagaggcgcccgccggatggcgatcctgggagataccgcctgggactttggctccatcgggggagttttcacatctgtcggcaaactcgtgcatcagatttttgggaccgcttacggagtgctgttcagcggcgtctcctggacgatgaagatcgggattggcgtgcttctgacctggctcggactgaatagcagatctacatccctgagcatgacctgtatcgccgttggccttgtgacactctacctgggggtcatggtgcaggctgattctggatgcgttattaactggaaaggccgcgaactgaagtgtgggtccggaatctttgtgaccaatgaggtccacacatggaccgaacaatataagttccaggccgacagccctaaacggctctccgcggccattggcaaggcttgggaggagggggtgtgcggcatcagatctgccacgcgcctggaaaacatcatgtggaaacagattagcaacgagcttaatcatatcctgctcgaaaacggaatgaagtttacagttgtggtcggcgacgtggtggggattctggctcagggcaagaagatgatccggccgcaacccatggagcacaaatactcctggaagtcttggggcaaggccaaaattatcggggccgatgtccagaataccaccttcatcattgacggacctaacacacccgaatgtcctgatgaccagagagcttggaatatctgggaggttgaggattatggctttggcattttcaccacgaacatctggctgaaacttcgcgacagctacacacaggtgtgcgatcaccggctcatgtccgcggccattaaagacagcaaggctgtgcatgccgatatggggtattggatcgaatctgagaaaaatgaaacctggaagctggccagagcttcctttatcgaggtcaagacatgtatttggcccaaaagccacaccctgtggtctaacggagtgctcgaatccgagatgatcattccgaagatctacggcgggcctattagccaacataattatcgccccggatacttcacacagaccgccggcccttggcacctggggaaacttgagctggacttcgatctctgcgaaggaacgaccgttgtggtcgacgagcactgcggcaaccggggcccctctctgagaacaaccacagtgaccgggaagatcatccatgaatggtgttgccggagctgtacgctgcctccccttcgctttaaaggagaggatggctgctggtacgggatggagattagaccggttaaggaaaaggaggaaaatctcgtgaaatccatggtcagcgcgggatctggcgaggtggactccttcagcctggggctgctctgtacatccatcatgattgaagaggttatgcggtctagatggagccgcaagatgctgatgaccggaacacttgctgtgtttctgctcctgatcatgggccagctgacctggaacgaccttattcggctgtgcatcatggtcggcgccaatgcctccgatagaatggggatgggaaccacatatctcgctctgatggccacgttcaaaatgcgccctatgtttgcggtgggcctcctgttcagacggcttacctctcgcgaggtgctgctcctgacaattgggctgagccttgtcgcttccgttgaactgcccaactctctcgaggaactgggagacggcctcgccatggggatcatgatcctgaaacttctgaccgattttcaaagccaccagctctgggccacactgctgtcccttaccttcattaaaacgacactgagcctccattacgcttggaagaccatggccatggtgctgtctatcgtgtccctctttcccctgtgtcttagcaccacatctcagaagaccacatggctgcctgtcctgctcggatccctgggctgcaaaccgcttacgatgttcctgattgctgagaataagatctggggcagaaaaagctggcccctcaacgaagggattatggccgtgggagttgtgtctatcctgctctccagcctgcttaagaacgacgtccctctggcgggccccctgatcgccgggggaatgctcattgcttgttatgtgatctccggcagctctgccgatctgagccttgagaaagctgccgaggtttcctgggaagaggaagccgagcactctggggctagccataatattctggtggaagtccaggacgatggaaccatgaagatcaaagacgaggagcgggatgacacactcaccattctgctcaaggcgacactgcttgccgtgtccggcgtctaccctctgtctatccccgctaccctgtttgtgtggtatttctggcaaaagaaaaagcagcgcagcggcgttctctgggatacgcctagccctcccgaagtggagagagccgtcctggacgatgggatctaccggattatgcagcgcggacttctgggcagatctcaggtgggggttggagtgtttcaagaaaacgtcttccacaccatgtggcacgtgacacggggcgccgtgctcatgtatcaggggaaacgcctggagcccagctgggcttccgttaagaaagacctcatcagctacggaggcggctggagactgcaggggtcttggaataccggagaggaagtccaggtgattgccgtggagcccggcaagaaccctaagaatgtccaaacagcgcccgggaccttcaaaacaccggaaggagaggtgggcgctatcgcccttgactttaagcctgggacgtccggaagccccattgttaaccgggaaggcaaaatcgtgggcctgtacgggaatggagtcgtgaccacatctggcacctatgtttccgccattgctcaggccaaggcgagccaggaggggcctctgcccgagatcgaagatgaggtgttcagaaaacgcaacctcaccatcatggacctgcatcccggatccggcaagacacggagataccttcctgctattgtccgcgaagccatcaagcggaaactgagaacgctcattctggccccgacccgcgtggttgcttctgagatggccgaagctctgaaggggatgcccatccggtatcaaacaaccgccgtgaaaagcgagcacacaggcaaggagattgtcgatctcatgtgccatgcgacctttacgatgagacttctgtcccctgtgcgcgtgcccaattacaacatgatcatcatggacgaagcccacttcacagatcctagctctattgctgcccggggatatatctccaccagagtcggcatgggggaggctgccgccatttttatgaccgctacaccccctggaagcgttgaagcgttcccgcagtctaatgccgtgatccaggacgaggaacgggatattcccgagcgcagctggaactccggctacgagtggatcaccgactttcctgggaaaacagtgtggttcgtcccctctatcaagagcggaaatgatattgctaactgtctgagaaagaatggcaaacgggtgatccagctctcccgcaagacctttgacacggaatatcagaagaccaagaacaacgattgggactacgttgtgaccacagacatttctgagatgggggccaatttcagagccgatcgggtcatcgaccctagacgctgcctgaaacccgtgattcttaaggatggcccggaacgggttatcctggctggacctatgcccgtgaccgtcgccagcgcggctcagagacgcggccggattgggagaaaccataataaggagggagaccagtacatctatatgggccagcccctcaacaatgatgaggaccacgcccactggacggaagccaaaatgctgctggataacatcaatacccctgaggggattatccccgctctctttgaacctgagcgcgaaaagtccgccgcgattgacggagagtaccggcttagaggcgaggcccgcaaaacattcgtggaactgatgagaagaggggatctgccggtctggctcagctataaggtggcttctgagggcttccaatactccgaccgcagatggtgctttgatggagaacggaacaatcaggttctggaggaaaacatggacgtggagatctggaccaaagagggcgaacgcaagaaacttagaccccggtggctggatgccagaacatatagcgaccctctcgctctgcgcgagttcaaggaatttgccgctgggcggagatccgtgtctggagacctgattctcgagatcggcaaacttccccagcatctgacccagcgcgcccaaaatgcgctggataacctcgtcatgctgcacaatagcgaacaagggggacgggcctacagacatgctatggaggagcttcctgacacaatcgaaaccctgatgctcctggccctgattgctgttctcacgggcggcgtgacacttttctttctgtccgggcggggactgggcaaaacctctatcgggctcctgtgtgtgatggccagctccgtccttctgtggatggccagcgtggagccccactggattgctgcgtctatcattctcgagttctttctgatggttctgctcatcccggagcctgatcgccagagaacaccccaggacaaccaacttgcctatgtggtcatcggactgctgttcattatcctcacagtggctgccaatgagatgggcctgcttgaaaccacaaagaaagatctggggattggacacgtcgccgtggagaaccatcaccatgctacgatgctcgacgttgatctgcaccctgcctccgcgtggaccctgtacgccgtggctacaaccatcattacacccatgatgcggcataccatcgaaaacacgaccgccaatattagcctcacagctatcgccaaccaggcggccatccttatgggcctggacaagggctggcctatttctaaaatggatatcggggtccccctgctcgctctgggatgctactcccaggtgaatccgcttaccctgacagccgctgttctcatgctggtggcccactatgctattatcggccctgggctgcaagccaaggcgacccgcgaggcccagaagagaacggctgccggaattatgaaaaaccccacagtcgacggcatcgtggctatcgatctcgaccccgtggtttacgatgccaagtttgaaaaacagcttgggcagattatgctgctgatcctctgtaccagccaaattctgcttatgcggacaacctgggccctgtgcgagtctatcaccctcgcgacaggacctctgacgaccctgtgggagggcagcccgggcaagttctggaatacaaccattgctgtctccatggccaacatctttcgcgggtcttatctcgctggagccggccttgccttcagcctgatgaaatccctcgggggaggcagacgggggacaggagctcagggcgaaaccctcggcgagaagtggaagcgccagctgaatcagcttagcaaatccgaatttaacatctacaagagatctgggattatggaggtggaccggagcgaagccaaagagggactgaagagaggcgagacgacacgccacgcggtgtcccgggggaccgccaaactcagatggttcgtcgaacgcaatctggttaagcccgagggaaaggtgatcgacctgggctgtgggcggggaggctggtcttattactgcgctggcctcaaaaaggtgaccgaagtcaaagggtatacaaagggaggccctgggcatgaggaacccattcctatggccacctacggatggaaccttgtgaaactgcacagcggcaaggatgttttctttacaccccctgagaaatgtgacacgctgctctgcgatatcggggagtcctctccgaatcccaccattgaagagggaagaacactgcgcgtgcttaagatggtcgaaccttggctgcggggcaaccaattctgtatcaagattctcaatccctacatgcctagcgtggttgagaccctggagcagatgcagagaaaacatggcgggatgctggtgcgcaaccccctctcccggaatagcacacacgaaatgtattgggtctcttgcggaaccggcaacatcgtgtccgctgtgaatatgacgagcagaatgctgcttaaccgctttaccatggcccaccggaagccgacatacgagagagacgtcgatctgggggcgggaacccgccatgttgccgtggaacctgaggtggctaacctcgacatcattggccagagaatcgaaaatattaaacacgagcataagtctacatggcactatgatgaggacaacccctacaaaacctgggcctatcatgggtcctacgaagtcaagcccagcggatctgcttccagcatggtgaatggcgttgtgaagctgcttacaaaaccttgggatgtcatccccatggtgacccaaattgccatgacggacacaacccctttcggccagcagcgggtttttaaggagaaagtggatacccgcacaccgaaggctaaaagagggacggcccaaatcatggaagtcaccgcgcggtggctgtggggattcctctccagaaacaagaagccccggatctgtacacgcgaggaatttaccagaaaagtgcggagcaatgccgctattggcgccgttttcgtggacgagaaccagtggaactctgctaaggaggccgtcgaagacgagcgcttttgggatctggtgcagaaagaaagagagctgcacaagcaggggaaatgcgccacatgcgtctataacatgatgggaaagcgggaaaagaaactcggcgagttcgggaaggcgaaaggcagccgcgctatctggtacatgtggctgggagccagatttcttgagttcgaagccctgggctttatgaatgaggaccactggttctcccgggaaaactctctcagcggggtggagggagagggcctgcataaacttgggtacattctgcgcgatatctccaaaattcctggaggcaatatgtatgctgacgataccgccgggtgggacacaagaatcaccgaagatgacctccaaaacgaggctaagatcacggatattatggaacccgagcacgccctgctggcgacctctatcttcaaactcacataccagaataaggttgtgcgggtccagcgccctgccaagaacggcaccgtgatggacgtgattagcagacgggatcagcgcggatccggccaagttgggacatatggactgaatacctttacgaacatggaagctcagcttatcagacagatggagtctgagggcattttcctgcccagcgaactcgagacaccgaacctggccgaacgggtgcttgactggctggagaaatacggggtcgaaagactcaagcgcatggctatctccggagatgactgtgtggttaaacctatcgacgatcggtttgccaccgcgctgacagccctgaatgacatgggcaaggtgagaaaagatattccccagtgggagcctagcaaggggtggaacgactggcaacaggtccccttctgctctcatcactttcaccagctcatcatgaaggatggccgcgagattgtggtcccttgtcggaatcaggacgaactggtgggacgggctcgcgtttcccaaggcgccgggtggagccttcgggagaccgcttgcctgggaaaatcttatgcccagatgtggcagctcatgtacttccatagacgcgatctgcggcttgctgccaacgcgatctgttccgccgtgcccgtcgactgggtgccgacgagcagaaccacatggtccattcacgctcatcaccaatggatgaccacagaagatatgctgtctgtttggaatcgcgtgtggatcgaggaaaacccttggatggaggacaagacccatgtcagctcctggggcgatgtgccctatctcgggaaacgggaggaccagtggtgcggaagcctgattggcctgacagccagagccacctgggcttctaatatccaggtggccatcaaccaggttcggagactcattgggaatgaaaactacctggactacatgacgtccatgaagcgctttaaaaatgagggcgatcccgaaggagcgctttggtga

SEQ ID NO: 19084 - RNA, 9879 nt, synthetic construct
  misc_feature 1..9879: note = derived and/or modified CDS sequence (opt5) from DENV-1__FJ882569__SS-prME
  source 1..9879: mol_type = other RNA
agcgtgaccatgctgctgatgctgatgcccacagcccttgctttccacctgacgaccagaggaggggaacctcatatgatcgtcacaaagcaggaacggggaaaatccctcctgtttaagacctctgccggagttaacatgtgcacacttattgcgatggacctgggggaactctgtgaagataccatgacatacaaatgccccagaatcaccgaagctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaagaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagacggtcttggcccctgaacgaagggattatggccgtcggagtggtttccatcctcctgagctccctcctgaaaaacgacgtgcctcttgcgggccccctgatcgccgggggaatgctgattgcttgttatgtcatcagcggctctagcgccgatctctccctggagaaggctgccgaggtgtcttgggaagaggaagccgagcacagcggggcttcccataatattcttgttgaagtgcaggacgatggaaccatgaaaatcaaggacgaggagcgcgatgacacactgaccattctcctgaaagcgacactcctggccgtctctggcgtgtaccctcttagcatccccgctaccctgttcgtctggtatttttggcaaaagaagaaacagagatccggcgtgctgtgggatacgccttctcccccggaagttgagcgggccgtgctcgacgatgggatctaccgcattatgcagagaggactgcttggccggagccaggtcggggtgggagttttccaagaaaacgtgttccacaccatgtggcacgtcacacgcggcgccgtgctgatgtatcaggggaagagactcgagccttcctgggctagcgtgaaaaaggacctgatctcttacggaggcggctggcggctccaggggtcctggaataccggagaggaagttcaggtcattgccgtggagcccggcaaaaaccctaagaatgtgcaaacagcgcccgggacctttaagacaccggaaggagaggtcggcgctatcgccctggacttcaaacctgggacgagcggatctcccattgtgaacagagaaggcaagatcgttggcctttacgggaatggagtggtcaccacatccggcacctatgtgagcgccattgctcaggccaaagcgtcccaggaggggcctctgcccgagatcgaagatgaggtttttcgcaagcggaacctgaccatcatggacctccatcccggatctggcaaaacaagacgctacctgcctgctattgtgcgggaagccatcaagagaaaacttcgcacgctgattctcgccccgacccgggtcgtggctagcgagatggccgaagctctgaaagggatgcccatcagatatcaaacaaccgccgttaagtccgagcacacaggcaaagagattgtggatctgatgtgccatgcgaccttcacgatgcgcctccttagccctgtccgggtgcccaattacaacatgatcatcatggacgaagcccactttacagatccttcttccattgctgccagaggatatatcagcacccgggtgggcatgggggaggctgccgccattttcatgaccgctacaccccctggatctgtcgaagcgtttccgcagagcaatgccgttatccaggacgaggaacgcgatattcccgagagatcctggaactctggctacgagtggatcaccgacttccctgggaagacagtgtggtttgtgcccagcatcaaatccggaaatgatattgctaactgtctgcggaagaatggcaagcgcgtcatccagctgtctagaaaaaccttcgacacggaatatcaaaagaccaagaacaacgattgggactacgtggttaccacagacattagcgagatgggggccaattttcgggccgatagagtgatcgaccctcgccggtgcctcaagcccgtcattctgaaagatggcccggaaagagtgatccttgctggacctatgcccgttaccgtggcctccgcggctcagcgccggggcagaattgggcgcaaccataataaggagggagaccagtacatctatatgggccagcccctgaacaatgatgaggaccacgcccactggacggaagccaagatgctcctggataacatcaatacccctgaggggattatccccgctctgttcgaacctgagcgggaaaagagcgccgcgattgacggagagtacagactccgcggcgaggccagaaagacattcgtcgagcttatgcggcgcggggatctgccggtgtggctgtcttataaagtcgcttccgagggctttcaatacagcgacagacggtggtgcttcgatggagaacgcaacaatcaggtgctcgaggaaaacatggacgttgagatctggaccaaggagggcgaacgcaaaaagctgcggcccagatggcttgatgcccgcacatattccgaccctctggctctccgggagtttaaagagttcgccgctgggagacgctctgtgagcggagacctgattctggagatcggcaagctcccccagcatcttacccagcgggcccaaaatgcgctggataacctggtgatgctccacaattccgaacaagggggcagagcctaccggcatgctatggaggagctgcctgacacaatcgaaacccttatgctgctcgccctgattgctgtcctgacgggcggcgttacactctttttcctttctgggcgcggactgggcaagaccagcatcgggctgctctgtgtgatggcctccagcgtgctgctttggatggcctctgtcgagccccactggattgctgcgtccatcattctggaatttttcctcatggtgctgctgatcccggagcctgatagacagcggacaccccaggacaaccaactcgcctatgttgtgatcggacttctgtttatgattctgacagtcgctgccaatgagatgggcctcctggaaaccaccaaaaaggatcttgggatcggacacgtggccgtcgagaaccatcaccatgctacgatgctggacgtggatctccaccctgccagcgcgtggaccctgtacgccgttgctacaaccattatcacacccatgatgcgccataccattgaaaacacgaccgccaatatctctctgacagctattgccaaccaggcggccatcctcatgggccttgacaaaggctggcctatctccaagatggatattggggtgcccctgctggctctcggatgctacagccaggtcaatccgctgacccttacagccgctgtgctgatgctcgttgcccactatgctatcattggccctgggctgcaagccaaagcgaccagagaggcccagaagcggacggctgccggaatcatgaagaaccccacagtggacggcattgtcgctatcgatctggaccccgtggtgtacgatgccaaattcgaaaagcagctcgggcagatcatgcttctgattctgtgtacctctcaaatcctcctgatgcgcacaacctgggccctttgcgagagcattaccctggcgacaggacctctcacgaccctgtgggagggctccccgggcaaattttggaatacaaccatcgctgtttctatggccaacattttcagagggagctatctggctggagccggcctcgccttttcccttatgaaaagcctcgggggaggccggcgcgggacaggagctcagggcgaaaccctgggcgagaaatggaagagacagctcaatcagctgtccaagtctgagttcaacatctacaaacggagcgggatcatggaggtcgacagatccgaagccaaggagggacttaaacgcggcgagacgacacggcacgcggtgtctagagggaccgccaagctgcgctggttcgtggaacggaatctcgtcaaacccgagggaaaggttattgacctgggctgtgggagaggaggctggagctattactgcgctggcctgaagaaagtgaccgaagtgaaggggtatacaaaaggaggccctgggcatgaggaacccatccctatggccacctacggatggaacctcgtcaaacttcactccggcaaagatgtgtttttcacaccccctgagaagtgtgacacgctgctgtgcgatattggggagtctagcccgaatcccaccatcgaagagggacgcacactccgggttctgaaaatggtggaaccttggcttagaggcaaccaattttgtattaagatcctgaatccctacatgccttccgtcgtggagaccctcgagcagatgcagcgcaagcatggcgggatgctggttcggaaccccctgagcagaaattctacacacgaaatgtattgggtgtcctgcggaaccggcaacattgtcagcgctgtgaatatgacgtctcgcatgctcctgaaccggttcaccatggcccacagaaaaccgacatacgagcgcgacgtggatcttggggcgggaaccagacatgtcgccgttgaacctgaggtggctaacctggacatcatcggccagcggattgaaaatatcaagcacgagcataaatccacatggcactatgatgaggacaacccctacaagacctgggcctatcatgggagctacgaagtgaaaccctctggatccgctagctccatggtcaatggcgtggttaagctcctgacaaagccttgggatgtgattcccatggtcacccaaatcgccatgacggacacaaccccttttggccagcagcgcgtgttcaaagagaaggttgataccagaacaccgaaagctaagcgggggacggcccaaattatggaagtgaccgcgagatggctttggggatttctgagccggaacaaaaagccccgcatctgtacaagagaggagttcacccggaaggtccgctctaatgccgctatcggcgccgtgtttgttgacgagaaccagtggaatagcgctaaagaggccgtggaagacgagagattctgggatctcgtccagaaggaacgggagctgcacaaacaggggaagtgcgccacatgcgtgtataacatgatgggaaaacgcgaaaagaagctgggcgagtttgggaaagcgaagggctccagagctatttggtacatgtggctcggagcccggttcctggagtttgaagcccttggcttcatgaatgaggaccactggttctctcgcgaaaacagcctgtccggggtcgagggagagggcctccataaactggggtacatccttagagatatttctaagatccctggaggcaatatgtatgctgacgataccgccgggtgggacacacggattaccgaagatgacctgcaaaacgaggctaaaatcacggatatcatggaacccgagcacgccctcctggcgaccagcatttttaagctgacataccagaataaagtggttcgcgtgcagagacctgccaagaacggcaccgtcatggacgtgatctcccggcgcgatcagagaggatctggccaagtggggacatatggactcaataccttcacgaacatggaagctcagctgattcggcagatggagagcgagggcatctttcttccctccgaactggagacaccgaacctcgccgaaagagttctggactggcttgagaagtacggggtggaacgcctgaaacggatggctattagcggagatgactgtgtcgtgaagcctatcgacgatagattcgccaccgcgctcacagccctgaatgacatgggcaaagttcgcaaggatatcccccagtgggagccttctaaagggtggaacgactggcaacaggtgcccttttgctcccatcacttccaccagctgattatgaaggatggccgggagatcgtcgtgccttgtagaaatcaggacgaactcgtcggacgcgctcgggtgagccaaggcgccgggtggtctctgagagagaccgcttgccttggaaagtcctatgcccagatgtggcagctgatgtactttcatcgccgggatctcagactggctgccaacgcgatttgtagcgccgttcccgtggactgggtcccgacgtcccgcaccacatggtctatccacgctcatcaccaatggatgaccacagaagatatgcttagcgtgtggaatcgggtttggattgaggaaaacccttggatggaggacaaaacccatgtgtccagctggggcgatgtcccctatctggggaagagagaggaccagtggtgcggatctctcatcggcctgacagcccgggccacctgggcttccaatattcaggtggccatcaaccaggtgagacgcctgatcgggaatgaaaactacctcgactacatgacgagcatgaaacggttcaagaatgagggcgatcccgaaggagcgctgtggtga

SEQ ID NO: 19085 - RNA, 9879 nt, synthetic construct
  misc_feature 1..9879: note = derived and/or modified CDS sequence (opt5) from DENV-1__GQ199833__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcacagacgggaccgcagatccgtcgccctggctcctcatgtggggctgggactcgagacccggacggaaacatggatgtctagcgagggcgcctggaagcagattcagcgcgttgaaacctgggctctgagacaccccggcttcacagtgatcgccctttttctggcgcatgccattgggacctccatcacccagaaaggaatcattttcatcctcctgatgcttgtcacaccttctatggctatgcggtgcgtgggcattgggagccgcgattttgttgagggactgtccggcgccacgtgggtggacgtcgtgctcgagcacgggagctgtgtgaccacaatggctaaggataagcccaccctggacatcgaactgctcaaaacagaggtcaccaaccctgccgttctgagaaagctttgcattgaagcgaaaatctctaatacgacaaccgattcccggtgtccgacccaaggagaggccacactgatggaagagcaggacgctaacttcgtgtgccgcagaacctttgtggatcggggctggggcaatgggtgtggactcttcggcaaggggagcctgattacatgcgccaaatttaagtgcgtcacgaagcttgagggaaaaatcgtgcagtacgaaaacctgaagtattctgttatcgtgaccgtccacacaggcgaccagcatcaagtggggaatgagtccaccgaacacggaacaaccgctacgattaccccccaggcccctacaagcgagatccagctcaccgactacggcgccctgacactggattgttctccccgcaccggcctcgacttcaacgaaatggttctgcttacgatgaaagggaagtcctggctggtgcataaacagtggtttctcgatctgcctcttccctggacaagcggagcttccacctctcaagagacatggaatagacaggacctgctcgtcaccttcaagaccgcgcacgccaaaaagcaggaggtggtcgtgctgggcagccaagaaggggctatgcacacagccctgacgggagccaccgagattcagacatccggcaccacaaccatctttgctgggcatctcaagtgccggctgaaaatggataagcttacgctgaaaggcatgagctatgttatgtgtacaggatctttcaagctcgaaaaagaggtggccgaaacccagcacggcaccgtcctggtgcagattaagtacgaggggacagacgcgccgtgcaagatccctttctccacccaagatgagaaaggagttacacagaacggcagactgatcacggctaatcccattgtgaccgacaaggaaaaacctgtcaacatcgaggccgaacccccctttggggagagctatattgtgatcggagccggcgagaaggctcttaaactctcttggttcaagaaggggagctccattggcaaaatgtttgaagccacagctcgcggagcccggagaatggcgatcctgggcgataccgcctgggacttcgggtctatcggaggcgtgtttacaagcgttgggaagctggtccatcagattttcggaaccgcttacggcgtgctcttttccggggtgagctggacgatgaaaatcggcattggagtcctgcttacctggctgggcctcaattctcgctccacaagcctgtctatgacctgtatcgccgtggggctggttacactttacctcggagtgatggtccaggctgattccggctgcgtgattaactggaaggggcgggagctgaaatgtggaagcggcatcttcgttaccaatgaagtgcacacatggaccgagcaatataagtttcaggccgactcccctaagagactgtctgcggccattgggaaagcttgggaagagggcgtctgcggaatccgcagcgccacgcggctcgagaacatcatgtggaagcagatttccaacgaactgaatcatatccttctggagaacggcatgaaattcacagtggttgtgggggacgtcgtgggaattctcgctcagggcaagaaaatgatcagaccgcaacccatggaacacaagtactcttggaaaagctgggggaaggccaagattatcggagccgatgtgcagaataccacctttatcattgacggccctaacacacccgagtgtcctgatgaccagcgcgcttggaatatctgggaagtcgaggattatggcttcgggatttttaccacgaacatctggctgaaactgcgggactcctacacacaggtttgcgatcacagacttatgagcgcggccattaaggactctaaagctgtgcatgccgatatgggatattggatcgagtccgaaaagaatgagacctggaaactcgcccgcgctagcttcatcgaagtgaagacatgtatttggcccaagtctcacaccctgtggtccaacggcgtcctggagagcgaaatgatcattccgaaaatctacgggggacctatttctcaacataattatcggcccggctacttcacacagaccgccgggccttggcacctcggaaagctggagcttgactttgatctgtgcgagggcacgaccgtggttgtggacgaacactgcggcaacagagggcccagcctccggacaaccacagtcaccggaaaaatcatccatgagtggtgttgccgctcctgtacgctgcctcccctgagattcaagggcgaagatgggtgctggtacggaatggagattcggccggtgaaagagaaggaagagaatcttgttaagagcatggtgtctgcgggctccggggaagtcgacagcttttccctcggactgctgtgtatctctattatgatcgaggaagtgatgagaagccgctggtcccggaaaatgctcatgacaggcaccctggctgttttccttctgctcattatgggccagctgacatggaacgacctgatcagactttgcattatggtgggggccaatgcctctgatcgcatgggaatgggcaccacctatctggctctcatggccacatttaagatgagacctatgttcgcggtcgggctgctctttcggcgcctgacgagcagagaggtgcttctgctcaccatcggactgtccctggtggcttctgtcgagcttcccaacagcctggaagagctcggcgacgggctggccatgggaatcatgattctcaaactgcttacagatttccaatcccaccagctgtgggccaccctcctgagcctgacatttatcaagaccacgctttctctgcattacgcttggaaaacaatggccatggttctctccattgtgagcctgttccccctctgtctgtctaccacctcccagaagacaacctggcttcctgtgctgctgggcagcctcggctgcaagccgctgacaatgtttcttatcgctgaaaataaaatttgggggcggaagtcttggcccctgaacgagggaatcatggccgtcggcgtggtttccatcctcctgagctccctcctgaaaaacgacgtgcctcttgcggggcccctgattgccggaggcatgctgatcgcttgttatgtcattagcgggtctagcgccgatctctccctggaaaaggctgccgaggtgtcttgggaggaagaggccgaacacagcggagcttcccataatatccttgttgaggtgcaggacgatggcacgatgaaaattaaggacgaagagcgcgatgacaccctgacaatcctcctgaaagcgaccctcctggccgtctctggcgtgtaccctcttagcatccccgctacactgttcgtctggtatttttggcaaaagaagaaacagagatccggggtgctgtgggataccccttctcccccggaggttgaacgggccgtgctcgacgatggaatttaccgcatcatgcagagaggcctgcttgggcggagccaggtcggagtgggcgttttccaagagaacgtgttccacacgatgtggcacgtcacccgcggggccgtgctgatgtatcagggaaagagactcgaaccttcctgggctagcgtgaaaaaggacctgatttcttacggcggcgggtggcggctccagggatcctggaatacaggcgaggaggttcaggtcatcgccgtggaacccgggaaaaaccctaagaatgtgcaaaccgcgcccggaacatttaagaccccggagggcgaagtcggggctattgccctggacttcaaacctggaacaagcggctctcccatcgtgaacagagagggcaagattgttgggctttacggaaatggcgtggtcacgacctccgggacatatgtgagcgccatcgctcaggccaaagcgtcccaggaaggacctctgcccgagatcgaggatgaagtttttcgcaagcggaacctgaccattatggacctccatcccggctctgggaaaaccagacgctacctgcctgctatcgtgcgggaggccattaagagaaagcttcgcacactgatcctcgccccgacgcgggtcgtggctagcgaaatggccgaggctctgaaaggcatgcccattagatatcaaaccacagccgttaagtccgaacacaccggaaaagagatcgtggatctgatgtgccatgcgacattcaccatgcgcctccttagccctgtccgggtgcccaattacaacatgatcattatggacgaggcccactttacggatccttcttccatcgctgccagaggctatattagcacacgggtggggatgggagaagctgccgccatcttcatgaccgctaccccccctggctctgtcgaggcgtttccgcagagcaatgccgttattcaggacgaagagcgcgatatccccgaaagatcctggaactctgggtacgagtggatcacagacttccctggaaagaccgtgtggtttgtgcccagcattaaatccggcaatgatatcgctaactgtctgcggaagaatgggaagcgcgtcattcagctgtctagaaaaacattcgacaccgagtatcaaaagacgaaaaacaacgattgggactacgtggttacaaccgacatcagcgaaatgggcgccaattttcgggccgatagagtgattgaccctcgccggtgcctcaagcccgtcatcctgaaagatggaccggagagagtgattcttgctggccctatgcccgttacagtggcctccgcggctcagcgccgggggagaatcggacgcaaccataataaggaaggcgaccagtacatctatatggggcagcccctgaacaatgatgaggaccacgcccactggaccgaggccaagatgctcctggataacattaatacgcctgaaggaatcattcccgctctgttcgagcctgaacgggagaaaagcgccgcgatcgacggcgaatacagactccgcggggaggccagaaagaccttcgtcgagcttatgcggcgcggcgatctgccggtgtggctgtcttataaagtcgcttccgaaggatttcaatacagcgacagacggtggtgcttcgatggcgagcgcaacaatcaggtgctcgaagagaacatggacgttgaaatttggacaaaggagggggagagaaaaaagctgcggcccagatggcttgatgcccgcacctattccgaccctctggctctccgggaatttaaagagttcgccgctggaagacgctctgtgagcggcgacctgatcctggaaatcgggaagctcccccagcatcttacacagcgggcccaaaatgcgctggataacctggtgatgctccacaattccgagcagggaggcagagcctaccggcatgctatggaagagctgcctgacaccattgagacacttatgctgctcgccctgatcgctgtcctgaccggcggggttacgctctttttcctttctggacgcggcctggggaagacaagcattggactgctctgtgtgatggcctccagcgtgctgctttggatggcctctgtcgaaccccactggatcgctgcgtccattatcctggagtttttcctcatggtgctgctgatcccggaacctgatagacagcggaccccccaggacaaccaactcgcctatgttgtgattggccttctgtttatgatcctgaccgtcgctgccaatgagatggggctcctggagacaaccaaaaaggatcttggaattggccacgtggccgtcgaaaaccatcaccatgctacaatgctggacgtggatctccaccctgccagcgcgtggacgctgtacgccgttgctaccacaatcattacccccatgatgcgccatacaatcgagaacaccacggccaatatttctctgaccgctatcgccaaccaggcggccatcctcatgggccttgacaaagggtggcctatttccaagatggatatcggagtgcccctgctggctctcggctgctacagccaggtcaatccgctgacacttaccgccgctgtgctgatgctcgttgcccactatgctattatcgggcctggactgcaagccaaagcgacaagagaagcccagaagcggaccgctgccggcattatgaagaaccccacggtggacgggatcgtcgctatcgatctggaccccgtggtgtacgatgccaaattcgagaagcagctcggacagattatgcttctgatcctgtgtacatctcaaattctcctgatgcgcaccacatgggccctttgcgaaagcatcaccctggcgaccggccctctcacaacgctgtgggagggctccccggggaaattttggaataccacaattgctgtttctatggccaacatcttcagaggaagctatctggctggcgccgggctcgccttttcccttatgaagagcctgggaggcgggcggcgcggaaccggcgctcagggcgagacactgggggaaaaatggaagagacagctcaatcagctgtccaagtctgagttcaacatctacaaacggagcggaattatggaagtcgacagatccgaggccaaggaaggccttaaacgcggggagaccacgcggcacgcggtgtctagaggaacagccaagctgcgctggttcgtggagcggaatctcgtcaaacccgaaggcaaggttatcgacctggggtgtggaagaggcggctggagctattactgcgctgggctgaagaaagtgaccgaggtgaagggatataccaaaggcgggcctggacatgaagagcccattcctatggccacatacggctggaacctcgtcaagcttcactccgggaaagatgtgtttttcaccccccctgaaaagtgtgacacactgctgtgcgatatcggagagtctagcccgaatcccacgattgaggaaggccgcaccctccgggttctgaaaatggtggagccttggcttagaggcaaccaattttgtatcaagattctgaatccctacatgccttccgtcgtggaaacactcgagcagatgcagcgcaagcatgggggaatgctggttcggaaccccctgagcagaaattctacccacgagatgtattgggtgtcctgcggcacagggaacatcgtcagcgctgtgaatatgacctctcgcatgctcctgaaccggttcacgatggcccacagaaaaccgacctacgaacgcgacgtggatcttggagcgggcacaagacatgtcgccgttgagcctgaagtggctaacctggacatcattgggcagcggatcgagaatattaagcacgaacataaatccacctggcactatgatgaggacaacccctacaagacatgggcctatcatggaagctacgaggtgaaaccctctggctccgctagctccatggtcaatggcgtggttaagctcctgaccaagccttgggatgtgatccccatggtcacacaaattgccatgaccgacacgacaccttttgggcagcagcgcgtgttcaaagaaaaggttgataccagaaccccgaaagctaagcggggaacagcccaaatcatggaggtgacggcgagatggctttggggctttctgagccggaacaaaaagccccgcatctgtaccagagaagagttcacacggaaggtccgctctaatgccgctattggggccgtgtttgttgacgaaaaccagtggaatagcgctaaagaggccgtggaggacgaaagattctgggatctcgtccagaaggagcgggaactgcacaaacagggaaagtgcgccacctgcgtgtataacatgatgggcaaacgcgagaagaagctgggggaatttggcaaagcgaagggatccagagctatctggtacatgtggctcggcgcccggttcctggagtttgaggcccttgggttcatgaatgaagaccactggttctctcgcgagaacagcctgtccggagtcgaaggcgaggggctccataaactgggatacattcttagagatatctctaagattcctggcgggaatatgtatgctgacgatacagccggctgggacacccggatcacagaggatgacctgcaaaacgaagctaaaatcaccgatattatggagcccgaacacgccctcctggcgacgagcatctttaagctgacctaccagaataaagtggttcgcgtgcagagacctgccaagaacggaacagtcatggacgtgatttcccggcgcgatcagagaggctctgggcaagtgggaacctatggcctcaatacattcaccaacatggaggctcagctgatccggcagatggaaagcgaggggatttttcttccctccgagctggaaacgccgaacctcgccgagagagttctggactggcttgaaaagtacggagtggagcgcctgaaacggatggctatcagcggcgatgactgtgtcgtgaagcctatcgacgatagattcgccacagcgctcaccgccctgaatgacatggggaaagttcgcaaggatattccccagtgggaaccttctaaaggctggaacgactggcaacaggtgcccttttgctcccatcacttccaccagctgatcatgaaggatggacgggagattgtcgtgccttgtagaaatcaggacgagctcgtcggccgcgctcgggtgagccaaggggccggatggtctctgagagaaacagcttgccttggcaagtcctatgcccagatgtggcagctgatgtactttcatcgccgggatctcagactggctgccaacgcgatctgtagcgccgttcccgtggactgggtcccgacctcccgcacgacctggtctattcacgctcatcaccaatggatgacaaccgaggatatgcttagcgtgtggaatcgggtttggatcgaagagaacccttggatggaagacaaaacacatgtgtccagctggggggatgtcccctatctgggaaagagagaggaccagtggtgcggctctctcattgggctgaccgcccgggccacatgggcttccaatatccaggtggccatcaaccaggtgagacgcctgattggcaatgagaactacctcgactacatgaccagcatgaaacggttcaagaatgaaggagatcccgagggcgcgctgtggtga

SEQ ID NO: 19086 - RNA, 9879 nt, synthetic construct
  misc_feature 1..9879: note = derived and/or modified CDS sequence (opt5) from DENV-1__FJ882570__SS-prME
  source 1..9879: mol_type = other RNA
agcgtgaccatgctgctcatgctgatgcccaccgcccttgctttccacctgacgacccggggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgggaagggagttacacagaacggccggctgatcacggctaatcccattgtgaccgacaaagaaaagcctgtcaacatcgaggccgaaccgccctttggggagagctatattgtgatcggagccggcgagaaagctcttaagctctcttggttcaagaaagggagctccattggcaagatgtttgaagccacagctagaggagcccgccggatggcgatcctgggcgataccgcctgggacttcgggtctatcggaggcgtgtttacaagcgttgggaaactggtccatcagattttcggaaccgcttacggcgtgctcttttccggggtgagctggacgatgaagatcggcattggagtcctgcttacctggctgggcctcaattctagatccacaagcctgtctatgacctgtatcgccgtggggctggttacactttacctcggagtgatggtccaggctgattccggctgcgtgattaactggaaagggcgcgagctgaagtgtggaagcggcatcttcgttaccaatgaagtgcacacatggaccgagcaatataagtttcaggccgactcccctaaacggctgtctgcggccattgggaaggcttgggaagagggcgtctgcggaatcagaagcgccacgcgcctcgagaacatcatgtggaaacagatttccaacgaactgaatcatatccttctggagaacggcatgaagttcacagtggttgtgggggacgtcgtggggattctcgctcagggcaaaaagatgatccggccgcaacccatggaacacaaatactcttggaaaagctgggggaaggccaagattatcggagccgatgtgcagaataccacctttatcattgacggccctaacacacccgagtgtcctgatgaccagagagcttggaatatctgggaagtcgaggattatggcttcgggatttttaccacgaacatctggctgaagctgcgcgactcctacacacaggtttgcgatcaccggcttatgagcgcggccattaaagactctaaggctgtgcatgccgatatgggatattggatcgagtccgagaaaaatgagacctggaagctcgccagagctagcttcatcgaagtgaagacatgtatttggcccaaatctcacaccctgtggtccaacggcgtcctggagagcgaaatgatcattccgaagatctacgggggacctatttctcaacataattatcgccccggctacttcacacagaccgccgggccttggcacctcggaaaactggagcttgactttgatctgtgcgagggcacgaccgtggttgtggacgaacactgcggcaaccgggggcccagcctcagaacaaccacagtcaccggaaagatcatccatgagtggtgttgccggtcctgtacgctgcctcccctgcgcttcaaaggcgaagatgggtgctggtacggaatggagattagaccggtgaaggagaaggaagagaatcttgttaaaagcatggtgtctgcgggctccggggaagtcgacagcttttccctcggactgctgtgtacatctatcatgattgaggaagtgatgcggagcagatggtcccgcaagatgctcatgaccggcacactggctgttttccttctgctcatcatgggccagctgacctggaacgacctgattcggctttgcatcatggtgggggccaatgcctctgatagaatgggaatgggcaccacatatctggctctcatggccacgtttaaaatgcgccctatgttcgcggtcgggctgctctttagacggctgaccagccgcgaggtgcttctgctcacaattggactgtccctggtggcttctgtcgagcttcccaacagcctggaagaactcggcgacgggctggccatgggaatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggcagcctcggctgcaaaccgctgacgatgtttcttattgctgaaaataagatctgggggagaaaatcttggcccctgaacgagggaattatggccgtcggcgtggtttccatcctcctgagctccctcctgaagaacgacgtgcctcttgcggggcccctgatcgccggaggcatgctgattgcttgttatgtcatcagcgggtctagcgccgatctctccctggaaaaagctgccgaggtgtcttgggaggaagaggccgaacacagcggagcttcccataatattttcgttgaggtgcaggacgatggcaccatgaagatcaaagacgaagaacgggatgacacacttaccattctgctcaaggcgacactgctcgccgtctctggcgtgtaccctctgagcatccccgctaccctttttgtctggtatttctggcaaaagaaaaagcagcgctccggggtgctgtgggatacgccttctcccccggaggttgaaagagccgccctggacgatggaatctaccggattatgcagcgcggcctcctggggagaagccaggtgggagtcggcgtgttccaagagaacgtttttcacaccatgtggcacgtgacaagaggggctgtccttatgtatcagggaaaacgcctggaaccttcctgggccagcgtgaagaaagacctcatctcttacggcggcgggtggagactgcagggatcctggaataccggcgaggaggtgcaggttattgcggtcgaacccgggaagaaccctaagaatgtgcaaacagctcccggaaccttcaaaacaccggagggcgaagtgggggccatcgccctcgactttaagcctggaacgagcggctctcccattgtcaaccgggagggcaaaatcgtggggctgtacggaaatggcgttgtgaccacatccgggacctatgtcagcgctattgcccaggcgaaggcttcccaggaaggacctcttcccgagatcgaggatgaagtgttcagaaaacgcaacctgaccatcatggacctgcatcccggctctgggaagacacggagatacctccctgccattgttcgcgaggccatcaagcggaaactgagaacgcttattctggctccgacccgcgtggtcgccagcgaaatggctgaggccctcaagggcatgcccatccggtatcaaacaaccgcggtgaaatccgaacacacaggaaaggagattgttgatctgatgtgccatgccacctttacgatgagactgctcagccctgtgcgcgtccccaattacaacatgatcatcatggacgaggctcacttcacagatccttcttccattgccgctcggggctatatcagcaccagagtggggatgggagaagccgccgctatttttatgaccgcgacaccccctggctctgtggaggccttcccgcagagcaatgctgtcatccaggacgaggaacgggatattcccgaacgctcctggaactctgggtacgagtggatcaccgactttcctggaaaaacagtttggttcgtgcccagcatcaagtccggcaatgatattgccaactgtcttagaaagaatgggaaacgggtgatccagctgtctcgcaagacctttgacacggagtatcagaaaaccaagaacaacgattgggactacgtcgtgaccacagacattagcgaaatgggcgccaatttcagagctgatcgggttatcgaccctagacgctgcctgaaacccgtgattctcaaggatggaccggagcgggtcatcctggccggccctatgcccgtgaccgttgcgtccgctgcccagagacgcgggcggattggaagaaaccataataaggaaggcgaccagtacatctatatggggcagccccttaacaatgatgaggaccacgcccactggacggaggctaaaatgctgctcgataacatcaatacccctgaaggaattatccccgccctgttcgagcctgaacgcgaaaagagcgcggccattgacggcgaataccggctgagaggggaggctcgcaaaacatttgtggagctcatgagacggggcgatcttccggtctggctgtcttataaggtggcctccgaaggattccaatacagcgaccgcagatggtgctttgatggcgagcggaacaatcaggtcctggaagagaacatggacgtggaaatctggaccaaagagggggagcgcaagaaactcagaccccggtggctggatgctagaacatattccgaccctcttgccctgcgcgagttcaaggagtttgctgccggacggagatctgttagcggcgacctcattctggaaatcgggaagctgccccagcatctcacccagcgcgcgcaaaatgcccttgataacctggtgatgctgcacaattccgagcagggaggccgggcttacagacatgccatggaggaactccctgacacaatcgagaccctgatgcttctggctctcattgccgtgctgacgggcggggtcacactgttctttctctctggacggggccttgggaaaaccagcatcggactgctgtgtgttatggcctccagcgtgctcctgtggatggcttctgtggaaccccactggattgcggcctccatcattcttgagttctttctgatggtcctcctgatcccggaacctgatcgccagagaacaccccaggacaaccaactggcttatgtggttatcggcctccttttcattatcctgacagtggccgccaatgagatggggctgctcgagaccacaaagaaagatctgggaattggccacgtcgctgtggaaaaccatcaccatgccacgatgcttgacgtcgatctgcaccctgcgagcgcctggaccctctacgctgtggccacaaccatcattacacccatgatgcggcataccatcgagaacacgaccgctaatatttctctgacagccatcgcgaaccaggccgctatcctgatgggcctcgacaaggggtggcctatttccaaaatggatatcggagttccccttctggccctgggctgctacagccaggtgaatccgctcaccctgacagctgccgtccttatgctggtggctcactatgccattatcgggcctggactccaagcgaaggccacccgcgaagctcagaagagaacggccgctggcattatgaaaaaccccacagttgacgggatcgtggccatcgatctggaccccgtcgtgtacgatgccaagtttgagaaacagctgggacagattatgctccttatcctgtgtacctctcaaattctgctcatgcggacaacctgggcgctgtgcgaaagcatcacccttgctacaggccctctgacgaccctctgggagggctccccggggaagttctggaatacaaccattgccgtgtctatggctaacatctttcgcggaagctatctggccggcgccgggctggctttctccctcatgaaaagccttggaggcgggagacggggaacaggcgcccagggcgagaccctgggggaaaagtggaagcgccagctgaatcagctctccaaatctgagttcaacatctacaagagaagcggaattatggaagttgaccggtccgaggcgaaagaaggcctgaagagaggggagacgacacgccacgccgtctctcggggaaccgctaaacttagatggtttgtggagcgcaatctggtgaagcccgaaggcaaggtcatcgacctcgggtgtggacggggcggctggagctattactgcgccgggctgaaaaaggttaccgaggtgaaaggatatacaaagggcgggcctggacatgaggaacccattcctatggctacctacggctggaacctggtgaaactccactccgggaaggatgtcttctttacaccccctgaaaaatgtgacacgcttctgtgcgatatcggagagtctagcccgaatcccaccattgaggaaggcagaacactgcgcgtgctcaagatggttgagccttggctgcggggcaaccaattctgtatcaagattcttaatccctacatgccttccgtggtcgaaaccctggagcagatgcagagaaaacatgggggaatgctcgtgcgcaaccccctgagcagaaattctacacacgagatgtattgggtttcctgcggcaccgggaacatcgtgagcgccgtcaatatgacgtctagaatgctgctcaaccgctttaccatggcgcaccggaagccgacatacgaaagagacgtggatctgggagccggcacccgccatgtggctgtcgagcctgaagttgccaaccttgacatcattgggcagagaatcgagaatattaaacacgaacataagtccacatggcactatgatgaggacaacccctacaaaacctgggcttatcatggaagctacgaggtgaagccctctggctccgccagctccatggtgaatggcgtcgtgaagctgctcacaaaaccttgggatgttatccccatggtgacccaaattgctatgacggacacaacccctttcgggcagcagcgggtctttaaggaaaaagtggatacccgcacaccgaaggccaaaagaggaacggcgcaaatcatggaggttaccgcccggtggctgtggggcttccttagcagaaacaagaagccccggatctgtacacgcgaagagtttaccagaaaagtgcggtctaatgctgccattggggctgtcttcgtggacgaaaaccagtggaatagcgccaaggaggccgttgaggacgaacgcttttgggatctggtgcagaaagagagagaactccacaagcagggaaaatgcgcgacatgcgtctataacatgatgggcaagcgggagaagaaactgggggagttcggcaaggctaaaggatcccgcgccatctggtacatgtggctgggcgccagatttctcgagttcgaggctctggggttcatgaatgaagaccactggttttctcgggagaacagcctttccggagtggaaggcgaggggctgcataagctcggatacattctgcgcgatatctctaaaattcctggcgggaatatgtatgccgacgataccgctggctgggacacaagaatcaccgaggatgaccttcaaaacgaagccaagatcacggatattatggagcccgaacacgcgctgctcgccaccagcatcttcaaactgacataccagaataaggtcgtgcgggttcagcgccctgctaagaacggaaccgtgatggacgtcatttccagacgggatcagcgcggctctgggcaagtgggaacatatggcctgaatacctttacgaacatggaggcccagctcatcagacagatggaaagcgaggggattttcctgccctccgagcttgaaacaccgaacctggctgagcgggtgctcgactggctggaaaaatacggagttgagagacttaagcgcatggccatcagcggcgatgactgtgtggtcaaacctatcgacgatcggtttgcgaccgccctgacagctctcaatgacatggggaaggtgagaaaagatattccccagtgggaaccttctaagggctggaacgactggcaacaggttcccttctgctcccatcactttcaccagctgatcatgaaggatggacgcgagattgtggtcccttgtcggaatcaggacgagctggtgggcagagcccgcgtcagccaaggggctggatggtctctccgggaaaccgcctgcctgggcaaatcctatgctcagatgtggcagcttatgtacttccatagacgcgatctgcggctcgccgcgaacgccatctgtagcgctgtgcccgttgactgggtgccgacgtccagaaccacatggtctattcacgcccatcaccaatggatgaccacagaggatatgctgagcgtctggaatcgcgtgtggatcgaagagaacccttggatggaagacaagacccatgtttccagctggggagatgtgccctatcttggaaaacgggaggaccagtggtgcggctctctgattgggctcacagccagagctacctgggcctccaatatccaggtcgcgatcaaccaggtgcggagactgattggcaatgagaactacctggactacatgacgagcatgaagcgctttaaaaatgaaggagatcccgagggcgctctctggtga

SEQ ID NO: 19087 - RNA, 9879 nt, synthetic construct
  misc_feature 1..9879: note = derived and/or modified CDS sequence (opt5) from DENV-1__GQ199834__SS-prME
  source 1..9879: mol_type = other RNA
agcgtgaccatgctgctgatgctgatgcccaccgcccttgctttccacctgacgacccggggaggggaacctcatatgatcgtgaccaagcaggaacggggaaagtccctgctgtttaagacctctgccggcgttaacatgtgcacccttattgccatggacctgggggaactttgtgaagataccatgacatacaagtgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaactggccgagacccagcacggaaccgtgctggtccagattaagtacgagggcacagacgcgccgtgcaaaatccctttctccacccaagatgaaaagggggtgacacagaacggacggcttatcacggctaatcccattgttaccgacaaagagaagcctgtgaacatcgaagccgagccgccctttggcgagagctatattgtcatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgtgggcaaactcgttcatcagattttcgggaccgcttacggagtcctgttttccggcgtgagctggacgatgaagatcgggattggcgtgcttctgacctggctcggactcaattctagatccacaagcctgtctatgacctgtatcgccgtcggccttgtgacactctacctgggggttatggtgcaggctgattccggatgcgtcattaactggaaaggccgcgaactgaagtgtgggagcggaatcttcgtgaccaatgaggttcacacatggaccgaacaatataagtttcaggccgactcccctaaacggctctctgcggccattggcaaggcttgggaggagggggtgtgcggcatcagaagcgccacgcgcctggaaaacatcatgtggaaacagatttccaacgagcttaatcatatcctgctcgaaaacggaatgaagttcacagtcgtggttggcgacgtggatgggattctggctcagggcaagaagatgatccggccgcaacccatggagcacaaatactcttggaaaagctggggcaaggccaagattatcggggccgacgtccagaataccacctttatcattgatggacctaacacacccgaatgtcctgacgatcagagagcttggaatatctgggaggtggaggactatggcttcggcatttttaccacgaacatctggctgaaacttcgcgattcctacacacaggtgtgcgaccaccggctcatgagcgcggccattaaagattctaaggctgtccatgccgacatggggtattggatcgaatccgagaaaaatgaaacctggaagctggccagagctagcttcatcgaggttaagacatgtatttggcccaaatctcacaccctgtggtccaacggagtgctcgaaagcgagatgatcattccgaagatctacggcgggcctatttctcaacataattatcgccccggatacttcacacagaccgccggcccttggcacctggggaaacttgagctggattttgacctctgcgaaggaacgaccgtggtcgtggatgagcactgcggcaaccggggccccagcctgagaacaaccacagttaccgggaagatcatccatgaatggtgttgccggtcctgtacgctgcctccccttcgcttcaaaggagaggacggctgctggtacgggatggagattagaccggtgaaggaaaaggaggaaaatctcgtcaaaagcatggtgtctgcgggatccggcgaggttgacagcttttccctggggctgctctgtatctctattatgatcgaagaggtgatgcggagcagatggtcccgcaagatgctgatgacaggaacccttgctgtcttcctgctcctgattatgggccagctgacatggaacgatcttatccggctgtgcattatggtgggcgccaatgcctctgacagaatggggatgggaaccacctatctcgctctgatggccacatttaaaatgcgccctatgttcgcggttggcctcctgtttagacggcttacgagccgcgaggtgctgctcctgaccatcgggctgtcccttgtcgcttctgtggaactgcccaacagcctcgaggaactgggagatggcctcgccatggggatcatgattctgaaacttctgacagacttccaatcccaccagctctgggccaccctgctgagccttacatttatcaaaaccacgctgtctctccattacgcttggaagacaatggccatggtgctgtccattgtcagcctcttccccctgtgtctttctaccacctcccagaagacaacctggctgcctgttctgctcggaagcctgggctgcaaaccgcttacaatgtttctgatcgctgagaataagatttggggcagaaaatcttggcccctcaacgaagggatcatggccgtgggagtggtctccatcctgctcagctccctgcttaagaacgatgtgcctctggcgggccccctgattgccgggggaatgctcatcgcttgttatgttattagcggctctagcgccgacctgtcccttgagaaagctgccgaggtgtcttgggaagaggaagccgagcacagcggggcttcccataatatcctggtcgaagtgcaggatgacggaacgatgaagattaaagatgaggagcgggacgataccctcacaatcctgctcaaggcgaccctgcttgccgtttctggcgtgtaccctctgagcatccccgctacactgttcgtctggtatttttggcaaaagaaaaagcagcgctccggcgtgctctgggacaccccttctcccccggaagtcgagagagccgtgctggatgacgggatttaccggatcatgcagcgcggacttctgggcagaagccaggttggggtgggagtcttccaagaaaacgtgttccacacgatgtggcacgttacccggggcgccgtgctcatgtatcaggggaaacgcctggagccttcctgggctagcgtcaagaaagacctcatttcttacggaggcggctggagactgcaggggtcctggaatacaggagaggaagtccaggtgatcgccgttgagcccggcaagaaccctaagaatgtccaaaccgcgcccgggacatttaaaaccccggaaggagaggtgggcgctattgcccttgatttcaagcctgggacaagcggatctcccatcgtgaaccgggaaggcaaaattgtcggcctgtacgggaatggagtggttacgacctccggcacatatgtgagcgccatcgctcaggccaaggcgtcccaggaggggcctctgcccgagatcgaagacgaggtctttagaaaacgcaacctcaccattatggatctgcatcccggatctggcaagacccggagataccttcctgctatcgtgcgcgaagccattaagcggaaactgagaacactcatcctggccccgacgcgcgttgtggctagcgagatggccgaagctctgaaggggatgcccattcggtatcaaaccacagccgtcaaatccgagcacaccggcaaggagatcgtggacctcatgtgccatgcgacattcaccatgagacttctgagccctgttcgcgtgcccaattacaacatgatcattatggatgaagcccactttacggacccttcttccatcgctgcccggggatatattagcacaagagtcggcatgggggaggctgccgccatcttcatgaccgctacaccccctggatctgtggaagcgtttccgcagagcaatgccgtgattcaggatgaggaacgggacatccccgagcgctcctggaactctggctacgagtggatcacagatttccctgggaaaaccgtctggtttgttcccagcattaagtccggaaatgacatcgctaactgtctgagaaagaatggcaaacgggtgattcagctctctcgcaagacattcgataccgaatatcagaagacgaagaacaacgactgggactacgtggtcacaaccgatatcagcgagatgggggccaattttagagccgaccgggtgattgatcctagacgctgcctgaaacccgttatccttaaggacggcccggaacgggtgattctggctggacctatgcccgtcacagtggcctccgcggctcagagacgcggccggatcgggagaaaccataataaggagggagatcagtacatctatatgggccagcccctcaacaatgacgaggatcacgcccactggaccgaagccaaaatgctgctggacaacattaatacgcctgaggggatcattcccgctctcttcgaacctgagcgcgaaaagagcgccgcgatcgatggagagtaccggcttagaggcgaggcccgcaaaaccttcgttgaactgatgagaagaggggacctgccggtgtggctctcttataaggtcgcttccgagggctttcaatacagcgatcgcagatggtgcttcgacggagaacggaacaatcaggtgctggaggaaaacatggatgtcgagatttggacaaaagagggcgaacgcaagaaacttagaccccggtggctggacgccagaacctattccgaccctctcgctctgcgcgagtttaaggagttcgccgctgggcggagatctgtgagcggagatctgatcctcgagatcggcaaacttccccagcatctgacacagcgcgcccaaaatgcgctggacaacctcgttatgctgcacaattccgaacaagggggacgggcctacagacatgctatggaggagcttcctgataccattgaaacactgatgctcctggccctgatcgctgtgctcaccggcggcgtgacgctctttttcctgtctgggcggggactgggcaaaacaagcattgggctcctgtgtgtcatggcctccagcgttcttctgtggatggcctctgtggagccccactggatcgctgcgtccattatcctcgaatttttcctgatggtgctgctcatcccggagcctgaccgccagagaacaccccaggataaccaacttgcctatgtcgtgattggactgctgtttatgatcctcaccgttgctgccaatgagatgggcctgcttgaaacaaccaagaaagacctggggattggacacgtggccgtcgagaaccatcaccatgctacaatgctcgatgtggacctgcaccctgccagcgcgtggacgctgtacgccgtcgctaccacaatcattacccccatgatgcggcatacaatcgaaaacaccacggccaatatttctctcaccgctatcgccaaccaggcggccatccttatgggcctggataagggctggcctatttccaaaatggacatcggggtgcccctgctcgctctgggatgctacagccaggttaatccgcttacactgaccgccgctgtgctcatgctggtcgcccactatgctattatcggccctgggctgcaagccaaggcgacacgcgaggcccagaagagaaccgctgccggaattatgaaaaaccccacggtggatggcatcgttgctatcgacctcgatcccgtggtctacgacgccaagttcgaaaaacagcttgggcagattatgctgctgatcctctgtacatctcaaattctgcttatgcggaccacatgggccctgtgcgagagcatcaccctcgcgaccggacctctgacaacgctgtgggagggctccccgggcaagttttggaataccacaattgctgtgtctatggccaacatcttccgcgggagctatctcgctggagccggccttgccttttccctgatgaaaagcctcgggggaggcagacgggggaccggagctcagggcgaaacactcggcgagaagtggaagcgccagctgaatcagctttccaaatctgagttcaacatctacaagagaagcgggattatggaggtggaccggtccgaagccaaagagggactgaagagaggcgagaccacgcgccacgcggtttctcgggggacagccaaactcagatggttcgtcgaacgcaatctggtgaagcccgagggaaaggtgatcgatctgggctgtgggcggggaggctggagctattactgcgctggcctcaaaaaggtcaccgaagttaaagggtataccaagggaggccctgggcatgaggaacccattcctatggccacatacggatggaaccttgtgaaactgcactccggcaaggacgtgtttttcacaccccctgagaaatgtgataccctgctctgcgacatcggggagtctagcccgaatcccacgattgaagagggaagaaccctgcgcgtccttaagatggtggaaccttggctgcggggcaaccaattttgtatcaagattctcaatccctacatgccttccgttgtggagacactggagcagatgcagagaaaacatggcgggatgctggtccgcaaccccctcagcagaaattctacccacgaaatgtattgggtgtcctgcggaacaggcaacatcgttagcgctgtgaatatgacctctagaatgctgcttaaccgcttcacgatggcccaccggaagccgacctacgagagagatgtcgacctgggggcgggaacacgccatgtggccgtggaacctgaggtcgctaacctcgatatcattggccagagaatcgaaaatattaaacacgagcataagtccacctggcactatgacgaggataacccctacaaaacatgggcctatcatgggagctacgaagttaagccctctggatccgctagctccatggtgaatggcgtggtcaagctgcttaccaaaccttgggacgtgatccccatggttacacaaattgccatgaccgatacgacaccttttggccagcagcgggtgttcaaggagaaagtcgacacccgcaccccgaaggctaaaagagggacagcccaaatcatggaagtgacggcgcggtggctgtggggatttctcagcagaaacaagaagccccggatctgtacccgcgaggagttcacaagaaaagttcggtctaatgccgctattggcgccgtgtttgtcgacgagaaccagtggaatagcgctaaggaggccgtggaagatgagcgcttctgggacctggttcagaaagaaagagagctgcacaagcaggggaaatgcgcgacctgcgtgtataacatgatgggaaagcgggaaaagaaactcggcgagtttgggaaggcgaaaggctcccgcgctatctggtacatgtggctgggagccagattccttgagtttgaagccctgggcttcatgaatgaggatcactggttctctcgggaaaacagcctctccggggtcgagggagagggcctgcataaacttgggtacattctgcgcgacatctctaaaattcctggaggcaatatgtatgctgatgacacagccgggtgggataccagaatcacagaagacgatctccaaaacgaggctaagatcaccgacattatggaacccgagcacgccctgctggcgacgagcatctttaaactcacctaccagaataaggtggtccgggtgcagcgccctgccaagaacggcacagttatggatgtgatttccagacgggaccagcgcggatctggccaagtcgggacctatggactgaatacattcaccaacatggaagctcagcttatcagacagatggagagcgagggcatttttctgccctccgaactcgagacgccgaacctggccgaacgggtgcttgattggctggagaaatacggggtggaaagactcaagcgcatggctatcagcggagacgactgtgttgtgaaacctatcgatgaccggttcgccacagcgctgaccgccctgaatgatatgggcaaggtcagaaaagacattccccagtgggagccttctaaggggtggaacgattggcaacaggtgcccttttgctcccatcacttccaccagctcatcatgaaggacggccgcgagattgttgtgccttgtcggaatcaggatgaactggtcggacgggctcgcgtgagccaaggcgccgggtggtctcttcgggagacagcttgcctgggaaaatcctatgcccagatgtggcagctcatgtactttcatagacgcgacctgcggcttgctgccaacgcgatctgtagcgccgtccccgtggattgggttccgacctccagaacgacctggtctattcacgctcatcaccaatggatgacaaccgaagacatgctgagcgtgtggaatcgcgtctggatcgaggaaaacccttggatggaggataagacacatgtgtccagctggggcgacgttccctatctcgggaaacgggaggaccagtggtgcggatctctgattggcctgaccgccagagccacatgggcttccaatatccaggtggccatcaaccaggtccggagactcattgggaatgaaaactacctggattacatgaccagcatgaagcgcttcaaaaatgagggcgaccccgaaggagcgctttggtga

SEQ ID NO: 19088 - RNA, 9879 nt, synthetic construct
  misc_feature 1..9879: note = derived and/or modified CDS sequence (opt5) from DENV-1__GQ199835__SS-prME
  source 1..9879: mol_type = other RNA
agcgtgaccatgctgctcatgctgatgcccaccgcccttgctttccacctgacgacccggggcggggaacctcatatgatcgtcacaaagcaggaacggggaaagtccctcctgtttaagacctctgccggcgttaacatgtgcacacttattgcgatggacctgggggagctctgtgaagataccatgacatacaagtgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctgacactcatggctacgtttaaaatgcgccctatgttcgccgtcggactgctcctgagacggcttaccagccgcgaggtgctgctcctgacaatcggcctgtcccttgtggcgtctgtcgaactgcccaacagcctcgaggaactgggggatggactcgctatgggcatcatgattctgaaacttctgaccgactttcaatcccaccagctctgggccacactgctgagccttaccttcatcaaaacgacactgtctctccattacgcctggaagaccatggctatggttctgtccattgtgagcctctttcccctgtgtctttctaccacatcccagaagaccacatggctgcctgtgctgctcgggagcctgggatgcaaaccgcttacgatgttcctgatcgccgagaataagatttggggcagaaaatcttggcccctcaacgaaggcatcatggctgtcggggtggtttccatcctgctcagctccctgcttaagaacgatgtgcctctggccggacccctgattgcgggcgggatgctcatcgcctgttatgtcattagcggatctagcgctgacctgtcccttgagaaagccgctgaggtgtcttgggaagaggaagccgagcacagcggcgcctcccataatatcctggttgaagtgcaggatgacgggaccatgaagattaaagatgaggagcgggacgatacactcaccatcctgctcaaggctacactgcttgcggtctctggagtgtaccctctgagcatccccgccaccctgtttgtctggtatttctggcaaaagaaaaagcagcgctccggcgtgctctgggacacgccttctcccccggaagttgagagagctgtgctggatgacggcatttaccggatcatgcagcgcgggcttctgggaagaagccaggtcggcgtgggggtttttcaagaaaacgtgttccacaccatgtggcacgtcacacggggagccgtgctcatgtatcagggcaaacgcctggagccttcctgggccagcgtgaagaaagacctcatttcttacgggggaggctggagactgcagggctcctggaataccggggaggaagttcaggtcatcgctgtggagcccggaaagaaccctaagaatgtgcaaacagcccccggcaccttcaaaacaccggaaggggaggtcggagcgattgctcttgattttaagcctggcacgagcgggtctcccatcgtgaaccgggaaggaaaaattgttggcctgtacggcaatggggtggtcaccacatccggaacctatgtgagcgccatcgcccaggctaaggcctcccaggagggccctctgcccgagatcgaagacgaggttttcagaaaacgcaacctcaccattatggatctgcatcccgggtctggaaagacacggagataccttcctgcgatcgtgcgcgaagctattaagcggaaactgagaacgctcatcctggccccgacccgcgtcgtggccagcgagatggctgaagccctgaagggcatgcccattcggtatcaaacaaccgctgttaaatccgagcacacagggaaggagatcgtggacctcatgtgccatgccacctttacgatgagacttctgagccctgtccgcgtgcccaattacaacatgatcattatggatgaagcgcacttcacagacccttcttccatcgccgctcggggctatattagcaccagagtgggaatgggcgaggccgctgccatctttatgaccgccacaccccctgggtctgtcgaggctttcccgcagagcaatgcggttattcaggatgaggaacgggacatccccgagcgctcctggaactctggatacgagtggatcaccgattttcctggcaaaacagtgtggttcgtgcccagcattaagtccgggaatgacatcgccaactgtctgagaaagaatggaaaacgggtcattcagctctctcgcaagacctttgatacggaatatcagaagaccaagaacaacgactgggactacgtggttaccacagatatcagcgagatgggcgctaatttcagagccgaccgggtgattgatcctagacgctgcctgaaacccgtcatccttaaggacgggccggaacgggtgattctggccggccctatgcccgttaccgtggcttccgccgcgcagagacgcggacggatcggcagaaaccataataaggagggggatcagtacatctatatgggacagcccctcaacaatgacgaggatcacgctcactggacggaagccaaaatgctgctggacaacattaatacccctgagggcatcattcccgccctctttgaacctgagcgcgaaaagagcgctgccatcgatggggagtaccggcttagaggagaggcgcgcaaaacattcgtcgaactgatgagacggggcgacctgccggtgtggctctcttataaggtcgcctccgaggggttccaatacagcgatcgcagatggtgctttgacggcgaacggaacaatcaggtgctggaggaaaacatggatgttgagatttggaccaaagagggagaacgcaagaaacttagaccccggtggctggacgctagaacatattccgaccctctcgccctgcgcgagttcaaggaatttgctgccggccggagatctgtgagcggggatctgatcctcgagatcggaaaacttccccagcatctgacccagcgcgctcaaaatgccctggacaacctcgtgatgctgcacaattccgaacagggcgggcgggcgtacagacatgccatggaggagcttcctgatacaattgaaaccctgatgctcctggctctgatcgccgtcctcacgggaggcgttacacttttctttctgtctggccgggggctgggaaaaaccagcattggcctcctgtgtgtgatggcttccagcgtgcttctgtggatggcctctgtcgagccccactggatcgccgcttccattatcctcgagttctttctgatggtgctgctcatcccggagcctgaccgccagagaacaccccaggataaccaacttgcgtatgttgtgattgggctgctgttcatgatcctcacagtcgccgctaatgagatgggactgcttgaaaccacaaagaaagacctgggcattgggcacgtggccgtcgagaaccatcaccatgccacgatgctcgatgtggacctgcaccctgctagcgcctggaccctgtacgcggttgccacaaccatcattacacccatgatgcggcataccatcgaaaacacgaccgctaatatttctctcacagccatcgctaaccaggccgcgatccttatgggactggataagggctggcctatttccaaaatggacatcggcgtgcccctgctcgccctggggtgctacagccaggtcaatccgcttaccctgacagctgccgtgctcatgctggttgctcactatgccattatcggacctggcctgcaagctaaggccacccgcgaggcgcagaagagaacggccgctgggattatgaaaaaccccacagtggatggaatcgtcgccatcgacctcgatcccgtggtgtacgacgctaagtttgaaaaacagcttggccagattatgctgctgatcctctgtacctctcaaattctgcttatgcggacaacctgggccctgtgcgagagcatcaccctcgccacagggcctctgacgaccctgtgggagggatccccgggcaagttctggaatacaaccattgcggtttctatggctaacatctttcgcggcagctatctcgccggggctggacttgccttctccctgatgaaaagcctgggcgggggaagacggggcacaggggcccagggagaaaccctcggcgagaagtggaagcgccagctgaatcagctttccaaatctgaatttaacatctacaagagaagcggcattatggaggtcgaccggtccgaagctaaagaggggctgaagagaggagagacgacacgccacgccgtgtctcggggcaccgcgaaactcagatggttcgtggaacgcaatctggtcaagcccgaggggaaggttatcgatctgggatgtggcagagggggatggagctattactgcgccggcctcaaaaaggtgaccgaagtgaaaggctatacaaaagggggacctggccatgaggaacccattcctatggctacctacgggtggaaccttgtcaaactgcactccggaaaggacgtgttctttacaccccctgagaaatgtgatacgctgctctgcgacatcggcgagtctagcccgaatcccaccattgaagaggggagaacactgcgcgttcttaagatggtggaaccttggctgcggggaaaccaattctgtatcaagattctcaatccctacatgccttccgtcgtggagaccctggagcagatgcagagaaaacatggcggcatgctggttcgcaaccccctcagcagaaattctacacacgaaatgtattgggtgtcctgcgggaccggaaacatcgtcagcgccgtgaatatgacgtctagaatgctgcttaaccgctttaccatggctcaccggaagccgacatacgagagagatgtggacctgggcgccgggacccgccatgtcgcggttgaacctgaggtggccaacctcgatatcattggacagagaatcgaaaatattaaacacgagcataagtccacatggcactatgacgaggataacccctacaaaacctgggcttatcatggcagctacgaagtgaagccctctgggtccgccagctccatggtcaatggagtggttaagctgcttacaaaaccttgggacgtgatccccatggtcacccaaattgctatgacggatacaacccctttcggccagcagcgggtgtttaaggagaaagttgacacccgcacaccgaaggccaaaagaggcacggctcaaatcatggaagtgaccgcccggtggctgtgggggttcctcagcagaaacaagaagccccggatctgtacacgcgaggaatttaccagaaaagtccggtctaatgcggccattggagctgtgttcgttgacgagaaccagtggaatagcgccaaggaggctgtggaagatgagcgcttttgggacctggtccagaaagaaagagagctgcacaagcagggcaaatgcgccacatgcgtgtataacatgatggggaagcgggaaaagaaactcggagagttcggcaaggccaaagggtcccgcgcgatctggtacatgtggctgggcgctagatttcttgagttcgaagccctgggatttatgaatgaggatcactggttctctcgggaaaacagcctctccggcgtcgagggggagggactgcataaacttggctacattctgcgcgacatctctaaaattcctgggggaaatatgtatgccgatgacaccgctggctgggatacaagaatcaccgaagacgatctccaaaacgaggccaagatcacggacattatggaacccgagcacgctctgctggccaccagcatcttcaaactcacataccagaataaggtggttcgggtgcagcgccctgcgaagaacgggaccgtcatggatgtgatttccagacgggaccagcgcggctctggacaagtgggcacatatgggctgaatacctttacgaacatggaagcccagcttatcagacagatggagagcgagggaattttcctgccctccgaactcgagacaccgaacctggctgaacgggttcttgattggctggagaaatacggcgtggaaagactcaagcgcatggccatcagcggggacgactgtgtcgtgaaacctatcgatgaccggtttgctaccgccctgacagcgctgaatgatatgggaaaggttagaaaagacattccccagtgggagccttctaagggctggaacgattggcaacaggtgcccttctgctcccatcactttcaccagctcatcatgaaggacgggcgcgagattgtcgtgccttgtcggaatcaggatgaactggtcggcagagcccgcgtgagccaaggagctggctggtctcttcgggagaccgcctgcctggggaaatcctatgctcagatgtggcagctcatgtacttccatagacgcgacctgcggcttgccgctaacgccatctgtagcgcggttcccgtggattgggtcccgacgtccagaaccacatggtctattcacgcccatcaccaatggatgaccacagaagacatgctgagcgtgtggaatcgcgtttggatcgaggaaaacccttggatggaggataagacccatgtgtccagctggggagacgtcccctatctcggcaaacgggaggaccagtggtgcgggtctctgattggactgacagctagagccacctgggcctccaatatccaggtggctatcaaccaggtgcggagactcattggcaatgaaaactacctggattacatgacgagcatgaagcgctttaaaaatgagggggaccccgaaggcgccctttggtga

SEQ ID NO: 19089 - RNA, 9879 nt, synthetic construct
  misc_feature 1..9879: note = derived and/or modified CDS sequence (opt5) from DENV-1__FJ898386__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtaccctcttagcatccccgctacactgttcgtctggtatttttggcaaaagaaaaagcagcgctccggcgtgctgtgggacaccccttctcccccggaagttgagagagccgtgctcgatgacggcatttaccggatcatgcagcgcgggctgcttggaagaagccaggtcggcgtgggggttttccaagaaaacgtgttccacacgatgtggcacgtcacccggggagccgtgctgatgtatcagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacatttaaaaccccggaaggggaggtcggagctattgccctggatttcaagcctggcacaagcgggtctcccatcgtgaaccgggaaggaaaaattgttggcctttacggcaatggggtggtcacgacctccggaacatatgtgagcgccatcgctcaggccaaggcgtcccaggagggccctctgcccgagatcgaagacgaggtttttagaaaacgcaacctgaccattatggatctccatcccgggtctggaaagacccggagatacctgcctgctatcgtgcgcgaagccattaagcggaaacttagaacactgatcctcgccccgacgcgcgtcgtggctagcgagatggccgaagctctgaagggcatgcccattcggtatcaaaccacagccgttaaatccgagcacaccgggaaggagatcgtggacctgatgtgccatgcgacattcaccatgagactccttagccctgtccgcgtgcccaattacaacatgatcattatggatgaagcccactttacggacccttcttccatcgctgcccggggctatattagcacaagagtgggaatgggcgaggctgccgccatcttcatgaccgctacaccccctgggtctgtcgaagcgtttccgcagagcaatgccgttattcaggatgaggaacgggacatccccgagcgctcctggaactctggatacgagtggatcacagatttccctggcaaaaccgtgtggtttgtgcccagcattaagtccgggaatgacatcgctaactgtctgagaaagaatggaaaacgggtcattcagctgtctcgcaagacattcgataccgaatatcagaagacgaagaacaacgactgggactacgtggttacaaccgatatcagcgagatgggcgccaattttagagccgaccgggtgattgatcctagacgctgcctcaaacccgtcatcctgaaggacgggccggaacgggtgattcttgctggccctatgcccgttacagtggcctccgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagagcgccgcgatcgatggggagtaccggctcagaggagaggcccgcaaaaccttcgtcgaacttatgagacggggcgacctgccggtgtggctgtcttataaggtcgcttccgaggggtttcaatacagcgatcgcagatggtgcttcgacggcgaacggaacaatcaggtgctcgaggaaaacatggatgttgagatttggacaaaagagggagaacgcaagaaactgagaccccggtggcttgacgccagaacctattccgaccctctggctctccgcgagtttaaggagttcgccgctggccggagatctgtgagcggggatctgatcctggagatcggaaagctcccccagcatcttacacagcgcgcccaaaatgcgctggacaacctggtgatgctccacaattccgaacagggcgggcgggcctacagacatgctatggaggagctgcctgataccattgaaacacttatgctgctcgccctgatcgctgtcctgaccggaggcgttacgctctttttcctttctggccgggggctgggaaaaacaagcattggcctgctctgtgtgatggcctccagcgtgctgctttggatggcctctgtcgagccccactggatcgctgcgtccattatcctggaatttttcctcatggtgctgctgatcccggagcctgaccgccagagaacaccccaggataaccaactcgcctatgttgtgattgggcttctgtttatgatcctgaccgtcgctgccaatgagatgggactcctggaaacaaccaagaaagaccttggcattgggcacgtggccgtcgagaaccatcaccatgctacaatgctggatgtggacctccaccctgccagcgcgtggacgctgtacgccgttgctaccacaatcattacccccatgatgcggcatacaatcgaaaacaccacggccaatatttctctgaccgctatcgccaaccaggcggccatcctcatgggacttgataagggctggcctatttccaaaatggacatcggcgtgcccctgctggctctcgggtgctacagccaggtcaatccgctgacacttaccgccgctgtgctgatgctcgttgcccactatgctattatcggacctggcctgcaagccaaggcgacacgcgaggcccagaagagaaccgctgccgggattatgaaaaaccccacggtggatggaatcgtcgctatcgacctggatcccgtggtgtacgacgccaagttcgaaaaacagctcggccagattatgcttctgatcctgtgtacatctcaaattctcctgatgcggaccacatgggccctttgcgagagcatcaccctggcgaccgggcctctcacaacgctgtgggagggatccccgggcaagttttggaataccacaattgctgtttctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcattatggaggtcgaccggtccgaagccaaagaggggcttaagagaggagagaccacgcgccacgcggtgtctcggggcacagccaaactgagatggttcgtggaacgcaatctcgtcaagcccgaggggaaggttatcgatctgggatgtggcagagggggatggagctattactgcgctggcctgaaaaaggtgaccgaagtgaaaggctataccaaagggggacctggccatgaggaacccattcctatggccacatacgggtggaacctcgtcaaacttcactccggaaaggacgtgtttttcacaccccctgagaaatgtgatacactgctgtgcgacatcggcgagtctagcccgaatcccacgattgaagaggggagaaccctccgcgttctgaagatggtggaaccttggcttcggggaaaccaattttgtatcaagattctgaatccctacatgccttccgtcgtggagacactcgagcagatgcagagaaaacatggcggcatgctggttcgcaaccccctgagcagaaattctacccacgaaatgtattgggtgtcctgcgggacaggaaacatcgtcagcgctgtgaatatgacctctagaatgctcctgaaccgcttcacgatggcccaccggaagccgacctacgagagagatgtggaccttggcgcggggacacgccatgtcgccgttgaacctgaggtggctaacctggatatcattggacagagaatcgaaaatattaaacacgagcataagtccacctggcactatgacgaggataacccctacaaaacatgggcctatcatggcagctacgaagtgaagccctctgggtccgctagctccatggtcaatggagtggttaagctcctgaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctttgggggtttctgagcagaaacaagaagccccggatctgtacccgcgaggagttcacaagaaaagtccggtctaatgccgctattggagccgtgtttgttgacgagaaccagtggaatagcgctaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgtcgagggggagggactccataagctgggctacattcttcgcgacatctctaaaattcctgggggaaatatgtatgctgatgacacagccggctgggataccagaatcacagaagacgatctgcaaaacgaggctaagatcaccgacattatggaacccgagcacgccctcctggcgacgagcatctttaaactgacctaccagaataaggtggttcgggtgcagcgccctgccaagaacgggacagtcatggatgtgatttccagacgggaccagcgcggctctggacaagtgggcacctatgggctcaatacattcaccaacatggaagctcagctgatcagacagatggagagcgagggaatttttcttccctccgaactggagacgccgaacctcgccgaacgggttctggattggcttgagaaatacggcgtggaaagactgaagcgcatggctatcagcggggacgactgtgtcgtgaaacctatcgatgaccggttcgccacagcgctcaccgccctgaatgatatgggaaaggttagaaaagacattccccagtgggagccttctaagggctggaacgattggcaacaggtgcccttttgctcccatcacttccaccagctgatcatgaaggacgggcgcgagattgtcgtgccttgtcggaatcaggatgaactcgtcggcagagctcgcgtgagccaaggagccggctggtctctgcgggagacagcttgccttgggaaatcctatgcccagatgtggcagctgatgtactttcatagacgcgacctccggctggctgccaacgcgatctgtagcgccgttcccgtggattgggtcccgacctccagaacgacctggtctattcacgctcatcaccaatggatgacaaccgaagacatgcttagcgtgtggaatcgcgtttggatcgaggaaaacccttggatggaggataagacacatgtgtccagctgggaggacgtcccctatctgggaaaacgggaagaccagtggtgcggctctctcattgggctgaccgccagagccacatgggcttccaatatccaggtggccatcaaccaggtgcggagactgattggaaatgagaactacctcgattacatgaccagcatgaagcgcttcaaaaatgaaggcgaccccgagggggcgttttggtga

SEQ ID NO: 19090 - RNA, 9879 nt, synthetic construct
  misc_feature 1..9879: note = derived and/or modified CDS sequence (opt5) from DENV-1__FJ898387__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacacgaaatttgaaaagcagctcggccagattatgctgctgatcctctgtacatcccagattcttctgatgcggaccacatgggcgctgtgcgagtctatcaccctcgctaccgggcccctgacaacgctttgggagggaagccctggcaaattctggaataccacaattgccgtgtccatggctaacatcttccgcggcagctacctggccggggccggactcgctttttccctgatgaagtctctgggcgggggaagacggggcaccggggcccaaggagaaacactcggcgagaagtggaaacgccagcttaatcagctgagcaagtccgagttcaacacctataaaagatctggcatcatggaggttgaccggagcgaagcgaaggaggggctgaaaagaggagagacgacaaagcacgccgtctcccgcggcaccgctaagctccggtggtttgtggaaagaaatctggtgaaaccggaggggaaggtcattgatcttggatgtggccgcgggggatggtcttactattgcgccggcctgaaaaaggttaccgaagtgaaaggctacacaaaagggggacccggccacgaggaacctatccccatggctacctacgggtggaacctcgtgaaactgcatagcggaaaggacgtcttctttattcctcccgagaagtgtgatacactgctctgcgacatcggcgagtccagccctaatccgacgattgaagaggggcggacccttagagtgctgaaaatggttgaaccctggctgcgcggaaaccagttctgtatcaagattctcaatccttatatgccctctgtggtcgagacactggagcaaatgcagcggaaacacggcggcatgcttgtgagaaaccctctgtcccgcaatagcacccatgaaatgtactgggtttcttgcgggacaggaaacatcgtgtccgccgtcaatatgaccagccggatgctcctgaacagatttacgatggcgcaccgcaagcccacctatgagcgggatgtggacctgggcgccgggacaagacacgtggctgtcgaaccggaggttgccaacctcgatatcattggacagcgcatcgaaaatattaaacatgagcacaagtctacctggcattacgacgaggataacccttataagacatgggcttaccacggctcctatgaagtgaaacccagcgggtccgccagctctatggtgaatggagtcgtgaagctgcttaccaaaccctgggacgttatccctatggtgacacagattgctatgaccgatacgacacccttcggccaacagagagtctttaaggagaaagtggacacccggacccctaaggccaagcgcggcacagcgcagatcatggaagttacggccaaatggctgtgggggttcctcagcagaaacaagaaaccgcggatctgtaccagagaggaatttacacggaaggtgcgctccaatgctgccattggagctgtcttcgtggacgagaaccaatggaactctgccaaagaggccgttgaagatgagagattttgggacctggtgcatcgggaacgcgagcttcacaagcagggcaagtgcgcgacctgcgtctacaacatgatggggaaaagagaaaagaaactgggagagttcggcaaggctaaagggagccgggccatctggtacatgtggctcggcgcccgcttcctggagtttgaagctctgggattcatgaatgaggatcactggttttccagagaaaactctctcagcggcgtggagggggagggactgcataaacttggctatattctgcgggacatctccaaaattcccgggggaaatatgtacgccgatgacacagctggctgggatacccgcatcacagaagacgatctccagaacgaggccaagatcaccgacattatggaacctgagcacgcgctgcttgccaagtctatcttcaaactgacgtatcagaataaggtcgtgagagttcaacggcccgctaaaaacgggaccgtgatggatgtcattagccgcagagaccagcggggctccggacaggtgggcacatacgggctcaatacctttacaaacatggaagcccagctgatccgccaaatggagagcgagggaattttctctccttccgaactggagacccccaacctcgctggcagagtgctggattggcttgaaaagcatggggttgagcggctgaaaagaatggccatcagcggagacgactgtgtggtcaagccgatcgatgaccgctttgcgacggccctcacagctctgaatgatatgggcaaggtgcggaaagacattcctcagtgggaaccctctaaggggtggaacgattggcagcaggttcctttctgctcccaccactttcatcaacttatcatgaaagacggcagagagattgtggtcccctgtcgcaatcaggatgagctggtgggacgggccagagtcagccagggcgctgggtggtccctccgcgaaaccgcctgcctgggaaagtcttatgctcagatgtggcaactgatgtacttccaccggagagacctccgcctggccgcgaacgccatctgtagcgctgtgcctgttgattgggtgcccacatcccggaccacgtggagcattcatgcccaccatcagtggatgaccacagaggacatgctttctgtctggaatagagtgtggatcgaagagaacccgtggatggaagataaaacccacatttccagctggggcgacgttccttatctggggaagcgcgaggaccagtggtgcggatctctcatcggcctgacagcccgggctacctgggccacaaatatccaagtggcgattaaccaggtcagacggcttatcgggaatgagaactacctggattacatgaccagcatgaagagatttaaaaatgaatccgaccccgagggcgctctctggtga

SEQ ID NO: 19091 - RNA, 9879 nt, synthetic construct
  misc_feature 1..9879: note = derived and/or modified CDS sequence (opt5) from DENV-1__FJ898389__SS-prME
  source 1..9879: mol_type = other RNA
agcgtgaccatgctgctcatgctgatgcccaccgcccttgctttccacctgacgaccagaggcggggaacctcatatgatcgtcacaaagcaggaacggggaaagtccctcctgtttaagacctctgccggcgttaatatgtgcacccttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttcctttttctgattatgggacagctcacatggaacgatctgatccggctgtgcattatggtgggcgccaatgcctctgacagaatgggcatggggaccacctatcttgctctgatggccacattcaaaatgcgccctatgtttgcggtcggactcctgttcagacggctcacgagccgcgaggtgctgcttctgaccatcggcctctccctggtggcttctgtcgaactgcccaacagccttgaggaactgggggatggactcgccatgggcatcatgattctgaagctcctgacagactttcaatcccaccagctttgggccaccctgctcagcctgacattcatcaaaaccacgctgtctcttcattacgcttggaagacaatggccatggttctgtccattgtgagcctctttcccctgtgtctctctaccacctcccagaagacaacctggctgcctgtgcttctggggagcttcggatgcaaaccgctggctatgtttctcatcgccgagaataagatttggggcagaaaatcttggcccctgaacgaaggcatcatggcggtcggggtggtttccatccttctgagctccctcctgaagaacgatgtgcctctcgccggacccctgattgctggcgggatgcttatcgcctgttatgtcattagcggatctagcgctgacctgtccctggagaaagccgccgaggtgtcttgggaagaggaagctgagcacagcggcgcgtcccataatatcctcgttgaagtgcaggatgacgggacaatgaagattaaagatgaggagcgggacgatacgctgaccatccttctgaaggccacactcctggctgtctctggagtgtaccctctcagcatccccgccaccctgttcgtctggtatttctggcaaaagaaaaagcagcgctccggcgtgctttgggacacaccttctcccccggaagttgagagagccgtgctggatgacggcatttaccggatcatgcagcgcgggctgctcggaagaagccaggtcggcgtgggggtttttcaagaaaacgtgttccacaccatgtggcacgtcacgcggggagctgtgctgatgtatcagggcaaacgccttgagccttcctgggccagcgtgaagaaagacctgatttcttacgggggaggctggagactccagggctcctggaataccggggaggaagttcaggtcatcgcggtggagcccggaaagaaccctaagaatgtgcaaacagctcccggcacctttaaaacaccggaaggggaggtcggagccattgccctggatttcaagcctggcaccagcgggtctcccatcgtgaaccgggaaggaaaaattgttggcctctacggcaatggggtggtcacaacgtccggaacctatgtgagcgctatcgcccaggcgaaggcttcccaggagggccctctgcccgagatcgaagacgaggtttttagaaaacgcaaccttacaattatggatctgcatcccgggtctggaaagacccggagatacctgcctgccatcgtgcgcgaagccattaagcggaaactcagaaccctgatccttgctccgacacgcgtcgtggccagcgagatggctgaagccctgaagggcatgcccattcggtatcaaacgaccgcggttaaatccgagcacacagggaaggagatcgtggacctcatgtgccatgccaccttcacaatgagactgctgagccctgtccgcgtgcccaattacaacatgatcattatggatgaagctcactttaccgaccctttctctatcgccgctcggggctatatttccacgagagtgggaatgggcgaggccgccgctatctttatgacagcgacaccccctgggagcgtcgaagccttcccgcagtctaatgctgttattcaggatgaggaacgggacatccccgagcgcagctggaactccggatacgagtggatcaccgattttcctggcaaaacagtgtggttcgtgccctctattaagagcgggaatgacatcgccaactgtctcagaaagaatggaaaacgggtcattcagctttcccgcaagaccttcgatacagaatatcagaagaccaagaacaacgactgggactacgtggttacgacagatatctctgagatgggcgccaattttagagctgaccgggtgattgatcctagacgctgcctgaaacccgtcatcctgaaggacgggccggaacgggtgattctcgccggccctatgcccgttaccgtggcgagcgctgcccagagacgcggacggatcggcagaaaccataataaggagggggatcagtacatctatatgggacagcccctgaacaatgacgaggatcacgcccactggacagaagctaaaatgcttctggacaacattaatacccctgagggcatcattcccgccctcttcgaacctgagcgcgaaaagtccgcggccatcgatggggagtaccggctgagaggagaggctcgcaaaacgtttgtcgaactgatgagacggggcgacctcccggtgtggcttagctataaggtcgcctctgaggggttccaatactccgatcgcagatggtgctttgacggcgaacggaacaatcaggtgctggaggaaaacatggatgttgagatttggaccaaagagggagaacgcaagaaactgagaccccggtggctcgacgctagaacatatagcgaccctctggcccttcgcgagttcaaggaatttgctgccggccggagatccgtgtctggggatctgatcctcgagatcggaaagctgccccagcatctgacccagcgcgcgcaaaatgccctcgacaaccttgtgatgctgcacaatagcgaacagggcgggcgggcttacagacatgccatggaggagctgcctgatacaattgaaaccctcatgctgcttgctctgatcgccgtcctcacaggaggcgttaccctgttctttctgtccggccgggggctcggaaaaacgtctattggccttctgtgtgtgatggccagctccgtgctgctctggatggctagcgtcgagccccactggatcgcggcctctattatcctggagttctttcttatggtgctgctcatcccggagcctgaccgccagagaacaccccaggataaccaactggcttatgttgtgattgggctcctgttcatgatccttaccgtcgccgccaatgagatgggactgctggaaaccacaaagaaagacctcggcattgggcacgtggctgtcgagaaccatcaccatgccaccatgctggatgtggaccttcaccctgcgtccgcctggacactgtacgctgttgccacgaccatcattacacccatgatgcggcataccatcgaaaacacaaccgctaatattagcctcacggccatcgcgaaccaggccgctatcctgatgggactggataagggctggcctatttctaaaatggacatcggcgtgcccctccttgccctggggtgctactcccaggtcaatccgctgaccctcacagctgccgtgctgatgcttgttgctcactatgccattatcggacctggcctgcaagcgaaggccacccgcgaggctcagaagagaacagccgctgggattatgaaaaaccccaccgtggatggaatcgtcgccatcgacctcgatcccgtggtgtacgacgccaagtttgaaaaacagctgggccagattatgctgctcatcctttgtacgagccaaattctgctgatgcggacaacctgggcgctctgcgagtctatcacactggctaccgggcctcttaccacactgtgggagggaagcccgggcaagttctggaatacgaccattgccgtttccatggctaacatcttccgcggctcttatctcgccggggccggactggcttttagcctgatgaaatccctcggcgggggaagacggggcacaggggcccagggagaaacccttggcgagaagtggaagcgccagctgaatcagctgagcaaatccgagttcaacatctacaagagatctggcattatggaggtcgaccggagcgaagcgaaagaggggctcaagagaggagagacaacccgccacgccgtgtcccggggcacggctaaactgagatggtttgtggaacgcaatcttgtcaagcccgaggggaaggttatcgatctgggatgtggcagagggggatggtcttattactgcgccggcctcaaaaaggtgacagaagtgaaaggctataccaaagggggacctggccatgaggaacccattcctatggctacctacgggtggaacctggtcaaactgcacagcggaaaggacgtgttctttacaccccctgagaaatgtgataccctcctttgcgacatcggcgagtcctctccgaatcccacaattgaagaggggagaacgctgcgcgttctgaagatggtggaaccttggctccggggaaaccaattctgtatcaagattctgaatccctacatgcctagcgtcgtggagacccttgagcagatgcagagaaaacatggcggcatgctggttcgcaaccccctctcccggaatagcacacacgaaatgtattgggtgtcttgcgggaccggaaacatcgtctccgccgtgaatatgacaagcagaatgctgctgaaccgctttaccatggcgcaccggaagccgacgtacgagagagatgtggacctcggcgccgggacccgccatgtcgctgttgaacctgaggtggccaacctggatatcattggacagagaatcgaaaatattaaacacgagcataagtctacatggcactatgacgaggataacccctacaaaacctgggcttatcatggctcctacgaagtgaagcccagcgggtctgcctccagcatggtcaatggagtggttaaacttctgacaaaaccttgggacgtgatccccatggtcacccaaattgctatgacagataccacgcctttcggccagcagcgggtgtttaaggagaaagttgacacacgcaccccgaaggccaaaagaggcaccgcgcaaatcatggaagtgacagcccggtggctctgggggttcctgtccagaaacaagaagccccggatctgtacgcgcgaggaatttaccagaaaagtccggagcaatgctgccattggagctgtgttcgttgacgagaaccagtggaactctgccaaggaggccgtggaagatgagcgcttttgggaccttgtccagaaagaaagagagctgcacaagcagggcaaatgcgcgacatgcgtgtataacatgatggggaagcgggaaaagaaactcggagagttcggcaaggctaaagggagccgcgccatctggtacatgtggctgggcgccagattcctggagtttgaagctctcggattcatgaatgaggatcactggttttcccgggaaaactctctgagcggcgtcgagggggagggacttcataagctgggctacattctccgcgacatctccaaaattcctgggggaaatatgtatgccgatgacaccgctggctgggatacaagaatcaccgaagacgatctgcaaaacgaggccaagatcacagacattatggaacccgagcacgcgcttctggccacctctatcttcaaactcacgtaccagaataaggtggttcgggtgcagcgccctgctaagaacgggaccgtcatggatgtgattagcagacgggaccagcgcggctccggacaagtgggcacatatgggctgaatacctttacaaacatggaagcccagctgatcagacagatggagtctgagggaattttcctccccagcgaactggagaccccgaaccttgctgaacgggttctggattggctcgagaaatacggcgtggaaagactgaagcgcatggccatctccggggacgactgtgtcgtgaaacctatcgatgaccggtttgcgacggcccttacagctctgaatgatatgggaaaggttagaaaagacattccccagtgggagcctagcaagggctggaacgattggcaacaggtgcccttctgctctcatcactttcaccagctcatcatgaaggacgggcgcgagattgtcgtgccttgtcggaatcaggatgaactggtcggcagagcccgcgtgtcccaaggagctggctggagcctgcgggagaccgcctgcctcgggaaatcttatgctcagatgtggcagctgatgtacttccatagacgcgaccttcggctggccgcgaacgccatctgttccgctgttcccgtggattgggtcccgacaagcagaaccacgtggtccattcacgcccatcaccaatggatgaccacagaagacatgctctctgtgtggaatcgcgtttggatcgaggaaaacccttggatggaggataagacccatgtgagctcctggggagacgtcccctatctgggcaaacgggaggaccagtggtgcgggagccttattggactgacagccagagctacctgggcctctaatatccaggtggcgatcaaccaggtgcggagactcattggcaatgaaaactacctggattacatgacatccatgaagcgctttaaaaatgagggggaccccgaaggcgctctgtggtga

SEQ ID NO: 19092 - RNA, 9879 nt, synthetic construct
  misc_feature 1..9879: note = derived and/or modified CDS sequence (opt5) from DENV-1__FJ898390__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggaactctgtgaagataccatgacatacaaatgcccccgcatcaccgaagctgaacccgacgatgtggactgttggtgcaatgccacggatacctgggtgacctatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggtgggagaaaaagcccttaagctctcttggttcaagaaaggcagctccattgggaagatgtttgaggctacagccagaggcgctcgccggatggccatcctgggagataccgcgtgggacttcggctctatcgggggagtttttacaagcgtcggcaaactggtgcatcagattttcgggaccgcctacggagtgctcttttccggcgtcagctggacgatgaagatcgggattggcgtgctgcttacctggctgggactcaattctagatccacaagcctgtctatgacctgtatcgctgttggcctggtgacactttacctcggggtcatggtgcaggccgattccggatgcgttattaactggaaaggccgcgaactgaagtgtgggagcggaatcttcgtgaccaatgaggtccacacatggaccgaacaatataagtttcaggctgactcccctaaacggctgtctgccgcgattggcaaggcctgggaggagggggtgtgcggcatcagaagcgctacgcgcctcgaaaacatcatgtggaaacagatttccaacgagctgaatcatatccttctggaaaacgacatgaagttcacagttgtggtcggagatgtggtgggcattctcgcccaggggaaaaagatgatccggccgcaacccatggagcacaaatactcttggaaaagctggggaaaggctaagattatcggcgccgacgtccagaataccacctttatcattgatgggcctaacacacccgaatgtcctgacgatcagagagcctggaatatctgggaggttgaggactatggattcggcatttttaccacgaacatctggctgaagctgcgcgattcctacacacaggtgtgcgaccaccggcttatgagcgctgcgattaaagattctaaggccgtgcatgctgacatgggctattggatcgaatccgagaaaaatgaaacctggaagctcgccagagccagcttcatcgaggtcaagacatgtatttggcccaaatctcacaccctgtggtccaacggggtgctggaaagcgagatgatcattccgaagatctacggaggccctatttctcaacataattatcgccccgggtacttcacacagaccgctggaccttggcacctcggcaaactggagcttgattttgacctgtgcgaagggacgaccgttgtggtcgatgagcactgcggaaaccggggccccagcctcagaacaaccacagtgaccggcaagatcatccatgaatggtgttgccggtcctgtacgctgcctcccctgcgcttcaaaggggaggacggatgctggtacggcatggagattagaccggttaaggaaaaggaggaaaatcttgtgaaaagcatggtctctgccgggtccggagaggtggacagcttttccctcggcctgctgtgtatctctattatgatcgaagaggttatgcggagcagatggtcccgcaagatgctcatgacagggaccctggcggtgttccttctgctcattatgggacagctgacatggaacgatctgatccggctttgcattatggtcggcgctaatgcctctgacagaatgggcatggggaccacctatctggccctcatggctacatttaaaatgcgccctatgttcgccgtgggactgctctttagacggctgacgagccgcgaggtgcttctgctcaccatcggcctgtccctggtcgcgtctgttgaacttcccaacagcctggaggaactcggggatggactggctatgggcatcatgattctcaagctgcttacagacttccaatcccaccagctgtgggccaccctcctgagcctgacatttatcaaaaccacgctttctctgcattacgcctggaagacaatggctatggtgctctccattgtgagcctgttccccctctgtctgtctaccacctcccagaagacaacctggcttcctgtcctgctggggagcctcggatgcaaaccgctgacaatgtttcttatcgccgagaataagatttggggcagaaaatcttggcccctgaacgaaggcatcatggctgtgggggttgtgtccatcctcctgagctccctcctgaagaacgatgtccctcttgccggacccctgattgcgggcgggatgctgatcgcctgttatgtgattagcggatctagcgctgacctctccctggagaaagccgctgaggtttcttgggaagaggaagccgagcacagcggcgcctcccataatatccttgtggaagtccaggatgacgggacgatgaagattaaagatgaggagcgggacgataccctgacaatcctcctgaaggctaccctcctggcggtgtctggagtctaccctcttagcatccccgccacactgttcgtgtggtatttttggcaaaagaaaaagcagcgctccggcgttctgtgggacaccccttctcccccggaagtggagagagctgtcctcgatgacggcatttaccggatcatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggccagcgttaagaaagacctgatttcttacgggggaggctggagactccagggctcctggaatacaggggaggaagtccaggtgatcgctgtggagcccggaaagaaccctaagaatgtccaaaccgcccccggcacatttaaaaccccggaaggggaggtgggagcgattgctctggatttcaagcctggcacaagcgggtctcccatcgttaaccgggaaggaaaaattgtgggcctttacggcaatggggtcgtgacgacctccggaacatatgttagcgccatcgcccaggctaaggcctcccaggagggccctctgcccgagatcgaagacgaggtgtttagaaaacgcaacctgaccattatggatctccatcccgggtctggaaagacccggagatacctgcctgcgatcgtccgcgaagctattaagcggaaacttagaacactgatcctcgccccgacgcgcgtggttgccagcgagatggctgaagccctgaagggcatgcccattcggtatcaaaccacagctgtgaaatccgagcacaccgggaaggagatcgtcgacctgatgtgccatgccacattcaccatgagactccttagccctgtgcgcgtgcccaattacaacatgatcattatggatgaagcgcactttacggacccttcttccatcgccgctcggggctatattagcacaagagtcggaatgggcgaggccgctgccatcttcatgaccgccacaccccctgggtctgttgaggcttttccgcagagcaatgcggtgattcaggatgaggaacgggacatccccgagcgctcctggaactctggatacgagtggatcacagatttccctggcaaaaccgtgtggtttgtccccagcattaagtccgggaatgacatcgccaactgtctgagaaagaatggaaaacgggtgattcagctgtctcgcaagacattcgataccgaatatcagaagacgaagaacaacgactgggactacgttgtgacaaccgatatcagcgagatgggcgctaattttagagccgaccgggtcattgatcctagacgctgcctcaaacccgtgatcctgaaggacgggccggaacgggttattcttgccggccctatgcccgtgacagtcgcttccgccgcgcagagacgcggacggatcggcagaaaccataataaggagggggatcagtacatctatatgggacagcccctgaacaatgacgaggatcacgctcactggaccgaagccaaaatgctcctggacaacattaatacgcctgagggcatcattcccgccctgttcgaacctgagcgcgaaaagagcgctgccatcgatggggagtaccggctcagaggagaggcgcgcaaaaccttcgtggaacttatgagacggggcgacctgccggtctggctgtcttataaggtggcctccgaggggtttcaatacagcgatcgcagatggtgcttcgacggcgaacggaacaatcaggttctcgaggaaaacatggatgtggagatttggacaaaagagggagaacgcaagaaactgagaccccggtggcttgacgctagaacctattccgaccctctggccctccgcgagtttaaggagttcgctgccggccggagatctgtgagcggggatctgatcctggagatcggaaagctcccccagcatcttacacagcgcgctcaaaatgccctggacaacctggtcatgctccacaattccgaacagggcgggcgggcgtacagacatgccatggaggagctgcctgataccattgaaacacttatgctgctcgctctgatcgccgttctgaccggaggcgtgacgctctttttcctttctggccgggggctgggaaaaacaagcattggcctgctctgtgtgatggcttccagcgtcctgctttggatggcctctgtggagccccactggatcgccgcttccattatcctggaatttttcctcatggttctgctgatcccggagcctgaccgccagagaacaccccaggataaccaactcgcgtatgtggtcattgggcttctgtttatgatcctgaccgtggccgctaatgagatgggactcctggaaacaaccaagaaagaccttggcattgggcacgtcgccgtggagaaccatcaccatgccacaatgctggatgttgacctccaccctgctagcgcctggacgctgtacgcggtggccaccacaatcattacccccatgatgcggcatacaatcgaaaacaccacggctaatatttctctgaccgccatcgctaaccaggccgcgatcctcatgggacttgataagggctggcctatttccaaaatggacatcggcgtccccctgctggccctcgggtgctacagccaggtgaatccgctgacacttaccgctgccgttctgatgctcgtggctcactatgccattatcggacctggcctgcaagctaaggccacacgcgaggcgcagaagagaaccgccgctgggattatgaaaaaccccacggtcgatggaatcgtggccatcgacctggatcccgtggtttacgacgctaagttcgaaaaacagctcggccagattatgcttctgatcctgtgtacatctcaaattctcctgatgcggaccacatgggccctttgcgagagcatcaccctggccaccgggcctctcacaacgctgtgggagggatccccgggcaagttttggaataccacaattgcggtctctatggctaacatcttccgcggcagctatctggccggggctggactcgccttttcccttatgaaaagcctgggcgggggaagacggggcaccggggcccagggagaaacactgggcgagaagtggaagcgccagctcaatcagctgtccaaatctgagttcaacatctacaagagaagcggcattatggaggtggaccggtccgaagctaaagaggggcttaagagaggagagaccacgcgccacgccgtgtctcggggcacagcgaaactgagatggttcgtcgaacgcaatctcgttaagcccgaggggaaggtgatcgatctgggatgtggcagagggggatggagctattactgcgccggcctgaaaaaggtgaccgaagtcaaaggctataccaaagggggacctggccatgaggaacccattcctatggctacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggtcgaaccttggcttcggggaaaccaattttgtatcaagattctgaatccctacatgccttccgtggttgagacactcgagcagatgcagagaaaacatggcggcatgctggtgcgcaaccccctgagcagaaattctacccacgaaatgtattgggtctcctgcgggacaggaaacatcgtgagcgccgtgaatatgacctctagaatgctcctgaaccgcttcacgatggctcaccggaagccgacctacgagagagatgtcgaccttggcgccgggacacgccatgttgcggtggaacctgaggtggccaacctggatatcattggacagagaatcgaaaatattaaacacgagcataagtccacctggcactatgacgaggataacccctacaaaacatgggcttatcatggcagctacgaagtcaagccctctgggtccgccagctccatggtgaatggagttgtgaagctcctgaccaaaccttgggacgtcatccccatggtgacacaaattgctatgaccgatacgacaccttttggccagcagcgggttttcaaggagaaagtggacacccgcaccccgaaggccaaaagaggcacagctcaaatcatggaagtcacggcccggtggctttgggggtttctgagcagaaacaagaagccccggatctgtacccgcgaggagttcacaagaaaagtgcggtctaatgcggccattggagctgtttttgtggacgagaaccagtggaatagcgccaaggaggctgtcgaagatgagcgcttctgggacctcgtgcagaaagaaagagagctgcacaagcagggcaaatgcgcgacctgcgtctataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgccgatgacacagctggctgggataccagaatcacagaagacgatctgcaaaacgaggccaagatcaccgacattatggaacccgagcacgctctcctggccacgagcatctttaaactgacctaccagaataaggttgtgcgggtccagcgccctgcgaagaacgggacagtgatggatgtgatttccagacgggaccagcgcggctctggacaagttggcacctatgggctcaatacattcaccaacatggaagcccagctgatcagacagatggagagcgagggaatttttcttccctccgaactggagacgccgaacctcgctgaacgggtgctggattggcttgagaaacatggcgtcgaaagactgaagcgcatggccatcagcggggacgactgtgtggttaaacctatcgatgaccggttcgctacagccctcaccgcgctgaatgatatgggaaaggtgagaaaagacattccccagtgggagccttctaagggctggaacgattggcaacaggtccccttttgctcccaccacttccatcagctgatcatgaaggacgggcgcgagattgtggtcccttgtcggaatcaggatgaactcgtgggcagagcccgcgttagccaaggagctggctggtctctgcgggagacagcctgccttgggaaatcctacgctcagatgtggcagctgatgtattttcacagacgcgacctccggctggccgctaacgccatctgtagcgcggtgcccgtcgattgggtgccgacctccagaacgacctggtctattcatgcccaccatcaatggatgacaaccgaagacatgcttagcgtttggaatcgcgtgtggatcgaggaaaacccttggatggaggataagacacacgtctccagctggggagacgtgccctacctgggcaaacgggaggaccagtggtgcgggtctctcattggactgaccgctagagccacatgggcctccaatatccaggtggctatcaaccaggttcggagactgattggcaatgaaaactatctcgattacatgaccagcatgaagcgcttcaaaaatgagggggaccccgaaggcgccctgtggtga

SEQ ID NO: 19093 - RNA, 9879 nt, synthetic construct
  misc_feature 1..9879: note = derived and/or modified CDS sequence (opt5) from DENV-1__FJ898391__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcattggatcgcggcctctattatcctcgagttctttctgatggtccttctgatccccgagccggaccgccagagaacccctcaggataaccagctcgcttacgtggttattgggctgctgttcatgatcctcaccgtggccgccaatgagatgggacttctggaaacaaccaaaaaggacctgggcattgggcacgtcgctgtggagaaccaccatcacgccgcgatgctcgatgtcgacctgcatcccgcctccgcttggacactttacgccgtggctacgaccatcattacacctatgatgcggcacaccatcgaaaacacaaccgccaatattagcctgacggcgatcgccaaccaagctgccatcctcatgggactggataaaggctggcccatttctaagatggacatcggcgttcctctgctcgctcttgggtgctatagccaggtgaatcccctgaccctgacagccgctgtcctcatgctggtggcccattacgcgattatcggaccgggccttcaggccaaggctacccgcgaggcccagaagagaacagctgccgggattatgaagaaccctaccgttgatggaatcgtggccatcgacctggatcccgtcgtgtatgacgcgaaatttgaaaagcagctcggccagattatgctgctgatcctctgtacgtcccagattcttctgatgcggacaacctgggctctgtgcgagtctatcacactcgccaccgggcccctgaccacactttgggagggaagccctggcaaattctggaatacgaccattgctgtgtccatggccaacatcttccgcggcagctacctggccggggctggactcgccttttccctgatgaagtctctgggcgggggaagacggggcacaggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacgaagcacgctgtctcccgcggcacagccaagctccggtggtttgtggaaagaaatctggtgaaaccggaggggaaggtcattgatcttggatgtggccgcgggggatggtcttactattgcgctggcctgaaaaaggttaccgaagtgaaaggctacaccaaagggggacccggccacgaggaacctatccccatggccacatacgggtggaacctcgtgaaactgcatagcggaaaggacgtcttctttattcctcccgagaagtgtgataccctgctctgcgacatcggcgagtccagccctaatccgacaattgaagaggggcggacgcttagagtgctgaaaatggttgaaccctggctgcgcggaaaccagttctgtatcaagattctcaatccttatatgccctctgtggtcgagaccctggagcaaatgcagcggaaacacggcggcatgcttgtgagaaaccctctgtcccgcaatagcacacatgaaatgtactgggtttcttgcgggaccggaaacatcgtgtccgcggtcaatatgacaagccggatgctcctgaacagatttaccatggcccaccgcaagcccacgtatgagcgggatgtggacctgggcgctgggaccagacacgtggccgtcgaaccggaggttgctaacctcgatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagattgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatctgtacgagagaggaatttacccggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacatgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaattcccgggggaaatatgtacgctgatgacaccgccggctgggatacacgcatcaccgaagacgatctccagaacgaggcgaagatcacagacattatggaacctgagcacgccctgcttgctaagtctatcttcaaactgacctatcagaataaggtcgtgagagttcaacggcccgccaaaaacgggacggtgatggatgtcattagccgcagagaccagcggggctccggacaggtgggcacctacgggctcaatacatttaccaacatggaagctcagctgatccgccaaatggagagcgagggaattttctctccttccgaactggagacacccaacctcgccggcagagtgctggattggcttgaaaagcatggggttgagcggctgaaaagaatggcgatcagcggagacgactgtgtggtcaagccgatcgatgaccgctttgccaccgctctcacggccctgaatgatatgggcaaggtgcggaaagacattcctcagtgggaaccctctaaggggtggaacgattggcagcaggttcctttctgctcccaccactttcatcaacttatcatgaaagacggcagagagattgtggtcccctgtcgcaatcaggatgagctggtgggacgggctagagtcagccagggcgccgggtggtccctccgcgaaacagcttgcctgggaaagtcttatgcccagatgtggcaactgatgtacttccaccggagagacctccgcctggcggccaacgctatctgtagcgccgtgcctgttgattgggtgcccacctcccggacaacctggagcattcatgcccaccatcagtggatgacgaccgaggacatgctttctgtctggaatagagtgtggatcgaagagaacccgtggatggaagataaaacacacatttccagctggggcgacgttccttatctggggaagcgcgaggaccagtggtgcggatctctcatcggcctgaccgctcgggccacatgggcgaccaatatccaagtggctattaaccaggtcagacggcttatcgggaatgagaactacctggattacatgacaagcatgaagagatttaaaaatgaatccgaccccgagggcgccctctggtga

SEQ ID NO: 19094 - RNA, 9879 nt, synthetic construct
  misc_feature 1..9879: note = derived and/or modified CDS sequence (opt5) from DENV-1__FJ898392__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaaaaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaagggggacgggcctacagacatgctatggaggagctgcctgacacaatcgaaacccttatgctgctcgccctgattgctgtcctgacgggcggcgttacactctttttcctttctgggcggggactgggcaaaaccagcatcgggctgctctgtgtgatggcctccagcgtgctgctttggatggcctctgtcgagccccactggattgctgcgtccatcattctggaatttttcctcatggtgctgctgatcccggagcctgatcgccagagaacaccccaggacaaccaactcgcctatgttgtgatcggacttctgtttattatcctgacagtcgctgccaatgagatgggcctcctggaaaccacaaagaaagatcttgggattggacacgtggccgtcgagaaccatcaccatgctacgatgctggacgtggatctccaccctgccagcgcgtggaccctgtacgccgttgctacaaccatcattacacccatgatgcggcataccatcgaaaacacgaccgccaatatttctctgacagctatcgccaaccaggcggccatcctcatgggccttgacaagggctggcctatttccaaaatggatatcggggtgcccctgctggctctcggatgctacagccaggtcaatccgctgacccttacagccgctgtgctgatgctcgttgcccactatgctattatcggccctgggctgcaagccaaggcgacccgcgaggcccagaagagaacggctgccggaattatgaaaaaccccacagtggacggcatcgtcgctatcgatctggaccccgtggtgtacgatgccaagttcgaaaaacagctcgggcagattatgcttctgatcctgtgtacctctcaaattctcctgatgcggacaacctgggccctttgcgagagcatcaccctggcgacaggacctctcacgaccctgtgggagggctccccgggcaagttttggaatacaaccattgctgtttctatggccaacatcttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatctacaagagaagcgggattatggaggtcgaccggtccgaagccaaagagggacttaagagaggcgagacgacacgccacgcggtgtctcgggggaccgccaaactgagatggttcgtggaacgcaatctcgtcaagcccgagggaaaggttatcgacctgggctgtgggcggggaggctggagctattactgcgctggcctgaaaaaggtgaccgaagtgaaagggtatacaaagggaggccctgggcatgaggaacccattcctatggccacctacggatggaacctcgtcaaacttcactccggcaaggatgtgtttttcacaccccctgagaaatgtgacacgctgctgtgcgatatcggggagtctagcccgaatcccaccattgaagagggaagaacactccgcgttctgaagatggtggaaccttggcttcggggcaaccaattttgtatcaagattctgaatccctacatgccttccgtcgtggagaccctcgagcagatgcagagaaaacatggcgggatgctggttcgcaaccccctgagcagaaattctacacacgaaatgtattgggtgtcctgcggaaccggcaacatcgtcagcgctgtgaatatgacgtctagaatgctcctgaaccgcttcaccatggcccaccggaagccgacatacgagagagacgtggatcttggggcgggaacccgccatgtcgccgttgaacctgaggtggctaacctggacatcattggccagagaatcgaaaatattaaacacgagcataagtccacatggcactatgatgaggacaacccctacaaaacctgggcctatcatgggagctacgaagtgaagccctctggatccgctagctccatggtcaatggcgtggttaagctcctgacaaaaccttgggatgtgatccccatggtcacccaaattgccatgacggacacaaccccttttggccagcagcgggtgttcaaggagaaagttgatacccgcacaccgaaggctaaaagagggacggcccaaatcatggaagtgaccgcgcggtggctttggggatttctgagcagaaacaagaagccccggatctgtacacgcgaggagttcaccagaaaagtccggtctaatgccgctattggcgccgtgtttgttgacgagaaccagtggaatagcgctaaggaggccgtggaagacgagcgcttctgggatctcgtccagaaagaaagagagctgcacaagcaggggaaatgcgccacatgcgtgtataacatgatgggaaagcgggaaaagaaactgggcgagtttgggaaggcgaaaggctcccgcgctatctggtacatgtggctcggagccagattcctggagtttgaagcccttggcttcatgaatgaggaccactggttctctcgggaaaacagcctgtccggggtcgagggagagggcctccataagctggggtacattcttcgcgatatctctaaaattcctggaggcaatatgtatgctgacgataccgccgggtgggacacaagaatcaccgaagatgacctgcaaaacgaggctaagatcacggatattatggaacccgagcacgccctcctggcgaccagcatctttaaactgacataccagaataaggtggttcgggtgcagcgccctgccaagaacggcaccgtcatggacgtgatttccagacgggatcagcgcggatctggccaagtggggacatatggactcaataccttcacgaacatggaagctcagctgatcagacagatggagagcgagggcatttttcttccctccgaactggagacaccgaacctcgccgaacgggttctggactggcttgagaaatacggggtggaaagactgaagcgcatggctatcagcggagatgactgtgtcgtgaaacctatcgacgatcggttcgccaccgcgctcacagccctgaatgacatgggcaaggttagaaaagatattccccagtgggagccttctaaggggtggaacgactggcaacaggtgcccttttgctcccatcacttccaccagctgatcatgaaggatggccgcgagattgtcgtgccttgtcggaatcaggacgaactcgtcggacgggctcgcgtgagccaaggcgccgggtggtctctgcgggagaccgcttgccttggaaaatcctatgcccagatgtggcagctgatgtactttcatagacgcgatctccggctggctgccaacgcgatctgtagcgccgttcccgtggactgggtcccgacgtccagaaccacatggtctattcacgctcatcaccaatggatgaccacagaagatatgcttagcgtgtggaatcgcgtttggatcgaggaaaacccttggatggaggacaagacccatgtgtccagctggggcgatgtcccctatctggggaaacgggaggaccagtggtgcggatctctcattggcctgacagccagagccacctgggcttccaatatccaggtggccatcaaccaggtgcggagactgattgggaatgaaaactacctcgactacatgacgagcatgaagcgcttcaaaaatgagggcgatcccgaaggagcgctgtggtga

SEQ ID NO: 19095 - RNA, 9879 nt, synthetic construct
  misc_feature 1..9879: note = derived and/or modified CDS sequence (opt5) from DENV-1__FJ898393__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagagcaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattaccccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagcccccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtggggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcagagcttgggaggagggggtgtgcggcattcgcagcgccacgcggctcgaaaacatcatgtggaagcagatctccaacgagctgaatcatattcttctggaaaacgacatgaaattcacagttgtggtcggagatgtggtgggcatcctcgctcaggggaagaaaatgattagaccgcaacccatggagcacaagtactcttggaaaagctggggaaaggccaagatcattggcgccgacgtccagaataccacctttatcatcgatgggcctaacacacccgaatgtcctgacgatcagcgcgcttggaatatttgggaggttgaggactatggattcggcatctttaccacgaacatttggctgaaactgcgggattcctacacacaggtgtgcgaccacagacttatgagcgcggccatcaaggattctaaagctgtgcatgccgacatgggctattggattgaatccgagaagaatgaaacctggaaactcgcccgcgctagcttcatcgaggtcaagacatgtatctggcccaagtctcacaccctgtggtccaacggggtgctggaaagcgagatgattatcccgaaaatttacggaggccctatctctcaacataattatcggcccgggtacttcacacagaccgccggaccttggcacctcggcaagctggagcttgattttgacctgtgcgaagggacgaccgttgtggtcgatgagcactgcggaaacagaggccccagcctccggacaaccacagtgaccggcaaaattatccatgaatggtgttgccgctcctgtacgctgcctcccctgagattcaagggggaggacggatgctggtacggcatggagatccggccggttaaagaaaaggaggaaaatcttgtgaagagcatggtctctgcggggtccggagaggtggacagcttttccctcggcctgctgtgtatttctatcatgattgaagaggttatgagaagccgctggtcccggaaaatgctcatgacagggaccctggctgtgttccttctgctcatcatgggacagctgacatggaacgatctgattagactttgcatcatggtcggcgccaatgcctctgaccgcatgggcatggggaccacctatctggctctcatggccacatttaagatgagacctatgttcgcggtgggactgctctttcggcgcctgacgagcagagaggtgcttctgctcaccattggcctgtccctggtcgcttctgttgaacttcccaacagcctggaggaactcggggatggactggccatgggcatcatgatcctcaaactgcttacagacttccaatcccaccagctgtgggccaccctcctgagcctgacatttattaagaccacgctttctctgcattacgcttggaaaacaatggccatggtgctctccatcgctagcctgttccccctctgtctgtctaccacctcccagaagacaacctggcttcctgtgctgctggggagcctcggatgcaagccgctgacaatgtttcttattacggagaccaaaatctggggccggaagtcttggcccctgaatgaaggcattatggccgtcggggtggtttccatcctcctgagctccctcctgaaaaacgatgtgcctcttgcgggacccctgatcgccggcgggatgctgattgcttgttatgtcatcagcggatctagcgccgacctctccctggagaaggctgccgaggtgtcttgggaagaggaagccgagcacagcggcgcttcccataacattcttgttgtggtccaggatgacgggacaatgaaaatcaaggatgaagagcgcgacgataccctgacaattctcctgaaagcgaccctcctggccgtgtctggagtctaccctcttagcatccccgctacgctgttcgtgtggtatttttggcaaaagaagaaacagagatccggcgttctgtgggacaccccttctcccccggaggtggaacgggccgtcctcgatgacggcatctaccgcattatgcagagagggctgcttggacggagccaggtgggcgttggggtgttccaagagaatgtcttccacacaatgtggcacgtgacccgcggagccgtgctgatgtatcagggcaagagactcgaaccttcctgggctagcgttaaaaaggacctgatctcttacgggggaggctggcggctccagggctcctggaacacaggggaggaggtccaggtgattgccgtggaacccggaaaaaatcctaagaacgtccaaaccgcgcccggcacatttaagacgccggagggggaagtgggagctatcgccctggatttcaaacctggcaccagcgggtctcccattgttaatagagagggaaagatcgtgggcctttacggcaacggggtcgtgacaacctccggaacctatgttagcgccattgctcaggccaaagcgtcccaggaaggccctctgcccgagatcgaggacgaagtgtttcgcaagcggaatctgacaatcatggatctccatcccgggtctggaaaaacgagacgctacctgcctgctattgtccgggaggccatcaagagaaagcttcgcaccctgattctcgccccgacacgggtggttgctagcgaaatggccgaggctctgaaaggcatgcccatcagatatcaaaccacagccgtgaagtccgaacacaccgggaaagagattgtcgacctgatgtgccatgcgacgttcacaatgcgcctccttagccctgtgcgggtgcccaactacaatatgatcatcatggatgaggcccactttaccgacccttcttccattgctgccagaggctatatcagcacccgggtcggaatgggcgaagctgccgccattttcatgacagctaccccccctgggtctgttgaggcgtttccgcagagcaacgccgtgatccaggatgaagagcgcgacattcccgaaagatcctggaattctggatacgagtggatcacagatttccctggcaagaccgtgtggtttgtccccagcatcaaatccgggaacgacattgctaattgtctgcggaagaacggaaagcgcgtgatccagctgtctagaaaaacgttcgatacagagtatcaaaagaccaaaaataacgactgggactacgttgtgacaaccgatattagcgaaatgggcgccaactttcgggccgacagagtcatcgatcctcgccggtgcctcaagcccgtgattctgaaagacgggccggagagagttatccttgctggccctatgcccgtgacggtcgcctccgcggctcagcgccggggaagaattggccgcaatcataacaaggaaggggatcagtacatctatatgggacagcccctgaataacgacgaggatcacgcccactggaccgaggccaagatgctcctggacaatatcaacacacctgaaggcattatccccgctctgttcgagcctgaacgggagaaaagcgccgcgattgatggggaatacagactccgcggagaggccagaaagaccttcgtggagcttatgcggcgcggcgacctgccggtctggctgtcttataaagtggcttccgaagggtttcaatacagcgatagacggtggtgcttcgacggcgagcgcaataaccaggttctcgaagagaatatggatgtggaaatctggacaaaggagggagagagaaaaaagctgcggcccagatggcttgacgcccgcacctattccgaccctctggctctccgggaatttaaagagttcgccgctggcagacgctctgtgagcggggatctgattctggaaatcggaaagctcccccagcatcttacacagcgggcccaaaacgcgctggacaatctggtcatgctccacaactccgagcagggcgggagagcctaccggcatgctatggaagagctgcctgataccatcgagacgcttatgctgctcgccctgattgctgttctgacaggaggcgtgaccctctttttcctttctggccgcgggctgggaaagaccagcatcggcctgctctgtgtgatggcctccagcgtcctgctttggatggcctctgtggaaccccactggattgctgcgtccatcattctggagtttttcctcatggttctgctgatcccggaacctgacagacagcggacaccccaggataatcaactcgcctatgtggtcatcgggcttctgtttatgattctgaccgtggctgccaacgagatgggactcctggagacaacgaaaaaggaccttggcatcgggcacgtcgccgtggaaaatcatcaccatgctaccatgctggatgttgacctccaccctgccagcgcgtggacactgtacgccgtggctaccacaattatcacccccatgatgcgccatacgattgagaacaccacagccaacatctctctgaccgctattgccaatcaggcggccatcctcatgggacttgataaaggctggcctatctccaagatggacattggcgtccccctgctggctctcgggtgctacagccaggtgaacccgctgacacttaccgccgctgttctgatgctcgtggcccactatgctatcattggacctggcctgcaagccaaagcgacgagagaagcccagaagcggacagctgccgggatcatgaagaatcccaccgtcgatggaattgtggctatcgacctggatcccgtggtttacgacgccaaattcgagaagcagctcggccagatcatgcttctgattctgtgtacatctcaaatcctcctgatgcgcaccacctgggccctttgcgaaagcattacactggcgacggggcctctcaccacactgtgggagggatccccgggcaaattttggaacaccacaatcgctgtctctatggccaatattttcagaggcagctatctggctggggccggactcgccttttcccttatgaagagcctgggcgggggacggcgcggcaccggggctcagggagagacgctgggcgaaaaatggaagagacagctcaaccagctgtccaagtctgagttcaatatctacaaacggagcggcatcatggaagtggacagatccgaggccaaggaagggcttaaacgcggagagacaacccggcacgcggtgtctagaggcaccgccaagctgcgctggttcgtcgagcggaacctcgttaaacccgaagggaaggtgattgatctgggatgtggcagagggggatggagctattactgcgctggcctgaagaaagtgacagaggtcaagggctataccaaagggggacctggccatgaagagcccatccctatggccacatacgggtggaatctcgtgaagcttcactccggaaaagacgtttttttcacgccccctgaaaagtgtgataccctgctgtgcgacattggcgagtctagcccgaaccccacaatcgaggaagggcgcaccctccgggtgctgaaaatggtcgagccttggcttagaggaaatcaattttgtattaagatcctgaacccctacatgccttccgtggttgaaacactcgagcagatgcagcgcaagcatggcggcatgctggtgcggaatcccctgagcagaaactctacccacgagatgtattgggtctcctgcgggacgggaaatattgtgagcgctgtgaacatgacctctcgcatgctcctgaatcggttcacaatggcccacagaaaaccgacctacgaacgcgatgtcgaccttggcgcggggacaagacatgttgccgtggagcctgaagtggctaacctggatatcatcggacagcggattgagaacatcaagcacgaacataaatccacctggcactatgacgaggataatccctacaagacatgggcctatcatggcagctacgaggtcaaaccctctgggtccgctagctccatggtgaacggagttgtgaagctcctgaccaagccttgggacgtcattcccatggtgacgcaaatcgccatgacagataccaccccttttggccagcagcgcgttttcaaagaaaaggtggacacaagaacgccgaaagctaagcggggcaccgcccaaattatggaggtcacagcgagatggctttgggggtttctgagccggaataaaaagccccgcatctgtaccagagaagagttcacacggaaggtgcgctctaacgccgctatcggagccgtttttgtggacgaaaatcagtggaacagcgctaaagaggccgtcgaggatgaaagattctgggacctcgtgcagaaggagcgggaactgcacaaacagggcaagtgcgccacctgcgtctataatatgatggggaaacgcgagaagaagctgggagaatttggcaaagcgaaggggtccagagctatttggtacatgtggctcggcgcccggttcctggagtttgaggcccttggattcatgaacgaagatcactggttctctcgcgagaatagcctgtccggcgtggaaggggagggactccataaactgggctacatccttagagacatttctaagatccctgggggaaacatgtatgctgatgacacagccggctgggatacccggattacggaggacgatctgcaaaatgaagctaaaatcaccgacatcatggagcccgaacacgccctcctggcgacaagcatttttaagctgacctaccagaacaaagttgtgcgcgtccagagacctgccaagaatgggacagtgatggatgtgatctcccggcgcgaccagagaggctctggacaagttggcacctatgggctcaacacgttcacaaatatggaggctcagctgattcggcagatggaaagcgagggaatctttcttccctccgagctggaaaccccgaacctcgccgagagagtgctggattggcttgaaaagtacggcgtcgagcgcctgaaacggatggctattagcggggacgactgtgtggttaagcctatcgatgacagattcgccacagcgctcaccgccctgaacgatatgggaaaagtgcgcaaggacatcccccagtgggaaccttctaaaggctggaatgattggcaacaggtccccttttgctcccatcacttccaccagctgattatgaaggacgggcgggagatcgtggtcccttgtagaaaccaggatgagctcgtgggccgcgctcgggttagccaaggagccggctggtctctgagagaaacggcttgccttgggaagtcctatgcccagatgtggcagctgatgtactttcatcgccgggacctcagactggctgccaatgcgatttgtagcgccgtgcccgtcgattgggtgccgacctcccgcacaacctggtctatccacgctcatcaccaatggatgacaaccgaggacatgcttagcgtttggaaccgggtgtggattgaagagaatccttggatggaagataaaacacatgtctccagctggggagacgtgccctatctgggcaagagagaggaccagtggtgcgggtctctcatcggactgaccgcccgggccacgtgggcttccaacattcaggtggccatcaatcaggttagacgcctgatcggcaacgagaattacctcgattacatgacaagcatgaaacggttcaagaacgaaggggaccccgagggcgcgctgtggtga

SEQ ID NO: 19096 - RNA, 9879 nt, synthetic construct
  misc_feature 1..9879: note = derived and/or modified CDS sequence (opt5) from DENV-1__FJ898394__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagagcaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattaccccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccaccccgcaagagacatggaatcgccaggacctgctcgtcaccttcaaaaccgcgcacgccaagaagcaggaagtggtcgtgctgggatctcaagagggcgctatgcacacagccctgacgggggccaccgaaattcagacaagcggaaccacaaccatctttgctggccatctcaaatgcagactgaagatggataaacttacgctgaaggggatgtcctatgttatgtgtacaggcagcttcaaactcgagaaggaagtggccgagacccagcacggaaccgtcctggtgcagattaagtacgagggcacagacgcgccttgcaaaatccccttctctacccaagatgaaaagggggttacacagaacggacggctgatcacggctaatcctattgtgaccgacaaagagaagcccgtcaacatcgaagccgagcccccttttggcgagtcctatattgtgatcggggccggagaaaaagctcttaagctcagctggttcaagaaaggctctagcattgggaagatgtttgaggccacagctagaggcgcccgccggatggcgatcctgggagataccgcctgggacttcggctccatcgggggagtgtttacatctgttggcaaactggtccatcagattttcgggaccgcttacggagtgctctttagcggcgtgtcctggacgatgaagatcgggattggcgtcctgcttacctggctgggactcaatagcagatctacatccctgagcatgacctgtatcgccgtgggcctggttacactttacctcggggtgatggtccaggctgattctggatgcgtgattaactggaaaggccgcgaactgaagtgtgggtccggaatcttcgttaccaatgaggtgcacacatggaccgaacaatataagtttcaggccgacagcccgaaacggctgtccgcggccattggcaaggcttgggaggagggggtctgcggcatcagatctgccacgcgcctcgaaaacatcatgtggaaacagattagcaacgagctgaatcatatccttctggaaaacgacatgaagttcacagtggttgtgggagatgtcgtgggcattctcgctcaggggaaaaagatgatccggccccaacctatggagcacaaatactcctggaagtcttggggaaaggccaaaattatcggcgccgacgtgcagaataccacctttatcattgatgggcccaacacacctgaatgtcccgacgatcagagagcttggaatatctgggaggtcgaggactatggattcggcatttttaccacgaacatctggctgaagctgcgcgatagctacacacaggtttgcgaccaccggcttatgtccgcggccattaaagatagcaaggctgtgcatgccgacatgggctattggatcgaatctgagaaaaatgaaacctggaagctcgccagagcttccttcatcgaggtgaagacatgtatttggccgaaaagccacaccctgtggtctaacggggtcctggaatccgagatgatcattcctaagatctacggaggccccattagccaacataattatcgccctgggtacttcacacagaccgccggaccctggcacctcggcaaactggagcttgattttgacctgtgcgaagggacgaccgtggttgtggatgagcactgcggaaaccggggcccttctctcagaacaaccacagtcaccggcaagatcatccatgaatggtgttgccggagctgtacgctgcccccgctgcgcttcaaaggggaggacggatgctggtacggcatggagattagacctgtgaaggaaaaggaggaaaatcttgttaaatccatggtgagcgcggggtctggagaggtcgactcctttagcctcggcctgctgtgtatctccattatgatcgaagaggtgatgcggtctagatggagccgcaagatgctcatgacagggaccctggctgttttccttctgctcattatgggacagctgacatggaacgatctgatccggctttgcattatggtgggcgccaatgtctccgacagaatgggcatggggaccacctatctggccctcatggctacatttaaaatgcgccccatgttcgccgtgggactgctctttagacggctgacgtctcgcgaggtgcttctgctcaccatcggcctgagcctggtcgcgtccgttgaacttcccaactctctggaggaactcggggatggactggctatgggcatcatgattctcaagctgcttacagacttccaaagccaccagctgtgggccaccctcctgtccctgacatttatcaaaaccacgcttagcctgcattacgcctggaagacaatggctatggtgctctctattgtgtccctgttccctctctgtctgagcaccacctctcagaagacaacctggcttccggtcctgctggggtccctcggatgcaaacccctgacaatgtttcttatcgccgagaataagatttggggcagaaaaagctggcctctgaacgaaggcatcatggctgtgggggttgtgtctatcctcctgtccagcctcctgaagaacgatgtcccccttgccggacctctgattgcgggcgggatgctgatcgcctgttatgtgatttccggaagctctgctgacctcagcctggagaaagccgctgaggtttcctgggaagaggaagccgagcactctggcgccagccataatatccttgtggaagtccaggatgacgggacgatgaagattaaagatgaggagcgggacgataccctgacaatcctcctgaaggctaccctcctggcggtgtccggagtctaccccctttctatccctgccacactgttcgtgtggtatttttggcaaaagaaaaagcagcgcagcggcgttctgtgggacaccccctccccgcctgaagtggagagagctgtcctcgatgacggcatttaccggatcatgcagcgcgggctgcttggaagatctcaggtgggcgttggggtgttccaagaaaacgtcttccacacgatgtggcacgtgacccggggagccgtgctgatgtatcagggcaaacgcctcgagcccagctgggcctccgttaagaaagacctgattagctacgggggaggctggagactccagggctcttggaatacaggggaggaagtccaggtgatcgctgtggagcctggaaagaaccccaagaatgtccaaaccgccccgggcacatttaaaacccctgaaggggaggtgggagcgattgctctggatttcaagcccggcacatccgggagccctatcgttaaccgggaaggaaaaattgtgggcctttacggcaatggggtcgtgacgacctctggaacatatgtttccgccatcgcccaggctaaggccagccaggagggccccctgcccgagatcgaagacgaggtgtttagaaaacgcaacctgaccattatggatctccatcctgggtccggaaagacccggagatacctgccggcgatcgtccgcgaagctattaagcggaaacttagaacactgatcctcgcccccacgcgcgtggttgcctctgagatggctgaagccctgaagggcatgcctattcggtatcaaaccacagctgtgaaaagcgagcacaccgggaaggagatcgtcgacctgatgtgccatgccacattcaccatgagactcctttcccccgtgcgcgtgcctaattacaacatgatcattatggatgaagcgcactttacggaccccagctctatcgccgctcggggctatatttccacaagagtcggaatgggcgaggccgctgccatcttcatgaccgccacccctccggggagcgttgaagcttttccccagtctaatgcggtgattcaggatgaggaacgggacatccctgagcgcagctggaactccggatacgagtggatcacagatttccccggcaaaaccgtgtggtttgtcccttctattaagagcgggaatgacatcgccaactgtctgagaaagaatggaaaacgggtgattcagctgtcccgcaagacattcgataccgaatatcaaaaaacgaagaacaacgactgggactacgttgtgacaaccgatatctctgagatgggcgctaattttagagccgaccgggtcattgatcccagacgctgcctcaaaccggtgatcctgaaggacgggcctgaacgggttattcttgccggccccatgcccgtgacagtcgctagcgccgcgcagagacgcggacggatcggcagaaaccataataaggagggggatcagtacatctatatgggacagcctctgaacaatgacgaggatcacgctcactggaccgaagccaaaatgctcctggacaacattaatacgcccgagggcatcattcctgccctgttcgaaccggagcgcgaaaagtccgctgccatcgatggggagtaccggctcagaggagaggcgcgcaaaaccttcgtggaacttatgagacggggcgacctgcccgtctggctgagctataaggtggcctctgaggggtttcaatactccgatcgcagatggtgcttcgacggcgaacggaacaatcaggttctcgaggaaaacatggatgtggagatttggacaaaagagggagaacgcaagaaactgagacctcggtggcttgacgctagaacctatagcgaccccctggccctccgcgagtttaaggaattcgctgccggccggagatccgtgtctggggatctgatcctggagatcggaaagctccctcagcatcttacacagcgcgctcaaaatgccctggacaacctggtcatgctccacaatagcgaacagggcgggcgggcgtacagacatgccatggaggagctgcccgataccattgaaacacttatgctgctcgctctgatcgccgttctgaccggaggcgtgacgctctttttcctttccggccgggggctgggaaaaacatctattggcctgctctgtgtgatggctagctccgtcctgctttggatggccagcgtggagccgcactggatcgccgcttctattatcctggaatttttcctcatggttctgctgatccctgagcccgaccgccagagaacccctcaggataaccaactcgcgtatgtggtcattgggcttctgtttatgatcctgaccgtggccgctaatgagatgggactcctggaaacaaccaagaaagaccttggcattgggcacgtcgccgtggagaaccatcaccatgccacaatgctggatgttgacctccaccccgcttccgcctggacgctgtacgcggtggccaccacaatcattacccctatgatgcggcatacaatcgaaaacaccacggctaatattagcctgaccgccatcgctaaccaggccgcgatcctcatgggacttgataagggctggcccatttctaaaatggacatcggcgtcccgctgctggccctcgggtgctactcccaggtgaatcctctgacacttaccgctgccgttctgatgctcgtggctcactatgccattatcggacccggcctgcaagctaaggccacacgcgaggcgcagaagagaaccgccgctgggattatgaaaaaccccacggtcgatggaatcgtggccatcgacctggatcctgtggtttacgacgctaagttcgaaaaacagctcggccagattatgcttctgatcctgtgtacaagccaaattctcctgatgcggaccacatgggccctttgcgagtctatcaccctggccaccgggccgctcacaacgctgtgggagggaagccccggcaagttttggaataccacaattgcggtctccatggctaacatcttccgcggctcttatctggccggggctggactcgcctttagccttatgaaatccctgggcgggggaagacggggcaccggggcccagggagaaacactgggcgagaagtggaagcgccagctcaatcagctgagcaaatccgaattcaacatctacaagagatctggcattatggaggtggaccggagcgaagctaaagaggggcttaagagaggagagaccacgcgccacgccgtgtcccggggcacagcgaaactgagatggttcgtcgaacgcaatctcgttaagcctgaggggaaggtgatcgatctgggatgtggccgggggggatggtcttattactgcgccggcctgaaaaaggtgaccgaagtcaaaggctataccaaggggggacccggccatgaggaacctattcccatggctacatacgggtggaacctcgtgaaacttcacagcggaaaggacgtttttttcacccctccggagaaatgtgatacactgctgtgcgacatcggcgagtcctctcccaatcctacgattgaagaggggagaaccctccgcgtgctgaagatggtcgaaccctggcttcggggaaaccaattttgtatcaagattctgaatccttacatgcccagcgtggttgagacactcgagcagatgcagagaaaacatggcggcatgctggtgcgcaacccgctgtcccggaatagcacccacgaaatgtattgggtctcttgcgggacaggaaacatcgtgtccgccgtgaatatgaccagcagaatgctcctgaaccgcttcacgatgacccaccggaagcctacatacgagagagatgtcgaccttggcgctgggacccgccatgttgccgtggaacccgaggtggcgaacctggatatcattggacagagaatcgaaaatattaaacacgagcataagtctacatggcactatgacgaggataacccctacaaaacctgggcctatcatggctcctacgaagtcaagcctagcgggtctgcttccagcatggtgaatggagttgtgaagctcctgacaaaaccctgggacgtcatccctatggtgacccaaattgccatgacggatacaaccccgtttggccagcagcgggttttcaaggagaaagtggacacccgcacacccaaggctaaaagaggcacggcccaaatcatggaagtcaccgctcggtggctttgggggtttctgtccagaaacaagaagcctcggatctgtacacgcgaggaattcaccagaaaagtgcggagcaatgccgcgattggagccgtttttgtggacgagaaccagtggaattctgctaaggaggccgtcgaagatgagcgcttctgggacctcgtgcagaaagaaagagagctgcacaagcagggcaaatgcgctacatgcgtctataacatgatggggaagcgggaaaagaaactgggagagtttggcaaggccaaagggagccgcgccatctggtacatgtggctcggcgcgagattcctggagtttgaagctcttggattcatgaatgaggatcactggttctcccgggaaaactctctgagcggcgtggagggggagggactccataagctgggctacattcttcgcgacatctccaaaattcccgggggaaatatgtatgccgatgacaccgccggctgggatacaagaatcaccgaagacgatctgcaaaacgaggctaagatcacggacattatggaacctgagcacgccctcctggctacctctatctttaaactgacataccagaataaggttgtgcgggtccagcgccccgccaagaacgggaccgtgatggatgtgattagcagacgggaccagcgcggctccggacaagttggcacatatgggctcaataccttcacgaacatggaagcgcagctgatcagacagatggagtctgagggaatttttcttccgagcgaactggagacacctaacctcgccgaacgggtgctggattggcttgagaaacatggcgtcgaaagactgaagcgcatggctatctccggggacgactgtgtggttaaacccatcgatgaccggttcgccaccgctctcacagccctgaatgatatgggaaaggtgagaaaagacattcctcagtgggagcccagcaagggctggaacgattggcaacaggtccctttttgctctcaccacttccatcagctgatcatgaaggacgggcgcgagattgtggtcccctgtcggaatcaggatgaactcgtgggcagagcgcgcgtttcccaaggagccggctggagcctgcgggagaccgcttgccttgggaaatcttacgcccagatgtggcagctgatgtattttcacagacgcgacctccggctggctgccaacgctatctgttccgccgtgccggtcgattgggtgcctacgagcagaaccacatggtccattcatgcgcaccatcaatggatgaccacagaagacatgctttctgtttggaatcgcgtgtggatcgaggaaaacccctggatggaggataagacccacgtcagctcctggggagacgtgccctacctgggcaaacgggaggaccagtggtgcgggagcctcattggactgacagccagagctacctgggcctctaatatccaggtggccatcaaccaggttcggagactgattggcaatgaaaactatctcgattacatgacgtccatgaagcgcttcaaaaatgagggggaccctgaaggcgctctgtggtga

SEQ ID NO: 19097 - RNA, 9879 nt, synthetic construct
  misc_feature 1..9879: note = derived and/or modified CDS sequence (opt5) from DENV-1__GQ199838__SS-prME
  source 1..9879: mol_type = other RNA
agcgtgaccatgctgctgatgctgatgcccaccgcccttgctttccacctgacgacccggggaggggagcctcatatgatcgtcacaaagcaggaacggggaaagtccctgctgtttaagacctctgccggcgttaacatgtgcacacttattgcgatggacctgggggagctctgtgaagataccatgacatacaagtgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcaccctcgtggatagaggctggggcaatgggtgtggactgtttggcaaagggagccttattacatgcgccaagttcaagtgcgtcacgaaactggagggaaagatcgtgcagtacgaaaacctcaaatattctgttatcgtgaccgtccacacaggcgaccagcatcaagtggggaatgagtccaccgaacacggaacaaccgctacgattacaccccaggcccctacaagcgagatccagctgaccgactacggcgccctgacactcgattgttctccccggaccggcctggactttaacgaaatggttcttctgacgatgaaggagaaatcctggctcgtgcataagcagtggttcctggatcttcctctgccctggacaagcggggcttccacctctcaagagacatggaatcgccaggacctcctggtcacctttaaaaccgcgcacgccaagaagcaggaagtggtcgtgctgggaagccaagagggcgctatgcacacagccctcacgggggccaccgaaattcagacatccggaaccacaaccatcttcgctggccatctgaaatgcagacttaagatggataaactgacgctcaaggggatgagctatgttatgtgtacaggctcttttaaactggagaaggaagtggccgagacccagcacggaaccgtcctggtgcagattaagtacgagggcacagacgcgccgtgcaaaatccctttctccacccaagatgaaaagggggttacacagaacggacggcttatcacggctaatcccattgtgaccgacaaagagaagcctgtcaacatcgaagccgagccgcccttcggcgagagctatattgtgatcggggccggagaaaaagctctcaagctgtcttggtttaagaaaggcagctccattgggaagatgttcgaggccacagctagaggcgcccgccggatggcgatcctgggagataccgcctgggactttggctctatcgggggagtgttcacaagcgttggcaaactcgtccatcagatttttgggaccgcttacggagtgctgttctccggcgtgagctggacgatgaagatcgggattggcgtccttctgacctggctcggactcaattctagatccacaagcctgtctatgacctgtatcgccgtgggccttgttacactctacctgggggtgatggtccaggctgattccggatgcgtgattaactggaaaggccgcgaactgaagtgtgggagcggaatctttgttaccaatgaggtgcacacatggaccgaacaatataagttccaggccgactcccctaaacggctctctgcggccattggcaaggcttgggaggagggggtctgcggcatcagaagcgccacgcgcctggaaaacatcatgtggaaacagatttccaacgagcttaatcatatcctgctcgaaaacggaatgaagtttacagtggttgtgggcgacgtcgtggggattctggctcagggcaagaagatgatccggccgcaacccatggagcacaaatactcttggaaaagctggggcaaggccaagattatcggggccgatgtgcagaataccaccttcatcattgacggacctaacacacccgaatgtcctgatgaccagagagcttggaatatctgggaggtcgaggattatggctttggcattttcaccacgaacatctggctgaaacttcgcgactcctacacacaggtttgcgatcaccggctcatgagcgcggccattaaagactctaaggctgtgcatgccgatatggggtattggatcgaatccgagaaaaatgaaacctggaagctggccagagctagctttatcgaggtgaagacatgtatttggcccaaatctcacaccctgtggtccaacggagtcctcgaaagcgagatgatcattccgaagatctacggcgggcctatttctcaacataattatcgccccggatacttcacacagaccgccggcccttggcacctggggaaacttgagctggacttcgatctctgcgaaggaacgaccgtggttgtggacgagcactgcggcaaccggggccccagcctgagaacaaccacagtcaccgggaagatcatccatgaatggtgttgccggtcctgtacgctgcctccccttcgctttaaaggagaggatggctgctggtacgggatggagattagaccggtgaaggaaaaggaggaaaatctcgttaaaagcatggtgtctgcgggatccggcgaggtcgacagcttctccctggggctgctctgtacatctatcatgattgaagaggtgatgcggagcagatggtcccgcaagatgctgatgaccggaacacttgctgtttttctgctcctgatcatgggccagctgacctggaacgaccttattcggctgtgcatcatggtgggcgccaatgcctctgatagaatggggatgggaaccacatatctcgctctgatggccacgttcaaaatgcgccctatgtttgcggtcggcctcctgttcagacggcttaccagccgcgaggtgctgctcctgacaattgggctgtcccttgtggcttctgtcgaactgcccaacagcctcgaggaactgggagacggcctcgccatggggatcatgatcctgaaacttctgaccgattttcaatcccaccagctctgggccacactgctgagccttaccttcattaaaacgacactgtctctccattacgcttggaagaccatggccatggttctgtccatcgtgagcctctttcccctgtgtctttctaccacatcccagaagaccacatggctgcctgtgctgctcggaagcctgggctgcaaaccgcttacgatgttcctgattgctgagaataagatctggggcagaaaatcttggcccctcaacgaagggattatggccgtcggagtggtttccatcctgctcagctccctgcttaagaacgacgtgcctctggcgggccccctgatcgccgggggaatgctcattgcttgttatgtcatcagcggctctagcgccgatctgtcccttgagaaagctgccgaggtgtcttgggaagaggaagccgagcacagcggggcttcccataatattctggttgaagtgcaggacgatggaaccatgaagatcaaagacgaggagcgggatgacacactcaccattctgctcaaggcgacactgcttgccgtctctggcgtgtaccctctgagcatccccgctaccctgtttgtctggtatttctggcaaaagaaaaagcagcgctccggcgtgctctgggatacgccttctcccccggaagttgagagagccgtgctggacgatgggatctaccggattatgcagcgcggacttctgggcagaagccaggtcggggtgggagtttttcaagaaaacgtgttccacaccatgtggcacgtcacacggggcgccgtgctcatgtatcaggggaaacgcctggagccttcctgggctagcgtgaagaaagacctcatctcttacggaggcggctggagactgcaggggtcctggaataccggagaggaagttcaggtcattgccgtggagcccggcaagaaccctaagaatgtgcaaacagcgcccgggaccttcaaaacaccggaaggagaggtcggcgctatcgcccttgactttaagcctgggacgagcggatctcccattgtgaaccgggaaggcaaaatcgttggcctgtacgggaatggagtggtcaccacatccggcacctatgtgagcgccattgctcaggccaaggcgtcccaggaggggcctctgcccgagatcgaagatgaggttttcagaaaacgcaacctcaccatcatggacctgcatcccggatctggcaagacacggagataccttcctgctattgtgcgcgaagccatcaagcggaaactgagaacgctcattctggccccgacccgcgtcgtggctagcgagatggccgaagctctgaaggggatgcccatccggtatcaaacaaccgccgttaaatccgagcacacaggcaaggagattgtggatctcatgtgccatgcgacctttacgatgagacttctgagccctgtccgcgtgcccaattacaacatgatcatcatggacgaagcccacttcacagatccttcttccattgctgcccggggatatatcagcaccagagtgggcatgggggaggctgccgccatttttatgaccgctacaccccctggatctgtcgaagcgttcccgcagagcaatgccgttatccaggacgaggaacgggatattcccgagcgctcctggaactctggctacgagtggatcaccgactttcctgggaaaacagtgtggttcgtgcccagcatcaagtccggaaatgatattgctaactgtctgagaaagaatggcaaacgggtcatccagctctctcgcaagacctttgacacggaatatcagaagaccaagaacaacgattgggactacgtggttaccacagacattagcgagatgggggccaatttcagagccgatcgggtgatcgaccctagacgctgcctgaaacccgtcattcttaaggatggcccggaacgggtgatcctggctggacctatgcccgttaccgtggcctccgcggctcagagacgcggccggattgggagaaaccataataaggagggagaccagtacatctatatgggccagcccctcaacaatgatgaggaccacgcccactggacggaagccaaaatgctgctggataacatcaatacccctgaggggattatccccgctctctttgaacctgagcgcgaaaagagcgccgcgattgacggagagtaccggcttagaggcgaggcccgcaaaacattcgtcgaactgatgagaagaggggatctgccggtgtggctctcttataaggtcgcttccgagggcttccaatacagcgaccgcagatggtgctttgatggagaacggaacaatcaggtgctggaggaaaacatggacgttgagatctggaccaaagagggcgaacgcaagaaacttagaccccggtggctggatgccagaacatattccgaccctctcgctctgcgcgagttcaaggaatttgccgctgggcggagatctgtgagcggagacctgattctcgagatcggcaaacttccccagcatctgacccagcgcgcccaaaatgcgctggataacctcgtgatgctgcacaattccgaacaagggggacgggcctacagacatgctatggaggagcttcctgacacaatcgaaaccctgatgctcctggccctgattgctgtcctcacgggcggcgttacacttttctttctgtctgggcggggactgggcaaaaccagcatcgggctcctgtgtgtgatggcctccagcgtgcttctgtggatggcctctgtcgagccccactggattgctgcgtccatcattctcgagttctttctgatggtgctgctcatcccggagcctgatcgccagagaacaccccaggacaaccaacttgcctatgttgtgatcggactgctgttcattatcctcacagtcgctgccaatgagatgggcctgcttgaaaccacaaagaaagatctggggattggacacgtggccgtcgagaaccatcaccatgctacgatgctcgacgtggatctgcaccctgccagcgcgtggaccctgtacgccgttgctacaaccatcattacacccatgatgcggcataccatcgaaaacacgaccgccaatatttctctcacagctatcgccaaccaggcggccatccttatgggcctggacaagggctggcctatttccaaaatggatatcggggtgcccctgctcgctctgggatgctacagccaggtcaatccgcttaccctgacagccgctgtgctcatgctggttgcccactatgctattatcggccctgggctgcaagccaaggcgacccgcgaggcccagaagagaacggctgccggaattatgaaaaaccccacagtggacggcatcgtcgctatcgatctcgaccccgtggtgtacgatgccaagtttgaaaaacagcttgggcagattatgctgctgatcctctgtacctctcaaattctgcttatgcggacaacctgggccctgtgcgagagcatcaccctcgcgacaggacctctgacgaccctgtgggagggctccccgggcaagttctggaatacaaccattgctgtttctatggccaacatctttcgcgggagctatctcgctggagccggccttgccttctccctgatgaaaagcctcgggggaggcagacgggggacaggagctcagggcgaaaccctcggcgagaagtggaagcgccagctgaatcagctttccaaatctgaatttaacatctacaagagaagcgggattatggaggtcgaccggtccgaagccaaagagggactgaagagaggcgagacgacacgccacgcggtgtctcgggggaccgccaaactcagatggttcgtggaacgcaatctggtcaagcccgagggaaaggttatcgacctgggctgtgggcggggaggctggagctattactgcgctggcctcaaaaaggtgaccgaagtgaaagggtatacaaagggaggccctgggcatgaggaacccattcctatggccacctacggatggaaccttgtcaaactgcactccggcaaggatgtgttctttacaccccctgagaaatgtgacacgctgctctgcgatatcggggagtctagcccgaatcccaccattgaagagggaagaacactgcgcgttcttaagatggtggaaccttggctgcggggcaaccaattctgtatcaagattctcaatccctacatgccttccgtcgtggagaccctggagcagatgcagagaaaacatggcgggatgctggttcgcaaccccctcagcagaaattctacacacgaaatgtattgggtgtcctgcggaaccggcaacatcgtcagcgctgtgaatatgacgtctagaatgctgcttaaccgctttaccatggcccaccggaagccgacatacgagagagacgtggatctgggggcgggaacccgccatgtcgccgttgaacctgaggtggctaacctcgacatcattggccagagaatcgaaaatattaaacacgagcataagtccacatggcactatgatgaggacaacccctacaaaacctgggcctatcatgggagctacgaagtgaagccctctggatccgctagctccatggtcaatggcgtggttaagctgcttacaaaaccttgggatgtgatccccatggtcacccaaattgccatgacggacacaacccctttcggccagcagcgggtgtttaaggagaaagttgatacccgcacaccgaaggctaaaagagggacggcccaaatcatggaagtgaccgcgcggtggctgtggggattcctcagcagaaacaagaagccccggatctgtacacgcgaggaatttaccagaaaagtccggtctaatgccgctattggcgccgtgttcgttgacgagaaccagtggaatagcgctaaggaggccgtggaagacgagcgcttttgggatctggtccagaaagaaagagagctgcacaagcaggggaaatgcgccacatgcgtgtataacatgatgggaaagcgggaaaagaaactcggcgagttcgggaaggcgaaaggctcccgcgctatctggtacatgtggctgggagccagatttcttgagttcgaagccctgggctttatgaatgaggaccactggttctctcgggaaaacagcctctccggggtcgagggagagggcctgcataaacttgggtacattctgcgcgatatctctaaaattcctggaggcaatatgtatgctgacgataccgccgggtgggacacaagaatcaccgaagatgacctccaaaacgaggctaagatcacggatattatggaacccgagcacgccctgctggcgaccagcatcttcaaactcacataccagaataaggtggttcgggtgcagcgccctgccaagaacggcaccgtcatggacgtgatttccagacgggatcagcgcggatctggccaagtggggacatatggactgaatacctttacgaacatggaagctcagcttatcagacagatggagagcgagggcattttcctgccctccgaactcgagacaccgaacctggccgaacgggttcttgactggctggagaaatacggggtggaaagactcaagcgcatggctatcagcggagatgactgtgtcgtgaaacctatcgacgatcggtttgccaccgcgctgacagccctgaatgacatgggcaaggttagaaaagatattccccagtgggagccttctaaggggtggaacgactggcaacaggtgcccttctgctcccatcactttcaccagctcatcatgaaggatggccgcgagattgtcgtgccttgtcggaatcaggacgaactggtcggacgggctcgcgtgagccaaggcgccgggtggtctcttcgggagaccgcttgcctgggaaaatcctatgcccagatgtggcagctcatgtacttccatagacgcgatctgcggcttgctgccaacgcgatctgtagcgccgttcccgtggactgggtcccgacgtccagaaccacatggtctattcacgctcatcaccaatggatgaccacagaagatatgctgagcgtgtggaatcgcgtttggatcgaggaaaacccttggatggaggacaagacccatgtgtccagctggggcgatgtcccctatctcgggaaacgggaggaccagtggtgcggatctctgattggcctgacagccagagccacctgggcttccaatatccaggtggccatcaaccaggtgcggagactcattgggaatgaaaactacctggactacatgacgagcatgaagcgctttaaaaatgagggcgatcccgaaggagcgctttggtga

SEQ ID NO: 19098 - RNA, 9879 nt, synthetic construct
  misc_feature 1..9879: note = derived and/or modified CDS sequence (opt5) from DENV-1__FJ898396__SS-prME
  source 1..9879: mol_type = other RNA
agcgtgaccatgctgctcatgctgatgcccaccgcccttgctttccacctgacgaccagaggcggggagcctcatatgatcgtgaccaagcaggaacggggaaaatccctcctgtttaagacctctgccggcgttaatatgtgcacccttattgcgatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgctagcctgttccccctctgtctgtctaccacctcccagaagacaacctggcttcctgtgctgctggggagcctcggatgcaaaccgctgacaatgtttcttattacggagaccaagatctggggcagaaaatcttggcccctgaatgaaggcattatggccgtcggggtggtttccatcctcctgagctccctcctgaagaacgatgtgcctcttgcgggacccctgatcgccggcgggatgctgattgcttgttatgtcatcagcggatctagcgccgacctctccctggagaaagctgccgaggtgtcttgggaagaggaagccgagcacagcggcgcttcccataacattcttgttgtggtccaggatgacgggacaatgaagatcaaagatgaggaacgggacgataccctgacaattctcctgaaggcgaccctcctggccgtgtctggagtctaccctcttagcatccccgctacgctgttcgtgtggtatttttggcaaaagaaaaagcagcgctccggcgttctgtgggacaccccttctcccccggaggtggaaagagccgtcctcgatgacggcatctaccggattatgcagcgcgggctgcttggaagaagccaggtgggcgttggggtgttccaagagaatgtcttccacacaatgtggcacgtgacccggggagccgtgctgatgtatcagggcaaacgcctcgaaccttcctgggctagcgttaagaaagacctgatctcttacgggggaggctggagactccagggctcctggaacacaggggaggaggtccaggtgattgccgtggaacccggaaagaatcctaagaacgtccaaaccgcgcccggcacatttaaaacgccggagggggaagtgggagctatcgccctggatttcaagcctggcaccagcgggtctcccattgttaatcgggagggaaaaatcgtgggcctttacggcaacggggtcgtgacaacctccggaacctatgttagcgccattgctcaggccaaggcgtcccaggaaggccctctgcccgagatcgaggacgaagtgtttagaaaacgcaatctgacaatcatggatctccatcccgggtctggaaagacgcggagatacctgcctgctattgtccgcgaggccatcaagcggaaacttagaaccctgattctcgccccgacacgcgtggttgctagcgaaatggccgaggctctgaagggcatgcccatccggtatcaaaccacagccgtgaaatccgaacacaccgggaaggagattgtcgacctgatgtgccatgcgacgttcacaatgagactccttagccctgtgcgcgtgcccaactacaatatgatcatcatggatgaggcccactttaccgacccttcttccattgctgcccggggctatatcagcaccagagtcggaatgggcgaagctgccgccattttcatgacagctacaccccctgggtctgttgaggcgtttccgcagagcaacgccgtgatccaggatgaggaacgggacattcccgaacgctcctggaactctggatacgagtggatcacagatttccctggcaaaaccgtgtggtttgtccccagcatcaagtccgggaacgacattgctaattgtctgagaaagaacggaaaacgggtgatccagctgtctcgcaagacgttcgatacagagtatcagaagaccaagaataacgactgggactacgttgtgacaaccgatattagcgaaatgggcgccaactttagagccgaccgggtcatcgatcctagacgctgcctcaaacccgtgattctgaaggacgggccggagcgggttatccttgctggccctatgcccgtgacggtcgcctccgcggctcagagacgcggacggattggcagaaatcataacaaggaaggggatcagtacatctatatgggacagcccctgaataacgacgaggatcacgcccactggaccgaggccaaaatgctcctggacaatatcaacacacctgaaggcattatccccgctctgttcgagcctgaacgcgaaaagagcgccgcgattgatggggaataccggctcagaggagaggcccgcaaaaccttcgtggagcttatgagacggggcgacctgccggtctggctgtcttataaggtggcttccgaagggtttcaatacagcgatcgcagatggtgcttcgacggcgagcggaataaccaggttctcgaagagaatatggatgtggaaatctggacaaaagagggagagcgcaagaaactgagaccccggtggcttgacgccagaacctattccgaccctctggctctccgcgaatttaaggagttcgccgctggccggagatctgtgagcggggatctgattctggaaatcggaaagctcccccagcatcttacacagcgcgcccaaaacgcgctggacaatctggtcatgctccacaactccgagcagggcgggcgggcctacagacatgctatggaggaactgcctgataccatcgagacgcttatgctgctcgccctgattgctgttctgacaggaggcgtgaccctctttttcctttctggccgggggctgggaaaaaccagcatcggcctgctctgtgtgatggcctccagcgtcctgctttggatggcctctgtggaaccccactggattgctgcgtccatcacactggagtttttcctcatggttctgctgattccggaacctgaccgccagagaacaccccaggataatcaactcgcctatgtggtcatcgggcttctgtttatgatcctgacagtggctgccaacgagatgggactcctggagacgaccaagaaagaccttggcattgggcacgtcgccgtggaaaatcatcaccatgctacaatgctggatgttgacctccaccctgccagcgcgtggaccctgtacgccgtggctacaaccatcattacgcccatgatgcggcataccatcgagaacacaaccgccaacatttctctgacagctatcgccaatcaggcggccattctcatgggacttgataagggctggcctatctccaaaatggacatcggcgtccccctgctggctctcgggtgctacagccaggtgaacccgctgacccttacggccgctgttctgatgctcgtggcccactatgctattatcggacctggcctgcaagccaaggcgacacgcgaagcccagaagagaaccgctgccgggattatgaaaaatcccacagtcgatggaatcgtggctattgacctggatcccgtggtttacgacgccaagttcgagaaacagctcggccagatcatgcttctgatcctgtgtacctctcaaattctcctgatgcggaccacatgggccctttgcgaaagcatcacgctggcgaccgggcctctcacaaccctgtgggagggatccccgggcaagttttggaacacaaccattgctgtctctatggccaatatcttccgcggcagctatctggctggggccggactcgccttttcccttatgaaaagcctgggcgggggaagacggggcacgggggctcagggagagacactgggcgaaaagtggaagcgccagctcaaccagctgtccaaatctgagttcaatatttacaagagaagcggcatcatggaagtggaccggtccgaggccaaagaagggcttaagagaggagagaccacccgccacgcggtgtctcggggcacagccaaactgagatggttcgtcgagcgcaacctcgttaagcccgaagggaaggtgatcgatctgggatgtggcagagggggatggagctattactgcgctggcctgaaaaaggtgaccgaggtcaaaggctatacaaaagggggacctggccatgaggagcccattcctatggccacgtacgggtggaatctcgtgaaacttcactccggaaaggacgtctttttcacaccccctgaaaaatgtgatacactgctgtgcgacatcggcgagtctagcccgaaccccaccattgaggaagggagaacactccgcgtgctgaagatggtcgagccttggcttcggggaaatcaattttgtatcaagattctgaacccctacatgccttccgtggttgaaaccctcgagcagatgcagagaaaacatggcggcatgctggtgcgcaatcccctgagccggaactctacgcacgagatgtattgggtctcctgcgggaccggaaatatcgtgagcgctgtgaacatgacatctagaatgctcctgaatcgcttcaccatggcccaccggaagccgacatacgaaagagatgtcgaccttggcgcggggacccgccatgttgccgtggagcctgaagtggctaacctggatattatcggacagagaatcgagaacattaaacacgaacataagtccacatggcactatgacgaggataatccctacaaaacctgggcctatcatggcagctacgaggtcaagccctctgggtccgctagctccatggtgaacggagttgtgaagctcctgacgaaaccttgggacgtcatccccatggtgacacaaattgccatgaccgataccacaccttttggccagcagcgggttttcaaggaaaaagtggacacgcgcaccccgaaggctaaaagaggcacagcccaaatcatggaggtcaccgcgcggtggctttgggggtttctgagcagaaataagaagccccggatttgtacacgcgaagagttcaccagaaaagtgcggtctaacgccgctatcggagccgtttttgtggacgaaaatcagtggaacagcgctaaggaggccgtcgaggatgaacgcttctgggacctcgtgcagaaagagagagaactgcacaagcagggcaaatgcgccacatgcgtctataatatgatggggaagcgggagaagaaactgggagaatttggcaaggcgaaagggtcccgcgctatctggtacatgtggctcggcgccagattcctggagtttgaggcccttggattcatgaacgaagatcactggttctctcgggagaatagcctgtccggcgtggaaggggagggactccataagctgggctacattcttcgcgacatctctaaaattcctgggggaaacatgtatgctgatgacaccgccggctgggatacgagaatcaccgaggacgatctgcaaaatgaagctaagattacagacatcatggagcccgaacacgccctcctggcgaccagcatctttaaactgacataccagaacaaggttgtgcgggtccagcgccctgccaagaatgggaccgtgatggatgtgatttccagacgggaccagcgcggctctggacaagttggcacgtatgggctcaacacattcaccaatatggaggctcagctgatcagacagatggaaagcgagggaatttttcttccctccgagctggaaacaccgaacctcgccgagcgggtgctggattggcttgaaaaatacggcgtcgagagactgaagcgcatggctatcagcggggacgactgtgtggttaaacctattgatgaccggttcgccaccgcgctcacggccctgaacgatatgggaaaggtgagaaaagacatcccccagtgggaaccttctaagggctggaatgattggcaacaggtccccttttgctcccatcacttccaccagctgatcatgaaggacgggcgcgagattgtggtcccttgtcggaaccaggatgagctcgtgggcagagctcgcgttagccaaggagccggctggtctctgcgggaaaccgcttgccttgggaaatcctatgcccagatgtggcagctgatgtactttcatagacgcgacctccggctggctgccaatgcgatctgtagcgccgtgcccgtcgattgggtgccgacatccagaaccacatggtctattcacgctcatcaccaatggatgaccacagaggacatgcttagcgtttggaaccgcgtgtggatcgaagagaatccttggatggaagataagacccatgtctccagctggggagacgtgccctatctgggcaaacgggaggaccagtggtgcgggtctctcattggactgacggccagagccacatgggcttccaacatccaggtggccattaatcaggttcggagactgatcggcaacgagaattacctcgattacatgaccagcatgaagcgcttcaaaaacgaaggggaccccgagggcgcgctgtggtga

SEQ ID NO: 19099 - RNA, 9879 nt, synthetic construct
  misc_feature 1..9879: note = derived and/or modified CDS sequence (opt5) from DENV-1__GQ199839__SS-prME
  source 1..9879: mol_type = other RNA
agcgtgaccatgctgctgatgctgatgcccaccgcccttgctttccacctgacgaccagaggaggggaacctcatatgatcgtcacaaagcaggaacggggaaagtccctcctgtttaagacctctgccggagttaacatgtgcacccttattgccatggacctgggggagctctgtgaagataccatgacatacaaatgcccccgcatcaccgaggctgaacccgacgatgtggactgttggtgcaatgccacggatacctgggtgacatatggaacctgtagcagaacaggcgagcaccggcgcgacaagagatccgtcgccctggctcctcatgtggggctgggactcgagacccggacggaaacatggatgtctagcgagggcgcctggaaacaaattcagcgcgttgaaacctgggctctgagacaccccggcttcacagtgatcgccctttttctggcgcatgccattgggacctccatcacccagaagggaatcattttcatcctcctgatgcttgtcacaccttctatggctatgcggtgcgtgggcattgggagccgcgattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgagaaaactttgcattgaagcgaagatctctaatacgacaaccgattcccggtgtccgacccagggagaggccacactgatggaagaacaagacgctaacttcgtgtgccgcagaacctttgtggatcggggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaggtggggaatgagtccaccgaacacggaacaaccgctacgattacaccccaagcccctacaagcgagatccagctcaccgactacggcgccctgacactggattgttctccccgcaccggcctcgacttcaacgaaatggttctgcttacgatgaaggagaaatcctggctggtgcataagcagtggtttctcgatctgcctcttccctggacaagcggggcttccacctctcaggagacatggaatagacaagacctgctcgtcaccttcaaaaccgcgcacgccaagaagcaggaagtggtcgtgctgggaagccaggagggcgctatgcacacagccctgacgggggccaccgaaattcaaacatccggaaccacaaccatctttgctggccatctcaaatgccggctgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaggatgaaaagggggttacacaaaacggaagactgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctcgcggcgcccggagaatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctcgctccacaagcctgtctatgacctgtatcgccgtgggcctggttacactttacctcggggtgatggtccaggctgattccggatgcgtgattaactggaaaggccgggaactgaagtgtgggagcggaatcttcgttaccaatgaggtgcacacatggaccgaacagtataagtttcaagccgactcccctaaaagactgtctgcggccattggcaaggcttgggaggagggggtctgcggcatccgcagcgccacgcggctcgaaaacatcatgtggaaacagatttccaacgagctgaatcatatccttctggaaaacggactcaagttcacagtggttgtgggcgacgtcgtggggattctggctcagggcaagaagatgatcagaccgcagcccatggagcacaaatactcttggaaaagctggggcaaggccaagattatcggggccgatgtgcaaaataccacctttatcattgacggacctaacacacccgaatgtcctgatgaccagcgcgcttggaatatctgggaggtcgaggattatggcttcggcatttttaccacgaacatctggctgaaacttcgggactcctacacacaggtttgcgatcacagactcatgagcgcggccattaaagactctaaggctgtgcatgccgatatggggtattggatcgaatccgagaaaaatgaaacctggaagctggcccgcgctagcttcatcgaggtgaagacatgtatttggcccaaatctcacaccctgtggtccaacggagtcctcgaaagcgagatgatcattccgaagatctacggcgggcctatttctcagcataattatcggcccggatacttcacacaaaccgccggcccttggcacctggggaaacttgagctggactttgatctctgcgaaggaacgaccgtggttgtggacgagcactgcggcaacagaggccccagcctgcggacaaccacagtcaccgggaagatcatccatgaatggtgttgccgctcctgtacgctgcctccccttagattcaaaggagaggatggctgctggtacgggatggagattcggccggtgaaggaaaaggaggaaaatctcgttaaaagcatggtgtctgcgggatccggcgaggtcgacagcttttccctggggctgctctgtacatctatcatgattgaagaggtgatgagaagccgctggtcccggaagatgctgatgaccggaacacttgctgttttcctgctcctgatcatgggccagctgacctggaacgaccttattagactgtgcatcatggtgggcgccaatgcctctgatcgcatggggatgggaaccacatatctcgctctgatggccacgtttaaaatgagacctatgttcgcggtcggcctcctgtttcggcgccttaccagcagagaggtgctgctcctgacaattgggctgtcccttgtggcttctgtcgaactgcccaacagcctcgaggaactgggagacggcctcgccatggggatcatgatcctgaaacttctgaccgatttccagtcccaccaactctgggccacactgctgagccttacctttattaaaacgacactgtctctccattacgcttggaagaccatggccatggttctgtccatcgtgagcctcttccccctgtgtctttctaccacatcccagaagaccacatggctgcctgtgctgctcggaagcctgggctgcaaaccgcttacgatgtttctgattgctgagaataagatctggggccggaaatcttggcccctcaacgaagggattatggccgtcggagtggtttccatcctgctcagctccctgcttaagaacgacgtgcctctggcgggccccctgatcgccgggggaatgctcattgcttgttatgtcatcagcggctctagcgccgatctgtcccttgagaaagctgccgaggtgtcttgggaagaggaagccgagcacagcggggcttcccataatattttcgttgaagtgcaggacgatggaaccatgaagatcaaagacgaggagcgcgatgacacactgaccattctcctgaaggcgacactcctggccgtctctggcgtgtaccctcttagcatccccgctaccctgtttgtctggtatttctggcagaagaaaaagcaaagatccggcgtgctgtgggatacgccttctcccccggaagttgagcgggccgccctcgacgatgggatctaccgcattatgcagagaggactgcttggccggagccaggtgggggtcggagtgttccaggaaaacgtttttcacaccatgtggcacgtgacacgcggcgctgtcctgatgtatcaagggaaaagactcgagccttcctgggccagcgtgaagaaagacctgatctcttacggaggcggctggcggctccaggggtcctggaataccggagaggaagtgcaggttattgcggtcgagcccggcaagaaccctaagaatgtgcagacagctcccgggaccttcaaaacaccggaaggagaggtgggcgccatcgccctggactttaagcctgggacgagcggatctcccattgtcaacagagaaggcaaaatcgtgggcctttacgggaatggagttgtgaccacatccggcacctatgtcagcgctattgcccaaaccaaggcgtcccaggaggggcctctgcccgagatcgaagatgaggtgttccgcaaacggaacctgacaatcatggacctccatcccggatctggcaagacgagacgctacctgcctgctattgttcgggaagccatcaagagaaaacttcgcaccctgattctcgccccgacacgggtggtcgctagcgagatggccgaagctctgaaggggatgcccatcagatatcagaccacagccgtgaaatccgagcacaccggcaaggagattgttgatctgatgtgccatgcgacgtttacaatgcgcctccttagccctgtgcgggtccccaattacaacatgatcatcatggacgaagcccacttcaccgatccttcttccattgctgccagaggatatatcagcacccgggtgggcatgggggaggctgccgccatttttatgacagctacaccccctggatctgtggaagcgttcccgcaaagcaatgccgtcatccaggacgaggaacgcgatattcccgagagatcctggaactctggctacgagtggatcacagactttcctgggaaaaccgtttggttcgtgcccagcatcaagtccggaaatgatattgctaactgtctgcggaagaatggcaaacgcgtgatccagctgtctagaaagacgtttgacacagaatatcagaaaaccaagaacaacgattgggactacgtcgtgacaaccgacattagcgagatgggggccaatttccgggccgatagagttatcgaccctcgccggtgcctcaaacccgtgattctgaaggatggcccggaaagagtcatccttgctggacctatgcccgtgacggttgcctccgcggctcaacgccggggcagaattgggcgcaaccataataaggagggagaccagtacatctatatgggccagcccctgaacaatgatgaggaccacgcccactggaccgaagccaaaatgctcctggataacatcaatacacctgaggggattatccccgctctgttcgaacctgagcgggaaaagagcgccgcgattgacggagagtacagactccgcggcgaggccagaaaaacctttgtggaacttatgcggcgcggggatctgccggtctggctgtcttataaggtggcttccgagggcttccagtacagcgacagacggtggtgctttgatggagaacgcaacaatcaagtcctcgaggaaaacatggacgtggagatctggacaaaagagggcgaaagaaagaaactgcggcccagatggcttgatgcccgcacctattccgaccctctggctctccgggagttcaaggaatttgccgctgggagacgctctgttagcggagacctgattctggagatcggcaagctcccccagcatcttacacagcgggcccagaatgcgctggataacctggtgatgctccacaattccgaacaagggggcagagcctaccggcatgctatggaggagctgcctgacaccatcgaaacgcttatgctgctcgccctgattgctgtgctgacaggcggcgtcaccctcttctttctttctgggcgcggactgggcaaaaccagcatcgggctgctctgtgttatggcctccagcgtgctgctttggatggcctctgtggagccccactggattgctgcgtccatcattctggagttctttctcatggtcctgctgatcccggagcctgatagacagcggacaccccaggacaaccagctcgcctatgtggttatcggacttctgttcattatcctgaccgtggctgccaatgagatgggcctcctggaaacaacgaagaaagatcttgggattggacacgtcgccgtggagaaccatcaccatgctaccatgctggacgtcgatctccaccctgccagcgcgtggacactgtacgccgtggctaccacaatcattacccccatgatgcgccatacgatcgaaaacaccacagccaatatttctctgaccgctatcgccaaccaagcggccatcctcatgggccttgacaagggctggcctatttccaaaatggatatcggggttcccctgctggctctcggatgctacagccaggtgaatccgctgacacttaccgccgctgtcctgatgctcgtggcccactatgctattatcggccctgggctgcaggccaaggcgacgagagaggcccaaaagcggacagctgccggaattatgaaaaaccccaccgttgacggcatcgtggctatcgatctggaccccgtcgtgtacgatgccaagtttgaaaaacagctcgggcagattatgcttctgatcctgtgtacatctcagattctcctgatgcgcaccacctgggccctttgcgagagcatcacactggcgacgggacctctcaccacactgtgggagggctccccgggcaagttctggaataccacaattgctgtgtctatggccaacatctttagagggagctatctggctggagccggcctcgccttctcccttatgaaaagcctcgggggaggccggcgcgggaccggagctcaaggcgaaacgctgggcgagaagtggaagagacagctcaatcagctgtccaaatctgagttcaacatctacaagcggagcgggattatggaggttgacagatccgaagccaaagagggacttaagcgcggcgagacaacccggcacgcggtctctagagggaccgccaaactgcgctggtttgtggaacggaatctcgtgaagcccgagggaaaggtcatcgacctgggctgtgggagaggaggctggagctattactgcgctggcctgaaaaaggttacagaagtgaaagggtataccaagggaggccctgggcatgaggaacccattcctatggccacatacggatggaacctcgtgaaacttcactccggcaaggatgtcttctttacgccccctgagaaatgtgacaccctgctgtgcgatatcggggagtctagcccgaatcccacaattgaagagggacgcaccctccgggtgctgaagatggttgaaccttggcttagaggcaaccagttctgtatcaagattctgaatccctacatgccttccgtggtcgagacactcgagcaaatgcagcgcaaacatggcgggatgctggtgcggaaccccctgagcagaaattctacccacgaaatgtattgggtttcctgcggaacgggcaacatcgtgagcgctgtcaatatgacctctcgcatgctcctgaaccggtttacaatggcccacagaaagccgacctacgagcgcgacgtggatcttggggcgggaacaagacatgtggccgtcgaacctgaggttgctaacctggacatcattggccagcggatcgaaaatattaaacacgagcataagtccacctggcactatgatgaggacaacccctacaaaacatgggcctatcatgggagctacgaagtgaagccctctggatccgctagctccatggtgaatggcgtcgtgaagctcctgaccaaaccttgggatgttatccccatggtgacgcagattgccatgacagacaccacccctttcggccaacagcgcgtctttaaggagaaagtggatacaagaacgccgaaggctaaacgggggaccgcccagatcatggaagttacagcgagatggctttggggattcctgagccggaacaagaagccccgcatctgtaccagagaggaatttacacggaaagtgcgctctaatgccgctattggcgccgtcttcgtggacgagaaccaatggaatagcgctaaggaggccgttgaagacgagagattttgggatctcgtgcagaaagaacgggagctgcacaagcaggggaaatgcgcgacctgcgtctataacatgatgggaaagcgcgaaaagaaactgggcgagttcgggaaggcgaaaggctccagagctatctggtacatgtggctcggagcccggtttctggagttcgaagcccttggcttcatgaatgaggaccactggttttctcgcgaaaacagcctgtccggggtggagggagagggcctccataagctggggtacattcttagagatatctctaaaattcctggaggcaatatgtatgctgacgatacagccgggtgggacacccggatcacggaagatgacctgcagaacgaggctaagatcaccgatattatggaacccgagcacgccctcctggcgacaagcatcttcaaactgacctaccaaaataaggtcgtgcgcgttcagagacctgccaagaacggcacagtgatggacgtcatttcccggcgcgatcagagaggatctggccaggtggggacctatggactcaatacgtttacaaacatggaagctcaactgatccggcagatggagagcgagggcattttccttccctccgaactggagaccccgaacctcgccgaaagagtgctggactggcttgagaaatacggggttgaacgcctgaagcggatggctatcagcggagatgactgtgtggtcaaacctatcgacgatagatttgccacagcgctcaccgccctgaatgacatgggcaaggtgcgcaaagatattccccagtgggagccttctaaggggtggaacgactggcagcaagttcccttctgctcccatcactttcaccagctgatcatgaaggatggccgggagattgtggtcccttgtagaaatcaggacgaactcgtgggacgcgctcgggtcagccagggcgccgggtggtctctgagagagacggcttgccttggaaaatcctatgcccaaatgtggcagctgatgtacttccatcgccgggatctcagactggctgccaacgcgatctgtagcgccgtgcccgttgactgggtgccgacctcccgcacaacctggtctattcacgctcatcaccagtggatgacaaccgaagatatgcttagcgtctggaatcgggtgtggatcgaggaaaacccttggatggaggacaagacacatgtttccagctggggcgatgtgccctatctggggaaaagagaggaccaatggtgcggatctctcattggcctgaccgcccgggccacgtgggcttccaatatccaggtcgccatcaaccaggtgagacgcctgattgggaatgaaaactacctcgactacatgacaagcatgaagcggtttaaaaatgagggcgatcccgaaggagcgctgtggtga

SEQ ID NO: 19100 - RNA, 9879 nt, synthetic construct
  misc_feature 1..9879: note = derived and/or modified CDS sequence (opt5) from DENV-1__FJ898397__SS-prME
  source 1..9879: mol_type = other RNA
agcgtgaccatgctgctgatgctgatgcccacagcccttgctttccacctgacgatcagaggcggggaacctcatatgattgtctccaagcaggaacggggaaaatctctcctgtttaagaccagcgccggcgttaacatgtgcacacttatcgcgatggacctgggggagttctgtgaagataccatgacatacaaatgcccgagaattaccgaggctgaacccgacgatgtggactgttggtgcaatgccacagatacctgggtgacgtatggaacctgttcccaaacaggcgagcacagacgggacaagcgctctgttgccctcgctcctcatgtggggctgggactggagaccagaacagaaacctggatgagctccgagggcgcctggaaacagatccagcgggttgaaacgtgggctctccgccaccccggctttacagtgattgccctgttccttgcgcatgccatcgggacctctatcacacagaagggaattatctttattctgctcatgctggtcacccctagcatggctatgagatgcgtgggcatcgggtcccgggatttcgttgagggacttagcggcgccacctgggtggacgtcgtgctggagcacgggtcttgtgtgacaacgatggctaaggataaacccaccctcgacattgaactgctgaagacagaggtcaccaaccctgccgttctccgcaaactgtgcatcgaagcgaagatttccaatacaaccacggatagcagatgtccgacacaaggagaggccacccttgtggaagaacaagacgctaactttgtgtgccggcgcaccttcgtcgatagaggctggggcaatgggtgtggactgtttggcaaagggtctctcatcacatgcgccaagttcaagtgcgtgaccaaactggagggaaagatcgttcagtacgaaaaccttaaatattccgtgattgtcacagtgcacacgggcgaccagcatcaagttgggaatgagagcaccgaacacggaacaaccgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgcaaagaccttctggtgacctttaagacagcgcacgccaagaaacaggaagtcgtggttctcggatcccaggagggcgctatgcacaccgccctgaccggggccacagaaatccaaacgagcggaaccacaaccattttcgctggccatctgaagtgcagactcaaaatggataagctgacacttaaagggatgtcttatgtgatgtgtaccggctccttcaagctggagaaggaagtcgccgagacgcagcacggaacagtgctcgttcagatcaaatacgagggcaccgacgcgccgtgcaagatcccttttagcacccaggatgaaaaaggggtgacacaaaacggacggctgattaccgctaatcccatcgtcacagacaaggagaaacctgtgaacattgaagccgagccgcccttcggcgagtcttatatcgtgattggggccggagaaaaggctctgaaacttagctggtttaaaaagggctcctctatcgggaaaatgttcgaggccacggctagaggcgcccgccggatggcgatcctcggagataccgcctgggactttggcagcattgggggagttttcacatccgtcggcaagctggtgcatcagatctttgggaccgcttacggagtgctgttcagcggcgtctcttggacaatgaaaattgggatcggcgtgctcctgacctggcttggactcaattccagaagcacgtctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcatcagatccgccacacgcctggaaaacattatgtggaagcagatctctaacgagctcaatcatattctgcttgaaaacgacatgaaatttaccgttgtggtcggagatgtggctggcatcctggcccaggggaagaaaatgattcggccgcagcccatggagtacaagtatagctggaagtcctggggaaaagccaagatcatcggcgctgacgtgcaaaatacgacattcattatcgatgggcctaacacccccgaatgtcctgacgatcagagagcgtggaatatttgggaggtcgaggactacggatttggcatcttcaccacaaacatttggctcaaactgcgcgatagctatacccaggtttgcgaccaccggctgatgtctgccgctatcaaggattccaaagccgtgcacgccgacatgggctactggatcgaaagcgagaagaatgaaacgtggaaacttgctagagcctctttcattgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacaaccgtggttgtggatgagcactgcggaaaccggggcccctccctgagaacgaccacagtcaccggcaaaatcattcacgaatggtgttgccggagctgtacactccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgaccgggacgctcgccgtctttttcctgcttatcatgggacagctgacatggaacgatctcattcggctgtgcatcatggtgggcgccaatgctagcgacagaatgggcatggggaccacatacctggcccttatggcgacctttaagatgcgccctatgttcgctgtcggactgctctttagacggctgacctcccgcgaggtgctcctgcttacaatcggcctgtctctcgtggccagcgtcgaactgcccaactccctggaggaacttggggatggactggccatgggcattatgatcctcaaactgctcacggacttccagagccatcaactgtgggctacccttctgtctctcacatttattaagaccacattctccctgcactatgcctggaagaccatggctatggttctgagcatcgtgtctctttttcccctgtgtctctccacgacaagccagaaaaccacctggctgcctgtgctcctggggtctcttggatgcaagccgctgacaatgttcctgattgccgagaataaaatctggggcagaaagtcctggcccctcaacgaaggcatcatggcggtcgggattgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggaccatgaaaatcaaggatgaggagcgggacgatacactcacgattctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacaatgtggcacgtgacccggggagctgtcctcatgtaccaaggcaagcgcctggagcccagctgggcctctgtgaaaaaggaccttatttcctacgggggaggctggagactgcagggcagctggaatacgggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagatcgtgggcctgtatggcaatggggttgtgaccacatccggaacgtacgtctctgctattgcccaagcgaaagctagccaggagggccccctccctgagatcgaagacgaggtgttcagaaagcgcaacctgaccattatggatcttcaccccgggtccggaaagacacggagatatctgcccgccatcgttcgcgaagccattaaacggaagctgagaaccctcatcctggctcctacccgcgtggtcgccagcgagatggctgaagcccttaaaggcatgccgatccggtaccagacaacggcggtgaagtctgagcataccgggaaagagattgttgacctgatgtgccacgccacatttaccatgagactcctgtcccccgtgcgcgtccctaattataacatgatcattatggatgaagctcatttcacagaccccagctctatcgccgctcggggctacattagcaccagagtgggaatgggcgaggccgccgctatctttatgacggcgacacctcccgggtccgtggaagccttccctcaatctaatgctgtcatccaggatgaggaacgggacattccggagcgcagctggaactccggatatgagtggatcaccgattttcccggcaagaccgtttggttcgtgccttctattaagagcgggaatgacatcgccaactgtctgcgcaagaatggaaagcgggtgattcagctctcccgcaaaacattcgataccgaataccagaagaccaagaataacgactgggactacgtcgtgaccacggatatcagcgagatgggcgccaattttagagctgaccgggttattgatcccagacgctgccttaagcctgtgatcctgaaggacgggcccgaacgggtcatcctggccggcccgatgcctgtgacagttgcgtctgctgcccaaagacgcggacggattggcagaaaccacaataaagagggggatcagtatatctacatgggacagcccctcaacaatgacgaggatcatgcccactggaccgaagctaagatgctgcttgacaacattaatacacccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatctggacgaaggagggagaacgcaaaaagctgagaccgcggtggctggacgctagaacctacagcgaccccctcgccctgcgcgagttcaaggaatttgctgccggccggagatccgtttctggggatcttattctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacactcttctttctgtccggccgggggctgggaaagaccagcattggcctcctttgtgttatggcctcttccgtgctgctgtggatggctagcgtggagcctcattggatcgcggcctctatcattctcgagttctttctgatggtccttctgatccccgagccggaccgccagagaacgcctcaggataaccagctcgcttacgtggttattgggctgctgttcatgatcctcacagtggccgccaatgagatgggacttctggaaaccaccaaaaaggacctgggcattgggcacgtcgctgtggagaaccaccatcacgccgcgatgctcgatgtcgacctgcatcccgcctccgcttggacactttacgccgtggctaccacaatcattacgcctatgatgcggcacaccatcgaaaacacaaccgccaatatcagcctgacagcgattgccaaccaagctgccatcctcatgggactggataaaggctggcccatttctaagatggacatcggcgttcctctgctcgctcttgggtgctatagccaggtgaatcccctgaccctgacggccgctgtcctcatgctggtggcccattacgcgattatcggaccgggccttcaggccaaggctacccgcgaggcccagaagagaacagctgccgggatcatgaagaaccctaccgttgatggaattgtggccatcgacctggatcccgtcgtgtatgacgcgaaatttgaaaagcagctcggccagattatgctgctgatcctctgtacatcccagattcttctgatgcggaccacgtgggctctgtgcgagtctatcacactcgccaccgggcccctgacaaccctttgggagggaagccctggcaaattctggaataccacaatcgctgtgtccatggccaacattttccgcggcagctacctggccggggctggactcgccttttccctgatgaagtctctgggcgggggaagacggggcacgggggcgcaaggagaaaccctcggcgagaagtggaaacgccagcttaatcagctgagcaagtccgagttcaacacatataaaagatctggcatcatggaggttgaccggagcgaagccaaggaggggctgaaaagaggagagaccacaaagcacgctgtctcccgcggcaccgccaagctccggtggtttgtggaaagaaatctggtgaaaccggaggggaaggtcattgatcttggatgtggccgcgggggatggtcttactattgcgctggcctgaaaaaggttacggaagtgaaaggctacacaaaagggggacccggccacgaggaacctatccccatggccacctacgggtggaacctcgtgaaactgcatagcggaaaggacgtcttctttattcctcccgagaagtgtgataccctgctctgcgacatcggcgagtccagccctaatccgacaattgaagaggggcggacccttagagtgctgaaaatggttgaaccctggctgcgcggaaaccagttctgtatcaagatcctcaatccttatatgccctctgtggtcgagacactggagcaaatgcagcggaaacacggcggcatgcttgtgagaaaccctctgtcccgcaatagcacgcatgaaatgtactgggtttcttgcgggaccggaaacattgtgtccgcggtcaatatgacaagccggatgctcctgaacagatttaccatggcccaccgcaagcccacatatgagcgggatgtggacctgggcgctgggaccagacacgtggccgtcgaaccggaggttgctaacctcgatatcattggacagcgcatcgaaaatattaaacatgagcacaagtctacgtggcattacgacgaggataacccttataagacctgggcctaccacggctcctatgaagtgaaacccagcgggtccgctagctctatggtgaatggagtcgtgaagctgcttacaaaaccctgggacgttatccctatggtgacccagatcgccatgacagataccacacccttcggccaacagagagtctttaaggagaaagtggacacccggacgcctaaggcgaagcgcggcacagcccagattatggaagttaccgctaaatggctgtgggggttcctcagcagaaacaagaaaccgcggatctgtaccagagaggaatttacacggaaggtgcgctccaatgccgctattggagccgtcttcgtggacgagaaccaatggaactctgccaaagaggcggttgaagatgagagattttgggacctggtgcatcgggaacgcgagcttcacaagcagggcaagtgcgctacgtgcgtctacaacatgatggggaaaagagaaaagaaactgggagagttcggcaaggccaaagggagccgggccatctggtacatgtggctcggcgctcgcttcctggagtttgaagccctgggattcatgaatgaggatcactggttttccagagaaaactctctcagcggcgtggagggggagggactgcataaacttggctatattctgcgggacatctccaaaatccccgggggaaatatgtacgctgatgacaccgccggctgggatacacgcattaccgaagacgatctccagaacgaggcgaagatcacagacattatggaacctgagcacgccctgcttgctacctctatcttcaagctgacatatcagaataaagtcgtgagagttcaacggcccgccaagaacgggaccgtgatggatgtcattagccgcagagaccagcggggctccggacaggtgggcacgtacgggctcaatacctttacaaacatggaagctcagctgatccgccaaatggagagcgagggaatcttctctccttccgaactggagacccccaacctcgccggcagagtgctggattggcttgaaaaacatggggttgagcggctgaagagaatggcgattagcggagacgactgtgtggtcaaaccgatcgatgaccgctttgccacagctctcaccgccctgaatgatatgggcaaggtgcggaaggacattcctcagtgggaaccctctaaagggtggaacgattggcagcaggttcctttctgctcccaccactttcatcaacttatcatgaaggacggcagagagattgtggtcccctgtcgcaatcaggatgagctggtgggacgggctagagtcagccagggcgccgggtggtccctccgcgaaacggcttgcctgggaaaatcttatgcccagatgtggcaactgatgtacttccaccggagagacctccgcctggcggccaacgctatctgtagcgccgtgcctgttgattgggtgcccacatcccggaccacatggagcattcatgcccaccatcagtggatgaccacggaggacatgctttctgtctggaatagagtgtggatcgaagagaacccgtggatggaagataagacccacatctccagctggggcgacgttccttatctggggaaacgcgaggaccagtggtgcggatctctcattggcctgacagctcgggccacctgggcgacaaatatccaagtggctattaaccaggtcagacggcttatcgggaatgagaactacctggattacatgaccagcatgaagagatttaagaatgaatccgaccccgagggcgccctctggtga

SEQ ID NO: 19101 - RNA, 9879 nt, synthetic construct
  misc_feature 1..9879: note = derived and/or modified CDS sequence (opt5) from DENV-1__FJ898398__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactgaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagatttggggaaaggccaaaatcatcggcgctgacgtgcagaatacaacctttattatcgatgggcctaacacccccgaatgtcctgacgatcagagagcgtggaatatttgggaggtcgaggactacggattcggcatctttacaaccaacatttggctgaagctgcgcgattcctatacgcaggtttgcgaccaccggcttatgagcgccgctatcaaagattctaaggccgtgcacgccgacatgggctactggatcgaatccgagaaaaatgaaacatggaagctcgctagagccagcttcattgaggtgaagacctgtatctggcccaaatctcatacactgtggtccaacggggtcctggaaagcgagatgattatcccgaagatttatggaggccctatctctcaacacaattaccgccccgggtacttcacccagacagcgggaccttggcatctcggcaaactggagcttgattttgacctgtgcgaagggaccacggtggttgtggatgagcactgcggaaaccggggccccagcctcagaaccacaaccgtcacaggcaagatcattcacgaatggtgttgccggtcctgtaccctgcctcccctgcgcttcaaaggggaggacggatgctggtatggcatggagatcagaccggtgaaggaaaaggaggaaaatcttgttaaaagcatggtgtctgctgggtccggagaggtcgacagcttttccctcggcctgctgtgtatttctatcatgattgaagaggtgatgcggagcagatggtcccgcaagatgctcatgacggggacactggccgttttctttcttctgatcatgggacagctcacctggaacgatctgattcggctgtgcatcatggtgggcgccaatgcttctgacagaatgggcatggggacaacctaccttgccctgatggcgaccttcaaaatgcgccctatgtttgctgtcggactcctgttcagacggctcacaagccgcgaggtgctgcttctgacgatcggcctctccctggtggcctctgtcgaactgcccaacagccttgaggaactgggggatggactcgccatgggcattatgatcctgaagctcctgaccgactttcaatcccatcagctttgggctacactgctcagcctgaccttcattagaacaaccttttctctgcactatgcctggaaaacgatggctatggttctttccatcgtgagcctgttccccctctgtctgtctacaacctcccagaagaccacatggctccctgtgctgcttgggagcctgggatgcaagccgctgaccatgtttctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacaatgaaaatcaaggatgaggagcgcgacgatacgctgaccattcttctgaaagccacactcctggctgtgtctggagtctatcctctcagcatccccgccaccctgttcgtgtggtacttctggcaaaagaagaaacagagatccggcgtcctttgggacacaccttctcccccggaagtggagcgggccgttctggatgacggcatttatcgcatcatgcagagagggctgctcggacggagccaggtgggcgtcggggtgtttcaagaaaacgttttccataccatgtggcacgtgacgcgcggagctgtcctgatgtaccagggcaagagacttgagccttcctgggccagcgtgaaaaaggacctgatttcttacgggggaggctggcggctccagggctcctggaataccggggaggaagtgcaggttatcgcggtcgagcccggaaaaaaccctaagaatgtgcaaacagctcccggcacctttaagacaagcgaaggggaggtgggagccattgccctggatttcaaaccgggcacctctgggtcccctatcgtcaacagagaaggaaagatcgtgggcctctatggcaatggggttgtgacaacgagcggaacctacgtctccgctattgcccaggcgaaagcttctcaggagggccccctgcctgagatcgaagacgaggtgtttcgcaagcggaaccttacaattatggatctgcaccccgggagcggaaaaaccagacgctatctgcccgccatcgttcgggaagccattaagagacgcctccggaccctgatccttgctcctacaagagtggtcgcctccgagatggctgaagccctgaagggcatgccgatccgctaccaaacgaccgcggtgaaaagcgagcatacagggaaggagattgttgacctcatgtgccacgccaccttcacaatgcggctgctgtctcccgtgagagtccctaattataacatgatcattatggatgaagctcattttaccgacccctccagcatcgccgctcggggctacatttctacgcgcgtgggaatgggcgaggccgccgctatcttcatgacagcgacccctcccgggagcgtggaagcctttcctcagtccaatgctgtcatccaggatgaggaaagagacattccggagcggtcttggaacagcggatatgagtggatcaccgatttccccggcaaaacagtttggtttgtgccttccattaagtctgggaatgacatcgccaactgtctccgcaaaaatggaaagagagtgattcagcttagccggaagaccttcgatacagaataccaaaaaaccaagaacaacgactgggactacgtcgtgacgacagatatctccgagatgggcgccaatttcagagctgaccgcgttattgatccccggagatgcctgaaacctgtgatcctgaaggacgggcccgaacgcgtcatcctcgccggcccgatgcctgtgaccgttgcgagcgctgcccagcggagaggacgcattggccggaaccacaataaagagggggatcagtatatctacatgggacagcccctgaacaatgacgaggatcatgcccactggacagaagctaagatgcttctggacaacattaatacccccgagggcatcattcctgccctctttgaacccgagagagaaaagtctgcggccatcgatggggagtatcgcctgagaggagaggctcggaaaacgttcgtggaactgatgcgcagaggcgacctccctgtctggctttcctacaaggtggccagcgaggggtttcaatattccgatcggcgctggtgcttcgacggcgaaagaaacaatcaggtcctggaggaatctatggatgtggagatctggaccaaagagggagaacggaagaaactgagaccgcgctggctcgacgctcggacatacagcgaccccctggcccttagagagtttaaggaattcgctgccggccgccggtccgtttctggggatctgattctcgagatcggaaaactgcctcagcacctgacccagagagcgcaaaacgccctcgacaatcttgtgatgctgcataacagcgaacagggcgggcgggcttatcgccacgccatggaggagctgcccgatacaattgaaaccctcatgctgcttgctctgatcgccgtgctcacaggaggcgtcaccctgtttttcctgtccggcagagggctcggaaagacgagcattggccttctgtgtgttatggcctcttccgtgctgctctggatggctagcgtggagcctcattggatcgcggcctctatcattctggaatttttccttatggtcctgctcatccccgagccggaccggcagcgcacacctcaggataatcaactggcttacgtggttattgggctgctctttatgatccttaccgtggccgccaacgagatgggactgctggaaaccacaaagaaagacctcggcattgggcacgtcgctgtggagaatcaccatcacgccgcgatgctggatgtcgaccttcatcccgcctccgcttggaccctgtacgccgtggctacaacgatcattacccctatgatgagacacacaatcgaaaacaccacagccaacatcagcctcaccgcgattgccaatcaggctgccatcctgatgggactggataagggctggcccatttctaaaatggacatcggcgttcctctccttgctctggggtgctatagccaggtgaaccccctgacgctcaccgccgctgtcctgatgcttgtggcccattacgcgattatcggaccgggcctgcaagccaaggctacacgggaggcccagaaacgcaccgctgccgggatcatgaagaatcctacagttgatggaattgtggccatcgacctcgatcccgtcgtgtatgacgcgaagttcgaaaaacagctgggccagattatgctgctcatcctttgtacctcccaaattctgctgatgagaacgacatgggctctctgcgagtctatcaccctggccacagggccccttaccaccctgtgggagggaagccctggcaagttttggaacacaacgatcgctgtgtccatggccaatattttccggggcagctacctcgccggggctggactggccttctccctgatgaaatctctcggcgggggacgcagaggcaccggggcgcagggagaaacacttggcgagaagtggaaacggcagctgaaccagctgagcaagtccgaatttaatacctataagagatctggcatcatggaggttgaccgcagcgaagccaaagaggggctcaagcggggagagacaaccaaacacgctgtctccagaggcacggccaagctgcgctggttcgtggaacggaaccttgtgaaaccggaggggaaggtcattgatctgggatgtggcagagggggatggtcttactattgcgctggcctcaagaaagttacagaagtgaagggctacaccaaagggggacccggccacgaggaacctatccccatggccacctacgggtggaatctggtgaagctgcatagcggaaaagacgtctttttcattcctcccgagaagtgtgatacactcctttgcgacatcggcgagtccagccctaacccgaccattgaagaggggcgcacactgcgggtgctgaaaatggttgaaccctggctcagaggaaatcaattttgtatcaagatcctgaacccttatatgccctctgtggtcgagacgcttgagcagatgcagcgcaagcacggcggcatgctggtgcggaatcctctctccagaaacagcacccatgaaatgtactgggtttcttgcgggacaggaaatattgtgtccgcggtcaacatgaccagccgcatgctgctgaatcggttcacaatggcccacagaaaacccacctatgagcgcgatgtggacctcggcgctgggacgagacacgtggccgtcgaaccggaggttgctaacctggatatcattggacagcggatcgaaaacattaagcatgagcacaaatctacctggcattacgacgaggataatccttataagacatgggcctaccacggctcctatgaagtgaaacccagcgggtccgctagctctatggtgaacggagtcgtgaagcttctgaccaagccctgggacgttatccctatggtgacacaaatcgccatgaccgatacaaccccctttggccagcagcgcgtcttcaaagagaaggtggacacgagaacacctaaagcgaagcggggcaccgcccaaattatggaagttaccgctaaatggctctgggggtttctgagcagaaataagaagccgcggatctgtacacgcgaggaattcacgagaaaagtgcggtccaacgccgctattggagccgtctttgtggacgagaatcagtggaactctgccaaggaggcggttgaagatgagcgcttctgggaccttgtgcatagagaacgggagctgcacaaacagggcaagtgcgctacctgcgtctacaatatgatggggaaacgcgaaaagaagctcggagagtttggcaaagccaaggggagcagagccatctggtacatgtggctgggcgctcggttcctggagttcgaagccctcggatttatgaacgaggatcactggttctcccgcgaaaattctctgagcggcgtggagggggagggacttcataaactgggctatattctcagagacatctccaagatccccgggggaaacatgtacgctgatgacacagccggctgggatacccggattacagaagacgatctgcagaatgaggcgaaaatcaccgacattatggaacctgagcacgcccttctggctaagtctatctttaaactcacatatcaaaacaaggtcgtgcgcgttcagagacccgccaagaatgggaccgtgatggatgtcattagccggcgcgaccagagaggctccggacaggtgggcacgtacgggctgaacaccttcacaaatatggaagctcaactgatccggcagatggagagcgagggaatcttttctccttccgaactcgagacccccaacctggccggcagagtgcttaactggctggaaaaacatggggttgagcgcctcaagcggatggcgattagcggagatgactgtgtggtcaaaccgatcgacgatagattcgccacagctctgaccgcccttaatgacatgggcaaggtgcgcaaagatattcctcagtgggaaccctctaaggggtggaacgactggcagcaagttcctttttgctcccaccacttccatcagctgatcatgaaggatggccgggagattgtggtcccctgtagaaatcaggacgagctcgtgggacgcgctcgggtcagccagggcgccgggtggtccctgagagaaacggcttgcctgggaaaatcttatgcccaaatgtggcagctcatgtactttcaccgccgggatctgagacttgcggccaacgctatctgtagcgccgtgcctgttgactgggtgcccacatcccgcaccacatggagcattcatgcccaccatcagtggatgaccacggaggatatgctgtctgtctggaatcgggtgtggatcgaagagaacccgtggatggaagacaagacccacgtttccagctggggcgatgtgccttatctcgggaaaagagaggaccaatggtgcggatctctgatcggccttacagctcgggccacctgggcgacaaatattcaggtcgctatcaaccaggtgagacgcctgctcgggaatgagaactacctggactacatgaccagcatgaagcggttcaaaaatgaatccgatcccgagggcgccctgtggtga

SEQ ID NO: 19102 - RNA, 9879 nt, synthetic construct
  misc_feature 1..9879: note = derived and/or modified CDS sequence (opt5) from DENV-1__FJ898399__SS-prME
  source 1..9879: mol_type = other RNA
agcgtgacaatgctgctgatgctgatgcccacagcccttgctttccacctgacgaccagaggcggggaacctcatatgatcgtgtccaagcaggaacgggggaaatctctcctgtttaagacaagcgccggcgttaatatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaactgacggttgtggtcggagatgtggctggcattctcgggcagggaaagaaaatgatccggccgcagcccatggagtacaagtatagctggaagtcctggggcaaagccaagattatcggggccgacgctcaaaatacaacctttatcattgatggacctaacacccccgaatgtcctgacgatcagagagcgtggaatatctgggaggtggaggactacggcttcggcatttttacaaccaacatctggctgaaactgcgcgatagctatacgcaggtctgcgaccaccggcttatgtctgccgctattaaggattccaaagccgttcacgccgacatggggtactggatcgaaagcgagaagaatgaaacatggaagctcgctagagcctctttcatcgaggtgaaaacctgtatttggcccaagtcccatacactgtggagcaacggagtgctggaatctgagatgatcattccgaaaatctatggcgggcctattagccagcacaattaccgccccggatacttcacccaaacagcgggcccttggcatctcgggaagctggagcttgattttgacctgtgcgaaggaaccacggtcgtggttgatgagcactgcggcaaccggggcccctccctcagaaccacaaccgtgacagggaaaatcatccacgaatggtgttgccggagctgtaccctgcctcccctgcgcttcaagggagaggacggctgctggtatgggatggagattagaccggtcaaggaaaaagaggaaaatcttgtgaagtctatggtttccgctggaagcggcgaggtggactccttttctctcgggctgctgtgtatcagcattatgatcgaagaggtcatgcggtccagatggtctcgcaaaatgctcatgacgggaacactggccgtgttctttcttctgattatgggccagctcacctggaacgatctgatccggctgtgcattatggttggcgccaatgctagcgacagaatggggatgggaacaacctaccttgccctgatggcgaccttcaagatgcgccctatgtttgctgtgggcctcctgttcagacggctcacatcccgcgaggtcctgcttctgacgatcgggctctctctggtggccagcgtggaactgcccaactcccttgaggaactgggagatggcctcgccatggggatcatgattctgaaactcctgaccgactttcagagccatcaactttgggctacactgctctctctgaccttcatcaagacaaccttttccctgcactatgcctggaagacgatggctatggtccttagcattgtttctctgttccccctctgtctgtccacaaccagccagaaaaccacatggctccctgtgctgcttggatctctgggctgcaagccgctgaccatgtttctcatcgccgagaataaaatttggggcagaaagtcctggcccctgaacgaagggatcatggcggtgggaatcgtcagcattcttctgtccagcctcctgaaaaacgatgtgcctctcgccggccccctgatcgctgggggaatgcttattgcctgttacgttatctctggcagctccgctgacctgtctctggagaaggccgccgaggtgagctgggaagaggaagctgagcattccggggcgtctcacaatattctcgtcgaagtgcaggatgacggaacaatgaaaatcaaggatgaggagcgggacgatacgctgaccatccttctgaaggccacactcctggctgttagcggcgtgtatcctctctccattcccgccaccctgttcgtctggtacttctggcagaaaaagaaacaacgctctggcgtgctttgggacacaccttcccctcccgaagtcgagagagccgtgctggatgacgggatctatcggattatgcagcgcggactgctcggcagatcccaggttggggtgggagtctttcaggaaaacgtgttccataccatgtggcacgttacgcggggcgctgtgctgatgtaccaagggaagcgccttgagcccagctgggcctctgtcaaaaaggacctgatctcctacggaggcggctggagactccaggggagctggaataccggagaggaagtccaggtgattgcggttgagcccggcaagaaccctaaaaatgtccagacagctcccgggacctttaagacatctgaaggagaggtgggcgccatcgccctggatttcaaaccggggacctccggaagccctattgtgaaccgggaaggcaagatcgtcggcctctatgggaatggagtggttacaacgtccggcacctacgtgtctgctatcgcccaagcgaaagctagccaggaggggcccctgcctgagattgaagacgaggtctttagaaagcgcaaccttacaatcatggatctgcaccccggatccggcaagacccggagatatctgcccgccattgtgcgcgaagccatcaaacggaagctcagaaccctgattcttgctcctacacgcgttgtggccagcgagatggctgaagccctgaaagggatgccgatccggtaccagacgaccgcggtcaagtctgagcatacaggcaaagagatcgtggacctcatgtgccacgccaccttcacaatgagactgctgtcccccgttcgcgtgcctaattataacatgattatcatggatgaagctcattttaccgaccccagctctattgccgctcggggatacatcagcacgagagtcggcatgggggaggccgccgctattttcatgacagcgacccctcccggatccgtggaagcctttcctcaatctaatgctgtgatccaggatgaggaacgggacatcccggagcgcagctggaactccggctatgagtggattaccgatttccccgggaagacagtctggtttgttccttctatcaagagcggaaatgacattgccaactgtctccgcaaaaatggcaagcgggtgatccagctttcccgcaaaaccttcgatacagaataccagaagaccaaaaacaacgactgggactacgtggtcacgacagatattagcgagatgggggccaatttcagagctgaccgggtgatcgatcccagacgctgcctgaagcctgttattctgaaggacggccccgaacgggtgatcctcgccggaccgatgcctgtcaccgtggcgtctgctgcccaaagacgcggccggatcgggagaaaccacaataaagagggagatcagtatatttacatgggccagcccctgaacaatgacgaggatcatgcccactggacagaagctaagatgcttctggacaacatcaatacccccgaggggattatccctgccctctttgaacccgagcgcgaaaaatccgcggccattgatggagagtatcggctgagaggcgaggctcgcaagacgttcgttgaactgatgagaagaggggacctccctgtgtggcttagctacaaagtcgcctccgagggctttcagtattctgatcgcagatggtgcttcgacggagaacggaacaatcaagtgctggaggaaaacatggatgtcgagatctggaccaaggagggcgaacgcaaaaagctgagaccgcggtggctcgacgctagaacatacagcgaccccctggcccttcgcgagtttaaggagttcgctgccgggcggagatccgtgtctggagatctgatcctcgagattggcaaactgcctcagcacctgacccagcgcgcgcagaatgccctcgacaaccttgttatgctgcataatagcgaacaagggggacgggcttatagacacgccatggaggagctgcccgatacaatcgaaaccctcatgctgcttgctctgattgccgtgctcacaggcggcgtgaccctgtttttcctgtccgggcggggactcggcaagacgagcatcgggcttctgtgtgtcatggcctcttccgttctgctctggatggctagcgtggagcctcattggattgcggcctctatcatcctggaatttttccttatggtgctgctcattcccgagccggaccgccagagaacacctcaggataaccagctggcttacgtcgtgatcggactgctctttatgattcttaccgttgccgccaatgagatgggcctgctggaaaccaccaaaaaggacctcgggatcggacacgtggctgtcgagaaccaccatcacgccgcgatgctggatgtggaccttcatcccgcctccgcttggaccctgtacgccgtcgctacaacgattatcacccctatgatgcggcacacaattgaaaacaccacagccaatatcagcctcaccgcgatcgccaaccaagctgccattctgatgggcctggataaaggctggcccatctctaagatggacattggggtgcctctccttgctctgggatgctatagccaggttaatcccctgacgctcaccgccgctgtgctgatgcttgtcgcccattacgcgatcattggcccggggctgcaggccaaggctacacgcgaggcccagaaacggaccgctgccggaatcatgaagaaccctacagtggatggcatcgttgccattgacctcgatcccgtggtctatgacgcgaaattcgaaaagcagctggggcagatcatgctgctcattctttgtacctcccagatcctgctgatgcggacgacatgggctctctgcgagtctattaccctggccacaggaccccttaccaccctgtgggagggcagccctggcaaattttggaatacaacgatcgctgtgtccatggccaacatcttccgcgggagctacctcgccggagctggcctggccttctccctgatgaagtctctcgggggaggcagacgggggaccggagcgcaaggcgaaacacttggcgagaagtggaaacgccagctgaatcagctgagcaagtccgaatttaacacctataaaagatctgggattatggaggtggaccggagcgaagccaaggagggactcaaaagaggcgagacaaccaagcacgctgtttcccgcgggacggccaagctgcggtggttcgtcgaaagaaatcttgtgaaaccggagggaaaggtgatcgatctgggctgtgggcgcggaggctggtcttactattgcgctggcctcaaaaaggtcacagaagttaaagggtacaccaagggaggccccgggcacgaggaacctattcccatggccacctacggatggaacctggtgaaactgcatagcggcaaggacgtgtttttcatccctcccgagaagtgtgatacactcctttgcgacattggggagtccagccctaatccgaccatcgaagagggacggacactgagagtcctgaaaatggtggaaccctggctccgcggcaaccagttttgtattaagatcctgaatccttatatgccctctgttgtggagacgcttgagcaaatgcagcggagacacggcgggatgctggtccgcaaccctctctcccggaatagcacccatgaaatgtactgggtgtcttgcggaacaggcaacatcgtttccgcggtgaatatgaccagcagaatgctgctgaaccgcttcacaatggcccaccggaaacccacctatgagagagatgtcgacctcggggctggaacgcgccacgtggccgtggaaccggaggtcgctaacctggatattatcggccagagaattgaaaatatcaagcatgagcacaaatctacctggcattacgacgaggataacccttataagacatgggcctaccacgggtcctatgaagttaagcccagcggatccgctagctctatggtgaatggcgtggtcaaacttctgaccaagccctgggacgtgattcctatggttacacagatcgccatgaccgatacaaccccctttggccaacagcgggtgttcaaagagaaggtcgacacgcgcacacctaaagcgaagagagggaccgcccagatcatggaagtgaccgctaagtggctctggggatttctgagccggaacaaaaagccgagaatttgtacacgggaggagttcacgcgcaaagttagatccaatgccgctatcggcgccgtgtttgtcgacgagaaccaatggaactctgccaaggaggcggtggaagatgagcggttctgggaccttgttcatcgcgaaagagagctgcacaaacaggggaagtgcgctacctgcgtgtacaacatgatgggaaagcgggagaaaaagctcggcgagtttgggaaagccaagggcagccgcgccatttggtacatgtggctgggagctagattcctggagttcgaagccctcggctttatgaatgaggatcactggttctcccgggaaaactctctgagcggggtcgagggagagggccttcataaactggggtatatcctccgcgacatttccaagatccccggaggcaatatgtacgctgatgacacagccgggtgggataccagaatcacagaagacgatctgcagaacgaggcgaaaattaccgacatcatggaacctgagcacgcccttctggctaagtctatttttaagctcacatatcagaataaagtggtccgggtgcaacgccccgccaagaacggcaccgttatggatgtgatcagcagacgggaccagcgcggatccggccaggtcgggacgtacggactgaataccttcacaaacatggaagctcagctgattagacaaatggagagcgagggcatcttttctccttccgaactcgagacccccaacctggccgggcgggtgcttgattggctggaaaaacatggagtggagagactcaagcgcatggcgatcagcggcgacgactgtgttgtgaaaccgattgatgaccggttcgccacagctctgaccgcccttaatgatatggggaaggtcagaaaggacatccctcagtgggaaccctctaaaggctggaacgattggcaacaggtgcctttttgctcccaccacttccatcaactgattatgaaggacggacgcgagatcgttgtgccctgtcggaatcaggatgagctcgtcggcagagctcgcgtgagccagggggccggatggtccctgcgggaaacggcttgcctgggcaaatcttatgcccagatgtggcaactcatgtactttcacagacgcgacctgcggcttgcggccaacgctatttgtagcgccgtccctgtggattgggttcccacatccagaaccacatggagcatccatgcccaccatcagtggatgaccacggaggacatgctgtctgtgtggaatcgcgtctggattgaagagaacccgtggatggaagataagacccacatctccagctggggagacgtgccttatctcggaaaacgggaggaccagtggtgcggctctctgatcgggcttacagctagagccacctgggcgacaaatattcaagttgctatcaaccaggtgcggagactgattggcaatgagaactacctcgattacatgaccagcatgaagcgcttcaagaatgaatccgaccccgagggagccctgtggtga

SEQ ID NO: 19103 - RNA, 9879 nt, synthetic construct
  misc_feature 1..9879: note = derived and/or modified CDS sequence (opt5) from DENV-1__FJ898401__SS-prME
  source 1..9879: mol_type = other RNA
agcgtgaccatgctgctgatgctgatgcccacagcccttgctttccacctgacgacccggggcggggaacctcatatgatcgtctccaagcaggaacggggaaaatctctgctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatggacactgcggcaaccggggcccctccctgagaaccacaaccgtcacagggaaaatcatccacgagtggtgttgccggagctgtaccctccctcccctgcgctttaagggagaagacggctgctggtatgggatggagattagaccggtgaaggagaaagaagagaatctggttaagtctatggtgtccgctggaagcggcgaagtcgactccttctctcttgggctcctgtgtatcagcattatgatcgaggaagtgatgcggtccagatggtctcgcaaaatgctgatgacgggaacactcgccgtctttttcctgcttattatgggccagctgacctggaacgatctcatccggctgtgcattatggtgggcgccaatgctagcgacagaatggggatgggaacaacctacctggcccttatggcgacctttaagatgcgccctatgttcgctgtcggcctgctctttagacggctgacatcccgcgaggtgctcctgcttacgatcgggctgtctctcgtggccagcgtcgagctgcccaactccctggaagaacttggagatggcctggccatggggatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctgggatctcttggctgcaagccgctgaccatgttcctgatcgccgaaaataaaatttggggcagaaagtcctggcccctcaacgaggggatcatggcggtcggaatcgtgagcattctgctttccagcctgctcaaaaacgatgttcctctggccggccccctcatcgctgggggaatgctgattgcctgttacgtgatctctggcagctccgctgacctttctctggaaaaggccgccgaggtcagctgggagaaagaagctgagcattccggggcgtctcacaatattctggtggaagttcaggatgacggaacaatgaagatcaaggatgaggaacgggacgatacgctcaccatcctgcttaaagccacactgctcgctgtgagcggcgtctatcctctgtccattcccgccaccctcttcgtgtggcatttttggcagaagaaaaagcaacgctctggcgtcctgtgggacacaccttcccctcccgaggtggagagagccgttcttgatgacgggatctaccggattatgcagcgcggactgctgggcagatcccaggtgggggtcggagtgttccaggaaaacgtttttcacaccatgtggcacgtgacgcggggcgctgtcctcatgtatcaagggaaacgcctggagcccagctgggcctctgtgaagaaggaccttatctcctacggaggcggctggagactgcaggggagctggaataccggagaagaggtgcaggttattgcggtcgagcccggcaaaaaccctaagaatgtgcagacagctcccgggaccttcaaaacatctgaaggagaggtgggcgccatcgccctcgattttaagccggggacctccggaagccctattgtcaaccgggaaggcaaaatcgtgggcctgtacgggaatggagttgtgacaacgtccggcacctatgtctctgctatcgcccaagcgaaggctagccaggaggggcccctccctgaaattgaggacgaggtgttcagaaagcgcaacctgacaatcatggatcttcatcccggatccggcaaaacccggagatacctgcccgccattgttcgcgaagccatcaagcggaaactgagaaccctcattctggctcctacacgcgtggtcgccagcgagatggctgaagcccttaaggggatgccgatccggtatcagacgaccgcggtgaaatctgagcacacaggcaaggaaatcgttgacctgatgtgccatgccacctttacaatgagactcctgtcccccgtgcgcgtccctaattacaacatgattatcatggatgaggctcacttcaccgaccccagctctattgccgctcggggatatatcagcacgagagtgggcatgggggaggccgccgctatttttatgacagcgacccctcccggatccgtggaagccttccctcaatctaatgctgtcatccaggatgaggaacgggacatcccggagcgcagctggaactccggctacgaatggattaccgattttcccgggaagacagtttggttcgtgccttctatcaaaagcggaaatgacattgccaactgtctgagaaagaatggcaaacgggtgatccagctctcccgcaagaccttcgatacagagtatcagaaaaccaagaacaacgactgggactacgtcgtgacgacagatattagcgagatgggggccaattttagagctgaccgggttatcgatcccagacgctgccttaagcctgtgattctgaaagacggccccgaacgggtcatcctggccggaccgatgcctgtgaccgttgcgtctgctgcccaaagacgcggccggatcgggagaaaccataataaggagggagatcagtacatttatatgggccagcccctcaacaatgacgaagatcacgcccactggacagaggctaaaatgctgcttgacaacatcaatacccccgaggggattatccctgccctgttcgaacccgagcgcgaaaagtccgcggccattgatggagagtaccggctcagaggcgaagctcgcaaaacgtttgtggagctgatgagaagaggggacctgcctgtctggctcagctataaggtggcctccgagggcttccagtactctgatcgcagatggtgctttgacggagaacggaacaatcaagtccttgaggaaaacatggatgtggagatctggaccaaagaaggcgagcgcaagaagctgagaccgcggtggctggacgctagaacatatagcgaccccctcgccctgcgcgagttcaaagaatttgctgccgggcggagatccgtttctggagatcttatcctggagattggcaagctccctcagcatctgacccagcgcgcgcagaatgccctggacaacctcgtgatgcttcacaatagcgaacaagggggacgggcttacagacatgccatggaggaactgcccgatacaatcgagaccctgatgctcctggctcttattgccgtgctgacaggcggcgtcaccctcttctttctgtccgggcggggactgggcaaaacgagcatcgggctcctttgtgttatggcctcttccgtgctgctgtggatggctagcgtggagcctcactggattgcggcctctatcatcctcgagttctttctgatggtccttctgattcccgagccggaccgccagagaacacctcaggataaccagctcgcttatgtggttatcggactgctgttcatgattctcaccgtggccgccaatgaaatgggccttctggagaccacaaagaaagacctggggatcggacacgtcgctgtggagaaccatcaccatgccgcgatgctcgatgtcgacctgcaccccgcctccgcttggaccctttacgccgtggctacaacgattatcacccctatgatgcggcatacaattgaaaacaccacagccaatatcagcctgaccgcgatcgccaaccaagctgccattctcatgggcctggataagggctggcccatctctaagatggacattggggttcctctgctcgctcttggatgctacagccaggtgaatcccctgacgctgaccgccgctgtcctcatgctggtggcccactatgcgatcattggcccggggcttcaggccaaagctacacgcgaggcccaaaagagaaccgctgccggaatcatgaaaaaccctacagttgatggcatcgtggccattgacctggatcccgtcgtgtacgacgcgaagtttgaaaaacagctcgggcagatcatgctgctgattctctgtacctcccagatccttctgatgcggacgacatgggctctgtgcgagtctattaccctcgccacaggacccctgaccaccctttgggaaggcagccctggcaagttctggaatacaacgatcgctgtgtccatggccaacatcttccgcgggagctatctggccggagctggcctcgccttttccctgatgaagtctctcgggggcgggagacgggggaccggagcgcacggcgagacactcggcgagaaatggaagcgccaacttaatcagctgagcaaatccgagttcaacacctacaagagatctgggattatggaggttgaccggagcgaagccaaagagggactgaagagaggcgaaacaaccaagcatgctgtctcccgcgggacggccaaactccggtggtttgtggagagaaatctggtgaagccggagggaaaagtcatcgatcttggctgtgggcgcggaggctggtcttattactgcgctggcctgaagaaagttacagaagtgaaggggtataccaaaggaggccccgggcacgaggaacctattcccatggccacctacggatggaacctcgtgaagctgcatagcggcaaggacgtcttctttatccctcccgagaaatgtgatacactgctctgcgacattggggaatccagccctaatccgaccatcgaggagggacggacacttagagtgctgaagatggttgaaccctggctgcgcggcaaccagttctgtattaaaatcctcaatccttacatgccctctgtggtcgagacgctggaacagatgcaacggaagcacggcgggatgcttgtgagaaaccctctgtcccgcaatagcacccacgagatgtattgggtttcttgcggaacaggcaacatcgtgtccgcggtcaatatgaccagccggatgctcctgaacagatttacaatggcccatcgcaaacccacctacgagcgggatgtggacctgggggctggaacgagacacgtggccgtcgaaccggaggttgctaacctcgatattatcggccagcgcattgaaaatatcaagcatgagcacaagtctacctggcattatgacgaagataacccttacaaaacatgggcctatcacgggtcctacgaggtgaagcccagcggatccgctagctctatggtgaatggcgtcgtgaaactgcttaccaagccctgggacgttattcctatggtgacacagatcgccatgaccgatacaacccccttcggccagcaaagagtctttaaagagaaggtggacacgcggacacctaaggcgaaacgcgggaccgcccagatcatggaagttaccgctaagtggctgtggggattcctcagcagaaacaaaaagccgcggatttgtacaagagaggaatttacgcggaaagtgcgctccaatgccgctatcggcgccgtcttcgtggacgagaaccagtggaactctgccaaggaagcggttgaggatgagagattttgggacctggtgcaccgggaacgcgagcttcataagcaagggaaatgcgctacctgcgtctataacatgatgggaaagagagagaagaagctgggcgagttcgggaaagccaagggcagccgggccatttggtacatgtggctcggagctcgcttcctggaatttgaggccctgggcttcatgaatgaggatcactggttttccagagaaaactctctcagcggggtggagggagaaggcctgcataaacttgggtacatcctgcgggacatttccaagatccccggaggcaatatgtatgctgatgacacagccgggtgggatacccgcatcacagaggacgatctccagaacgaggcgaagattaccgacatcatggaacctgagcacgccctgcttgctaaatctattttcaagctgacataccagaataaagtcgtgagagttcagcggcccgccaagaacggcaccgtgatggatgtcatcagccgcagagaccaacggggatccggccaggtggggacgtatggactcaatacctttacaaacatggaagctcagctgattcgccagatggagagcgaaggcatcttctctccttccgagctggagacccccaacctcgccgggagagtgctggattggcttgaaaaacacggagttgagcggctgaagagaatggcgatcagcggcgacgactgtgtggtcaagccgattgatgaccgctttgccacagctctcaccgccctgaatgatatggggaaagtgcggaaggacatccctcaatgggaaccctctaaaggctggaacgattggcagcaggttcctttctgctcccatcactttcatcagcttattatgaaggacggaagagagatcgtggtcccctgtcgcaatcaagatgaactggtgggccgggctagagtcagccagggggccggatggtccctccgcgagacggcttgcctgggcaaatcttacgcccagatgtggcagctgatgtatttccaccggagagacctccgcctggcggccaacgctatttgtagcgccgtgcctgttgattgggtgcccacatcccggaccacatggagcatccatgcccaccaccaatggatgaccacggaggacatgctttctgtctggaatagagtgtggattgaagagaacccgtggatggaagataagacccatatctccagctggggagacgttccttacctgggaaagcgcgaggaccagtggtgcggctctctcatcgggctgacagctcgggccacctgggcgacaaatattcaggtggctatcaaccaagtcagacggcttattggcaatgaaaactatctggattacatgaccagcatgaaaagatttaagaatgagtccgaccccgagggagccctctggtga

SEQ ID NO: 19104 - RNA, 9879 nt, synthetic construct
  misc_feature 1..9879: note = derived and/or modified CDS sequence (opt5) from DENV-1__FJ898402__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaattacatcctgcttgaaaacgacatgaaatttacggttgtggtcggagatgtggctggcattctggcccaggggaagaaaatgatccggccgcagcccatggagtataagtacagctggaagtcctggggaaaagccaagattatcggcgctgacgtgcaaaatacaaccttcatcattgatgggcctaacacccccgaatgtcctgacgatcagagagcgtggaatatctgggaggtcgaggactatggatttggcattttcacaaccaacatctggctcaaactgcgcgatagctacacgcaggtttgcgaccatcggctgatgtctgccgctattaaggattccaaagccgtgcacgccgacatgggctattggatcgaaagcgagaagaatgaaacatggaaacttgctagagcctctttcatcgaggtgaaaacctgtatttggcccaagtcccacacactctggagcaacggggtcctggaatctgagatgatcattccgaaaatctacggaggccctattagccagcataattaccgccccgggtattttacccaaacagcgggaccttggcacctgggcaagctcgagctggatttcgacctttgcgaagggaccacggtggttgtggatgagcattgcggaaaccggggcccctccctgagaaccacaaccgtcacaggcaaaatcatccacgaatggtgttgccggagctgtaccctccctcccctgcgctttaagggggaggacggatgctggtacggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctatctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccaccaactgtgggctacacttctgtctctcacctttatcaagacaaccttctccctgcattacgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccagcctgctcaaaaacgatgttcctctggccggacccctcatcgctggcgggatgctgattgcctgttatgtgatctctggaagctccgctgacctttctctggagaaggccgccgaggtcagctgggaagaggaagctgagcactccggcgcgtctcataatattctggtggaagttcaggatgacgggacaatgaaaatcaaggatgaggagcgggacgatacgctcaccatcctgcttaaggccacactgctcgctgtgagcggagtctaccctctgtccattcccgccaccctcttcgtgtggtatttttggcagaaaaagaaacaacgctctggcgtcctgtgggacacaccttcccctcccgaagtggagagagccgttcttgatgacggcatctaccggattatgcagcgcgggctgctgggaagatcccaggtgggcgtcggggtgttccaggaaaacgtttttcacaccatgtggcatgtgacgcggggagctgtcctcatgtaccaaggcaagcgcctggagcccagctgggcctctgtgaaaaaggaccttatctcctatgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacctccgggagccctattgtcaaccgggaaggaaagatcgtgggcctgtacggcaatggggttgtgacaacgtccggaacctatgtctctgctatcgcccaagcgaaagctagccaggagggccccctccctgagattgaagacgaggtgttcagaaagcgcaacctgacaatcatggatcttcaccccgggtccggaaagacccggagatacctgcccgccattgttcgcgaagccatcaaacggaagctgagaaccctcattctggctcctacacgcgtggtcgccagcgagatggctgaagcccttaaaggcatgccgatccggtatcagacgaccgcggtgaagtctgagcacacagggaaagagatcgttgacctgatgtgccatgccacctttacaatgagactcctgtcccccgtgcgcgtccctaattacaacatgattatcatggatgaagctcacttcaccgaccccagctctattgccgctcggggctatatcagcacgagagtgggaatgggcgaggccgccgctatttttatgacagcgacccctcccgggtccgtggaagccttccctcaatctaatgctgtcatccaggatgaggaacgggacatcccggagcgcagctggaactccggatacgagtggattaccgattttcccggcaagacagtttggttcgtgccttctatcaagagcgggaatgacattgccaactgtctgcgcaagaatggaaagcgggtgatccagctctcccgcaaaaccttcgatacagaataccagaagaccaaaaacaacgactgggactatgtcgtgacgacagatattagcgagatgggcgccaattttagagctgaccgggttatcgatcccagacgctgccttaagcctgtgattctgaaggacgggcccgaacgggtcatcctggccggcccgatgcctgtgaccgttgcgtctgctgcccaaagacgcggacggatcggcagaaaccataataaagagggggatcagtacatttatatgggacagcccctcaacaatgacgaggatcacgcccattggacagaagctaagatgctgcttgacaacatcaatacccccgagggcattatccctgccctgttcgaacccgagcgcgaaaaatccgcggccattgatggggagtaccggctcagaggagaggctcgcaagacgtttgtggaactgatgagacggggcgacctgcctgtctggctcagctataaagtggcctccgaggggttccagtactctgatcgcagatggtgctttgacggcgaacggaacaatcaagtccttgaggaaaacatggatgtggagatctggaccaaggagggagaacgcaaaaagctgagaccgcggtggctggacgctagaacatatagcgaccccctcgccctgcgcgagttcaaggaatttgctgccggccggagatccgtttctggggatcttatcctggagattggaaaactccctcagcacctgacccagcgcgcgcagaatgccctggacaacctcgtgatgcttcacaatagcgaacaaggcgggcgggcttacagacatgccatggaggagctgcccgatacaatcgaaaccctgatgctcctggctcttattgccgtgctgacaggaggcgtcaccctcttctttctgtccggccgggggctgggaaagacgagcatcggcctcctttgtgttatggcctcttccgtgctgctgtggacagctagcgtggagcctcactggattgcggcctctatcatcctcgagttctttctgatggtccttctgattcccgagccggaccgccagagaacccctcaggataaccagctcgcttacgtggttatcgggctgctgttcatgattctcaccgtggccgccaatgagatgggacttctggaaacaaccaaaaaggacctgggcatcgggcatgtcgctgtggagaaccaccaccatgccgcgatgctcgatgtcgacctgcaccccgcctccgcttggacactttatgccgtggctacgaccattatcacacctatgatgcggcataccattgaaaacacaaccgccaatatcagcctgacggcgatcgccaaccaagctgccattctcatgggactggataaaggctggcccatctctaagatggacattggcgttcctctgctcgctcttgggtgctacagccaggtgaatcccctgaccctgacagccgctgtcctcatgctggtggcccactatgcgatcattggaccgggccttcaggccaaggctacccgcgaggcccagaagagaacagctgccgggatcatgaagaaccctaccgttgatggaatcgtggccattgacctggatcccgtcgtgtacgacgcgaaatttgaaaagcagctcggccagatcatgctgctgattctctgtacgtcccagatccttctgatgcggacaacctgggctctgtgcgagtctattacactcgccaccgggcccctgaccacactttgggagggaagccctggcaaattctggaatacgaccatcgctgtgtccatggccaacatcttccgcggcagctatctggccggggctggactcgccttttccctgatgaagtctctgggcgggggaagacggggcacaggggcgcaaggagaaaccctcggcgagaagtggaaacgccagcttaatcagctgagcaagtccgagttcaacacatacaaaagatctggcattatggaggttgaccggagcgaagccaaggaggggctgaaaagaggagagaccacgaagcatgctgtctcccgcggcacagccaagctccggtggtttgtggaaagaaatctggtgaaaccggaggggaaggtcatcgatcttggatgtggccgcgggggatggtcttattactgcgctggcctgaaaaaggttaccgaagtgaaaggctacaccaaagggggacccggccacgaggaacctattcccatggccacatatgggtggaacctcgtgaaactgcacagcggaaaggacgtcttctttatccctcccgagaagtgtgataccctgctctgcgacattggcgagtccagccctaatccgacaatcgaagaggggcggacgcttagagtgctgaaaatggttgaaccctggctgcgcggaaaccagttctgtattaagatcctcaatccttacatgccctctgtggtcgagaccctggagcaaatgcagcggaaacatggcggcatgcttgtgagaaaccctctgtcccgcaatagcacacacgaaatgtattgggtttcttgcgggaccggaaacatcgtgtccgcggtcaatatgacaagccggatgctcctgaacagatttaccatggcccatcgcaagcccacgtacgagcgggatgtggacctgggcgctgggaccagacacgtggccgtcgaaccggaggttgctaacctcgatattatcggacagcgcattgaaaatatcaaacacgagcataagtctacatggcactatgacgaggataacccttacaagacctgggcctatcatggctcctacgaagtgaaacccagcgggtccgctagctctatggtgaatggagtcgtgaagctgcttacaaaaccctgggacgttattcctatggtgacccagatcgccatgacagataccacgcccttcggccaacagagagtctttaaggagaaagtggacacacggacccctaaggcgaagcgcggcaccgcccagatcatggaagttacagctaaatggctgtgggggttcctcagcagaaacaagaaaccgcggatttgtacgagagaggaatttacccggaaggtgcgctccaatgccgctatcggagccgtcttcgtggacgagaaccaatggaactctgccaaagaggcggttgaagatgagagattttgggacctggtgcaccgggaacgcgagcttcataagcagggcaagtgcgctacatgcgtctacaacatgatggggaaaagagaaaagaaactgggagagttcggcaaggccaaagggagccgggccatttggtatatgtggctcggcgctcgcttcctggagtttgaagccctgggattcatgaatgaggatcactggttttccagagaaaactctctcagcggcgtggagggggagggactgcacaaacttggctacatcctgcgggacatttccaaaatccccgggggaaatatgtatgctgatgacaccgccggctgggatacacgcatcaccgaagacgatctccagaacgaggcgaagattacagacatcatggaacctgagcatgccctgcttgctaagtctattttcaaactgacctaccagaataaggtcgtgagagttcaacggcccgccaaaaacgggacggtgatggatgtcatcagccgcagagaccagcggggctccggacaggtgggcacctatgggctcaatacatttaccaacatggaagctcagctgattcgccaaatggagagcgagggaatcttctctccttccgaactggagacacccaacctcgccggcagagtgctggattggcttgaaaagcacggggttgagcggctgaaaagaatggcgatcagcggagacgactgtgtggtcaagccgattgatgaccgctttgccaccgctctcacggccctgaatgatatgggcaaggtgcggaaagacatccctcagtgggaaccctctaaggggtggaacgattggcagcaggttcctttctgctcccatcactttcaccaacttattatgaaagacggcagagagatcgtggtcccctgtcgcaatcaggatgagctggtgggacgggctagagtcagccagggcgccgggtggtccctccgcgaaacagcttgcctgggaaagtcttacgcccagatgtggcaactgatgtatttccatcggagagacctccgcctggcggccaacgctatttgtagcgccgtgcctgttgattgggtgcccacctcccggacaacctggagcatccacgcccatcaccagtggatgacgaccgaggacatgctttctgtctggaatagagtgtggattgaagagaacccgtggatggaagataaaacacatatctccagctggggcgacgttccttacctggggaagcgcgaggaccagtggtgcggatctctcatcggcctgaccgctcgggccacatgggcgaccaatattcaagtggctatcaaccaggtcagacggcttattgggaatgagaactacctggattatatgacaagcatgaagagatttaaaaatgaatccgaccccgagggcgccctctggtga

SEQ ID NO: 19105 - RNA, 9879 nt, synthetic construct
  misc_feature 1..9879: note = derived and/or modified CDS sequence (opt5) from DENV-1__FJ898403__SS-prME
  source 1..9879: mol_type = other RNA
agcgtgacaatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccagcctgctcaaaaacgatgttcctctggccggacccctcatcgctggcgggatgctgattgcctgttacgtgatctctggaagctccgctgacctttctctggagaaggccgccgaggtcagctgggaagaggaagctgagcattccggcgcgtctcacaatattctggtggaagttcaggatgacgggacaatgaaaatcaaggatgaggagcgggacgatacgctcaccatcctgcttaaggccacactgctcgctgtgagcggagtctatcctctgtccattcccgccaccctcttcgtgtggtacttttggcagaaaaagaaacaacgctctggcgtcctgtgggacacaccttcccctcccgaagtggagagagccgttcttgatgacggcatctatcggattatgcagcgcgggctgctgggaagatcccaggtgggcgtcggggtgttccaggaaaacgtttttcataccatgtggcacgtgacgcggggagctgtcctcatgtaccaaggcaagcgcctggagcccagctgggcctctgtgaaaaaggaccttatctcctacgggggaggctggagactgcagggcagctggaataccggggaggaagtgcaggttattgcggtcgagcccggaaagaaccctaaaaatgtgcagacagctcccggcaccttcaagacatctgaaggggaggtgggagccatcgccctcgattttaaaccgggcacctccgggagccctattgtcaaccgggaaggaaagatcgtgggcctgtatggcaatggggttgtgacaacgtccggaacctacgtctctgctatcgcccaagcgaaagctagccaggagggccccctccctgagattgaagacgaggtgttcagaaagcgcaacctgacaatcatggatcttcaccccgggtccggaaagacccggagatatctgcccgccattgttcgcgaagccatcaaacggaagctgagaaccctcattctggctcctacacgcgtggtcgccagcgagatggctgaagcccttaaaggcatgccgatccggtaccagacgaccgcggtgaagtctgagcatacagggaaagagatcgttgacctgatgtgccacgccacctttacaatgagactcctgtcccccgtgcgcgtccctaattataacatgattatcatggatgaagctcatttcaccgaccccagctctattgccgctcggggctacatcagcacgagagtgggaatgggcgaggccgccgctatttttatgacagcgacccctcccgggtccgtggaagccttccctcaatctaatgctgtcatccaggatgaggaacgggacatcccggagcgcagctggaactccggatatgagtggattaccgattttcccggcaagacagtttggttcgtgccttctatcaagagcgggaatgacattgccaactgtctgcgcaagaatggaaagcgggtgatccagctctcccgcaaaaccttcgatacagaataccagaagaccaaaaacaacgactgggactacgtcgtgacgacagatattagcgagatgggcgccaattttagagctgaccgggttatcgatcccagacgctgccttaagcctgtgattctgaaggacgggcccgaacgggtcatcctggccggcccgatgcctgtgaccgttgcgtctgctgcccaaagacgcggacggatcggcagaaaccacaataaagagggggatcagtatatttacatgggacagcccctcaacaatgacgaggatcatgcccactggacagaagctaagatgctgcttgacaacatcaatacccccgagggcattatccctgccctgttcgaacccgagcgcgaaaaatccgcggccattgatggggagtatcggctcagaggagaggctcgcaagacgtttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatctggaccaaggagggagaacgcaaaaagctgagaccgcggtggctggacgctagaacatacagcgaccccctcgccctgcgcgagttcaaggaatttgctgccggccggagatccgtttctggggatcttatcctggagattggaaaactccctcagcacctgacccagcgcgcgcagaatgccctggacaacctcgtgatgcttcataatagcgaacaaggcgggcgggcttatagacacgccatggaggagctgcccgatacaatcgaaaccctgatgctcctggctcttattgccgtgctgacaggaggcgtcaccctcttctttctgtccggccgggggctgggaaagacgagcatcggcctcctttgtgttatggcctcttccgtgctgctgtggatggctagcgtggagcctcattggattgcggcctctatcatcctcgagttctttctgatggtccttctgattcccgagccggaccgccagagaacacctcaggataaccagctcgcttacgtggttatcgggctgctgttcatgattctcaccgtggccgccaatgagatgggacttctggaaaccaccaagaaggacctgggcatcgggcacgtcgctgtggagaaccaccatcacgccgcgatgctcgatgtcgacctgcatcccgcctccgcttggaccctttacgccgtggctacaacgattatcacccctatgatgcggcacacaattgaaaacaccacagccaatatcagcctgaccgcgatcgccaaccaagctgccattctcatgggactggataaaggctggcccatctctaagatggacattggcgttcctctgctcgctcttgggtgctatagccaggtgaatcccctgacgctgaccgccgctgtcctcatgctggtggcccattacgcgatcattggaccgggccttcaggccaaggctacacgcgaggcccagaagagaaccgctgccgggatcatgaagaaccctacagttgatggaatcgtggccattgacctggatcccgtcgtgtatgacgcgaaatttgaaaagcagctcggccagatcatgctgctgattctctgtacctcccagatccttctgatgcggacgacatgggctctgtgcgagtctattaccctcgccacagggcccctgaccaccctttgggagggaagccctggcaaattctggaatacaacgatcgctgtgtccatggccaacatcttccgcggcagctacctggccggggctggactcgccttttccctgatgaagtctctgggcgggggaagacggggcaccggggcgcaaggagaaacactcggcgagaagtggaaacgccagcttaatcagctgagcaagtccgagttcaacacctataaaagatctggcattatggaggttgaccggagcgaagccaaggaggggctgaaaagaggagagacaaccaagcacgctgtctcccgcggcacggccaagctccggtggtttgtggaaagaaatctggtgaaaccggaggggaaggtcatcgatcttggatgtggccgcgggggatggtcttactattgcgctggcctgaaaaaggttacagaagtgaaaggctacaccaaagggggacccggccacgaggaacctattcccatggccacctacgggtggaacctcgtgaaactgcatagcggaaaggacgtcttctttatccctcccgagaagtgtgatacactgctctgcgacattggcgagtccagccctaatccgaccatcgaagaggggcggacacttagagtgctgaaaatggttgaaccctggctgcgcggaaaccagttctgtattaagatcctcaatccttatatgccctctgtggtcgagacgctggagcaaatgcagcggaaacacggcggcatgcttgtgagaaaccctctgtcccgcaatagcacccatgaaatgtactgggtttcttgcgggacaggaaacatcgtgtccgcggtcaatatgaccagccggatgctcctgaacagatttacaatggcccaccgcaagcccacctatgagcgggatgtggacctgggcgctgggacgagacacgtggccgtcgaaccggaggttgctaacctcgatattatcggacagcgcattgaaaatatcaaacatgagcacaagtctacctggcattacgacgaggataacccttataagacatgggcctaccacggctcctatgaagtgaaacccagcgggtccgctagctctatggtgaatggagtcgtgaagctgcttaccaaaccctgggacgttattcctatggtgacacagatcgccatgaccgatacaacccccttcggccaacagagagtctttaaggagaaagtggacacgcggacacctaaggcgaagcgcggcaccgcccagatcatggaagttaccgctaaatggctgtgggggttcctcagcagaaacaagaaaccgcggatttgtacaagagaggaatttacgcggaaggtgcgctccaatgccgctatcggagccgtcttcgtggacgagaaccaatggaactctgccaaagaggcggttgaagatgagagattttgggacctggtgcatcgggaacgcgagcttcacaagcagggcaagtgcgctacctgcgtctacaacatgatggggaaaagagaaaagaaactgggagagttcggcaaggccaaagggagccgggccatttggtacatgtggctcggcgctcgcttcctggagtttgaagccctgggattcatgaatgaggatcactggttttccagagaaaactctctcagcggcgtggagggggagggactgcataaacttggctatatcctgcgggacatttccaaaatccccgggggaaatatgtacgctgatgacacagccggctgggatacccgcatcacagaagacgatctccagaacgaggcgaagattaccgacatcatggaacctgagcacgccctgcttgctaagtctattttcaaactgacatatcagaataaggtcgtgagagttcaacggcccgccaaaaacgggaccgtgatggatgtcatcagccgcagagaccagcggggctccggacaggtgggcacgtacgggctcaatacctttacaaacatggaagctcagctgattcgccaaatggagagcgagggaatcttctctccttccgaactggagacccccaacctcgccggcagagtgctggattggcttgaaaagcatggggttgagcggctgaaaagaatggcgatcagcggagacgactgtgtggtcaagccgattgatgaccgctttgccacagctctcaccgccctgaatgatatgggcaaggtgcggaaagacgttcctcagtgggaaccctctaaggggtggaacgattggcaacaggtgcctttctgctcccaccactttcatcaacttatcatgaaagacggcagagagattgtcgtgccctgtcgcaatcaggatgagctggtcggacgggctagagtgagccagggcgccgggtggtccctccgcgaaacggcttgcctgggaaagtcttatgcccagatgtggcaactgatgtacttccaccggagagacctccgcctggcggccaacgctatctgtagcgccgttcctgtggattgggtccccacatcccggaccacatggagcattcatgcccaccatcagtggatgaccacggaggacatgctttctgtgtggaatagagtttggatcgaagagaacccgtggatggaagataaaacccacatttccagctggggcgacgtgccttatctggggaagcgcgaggaccagtggtgcggatctctcatcggcctgacagctcgggccacctgggcgacaaatatccaagtcgctattaaccaggtgagacggcttatcgggaatgagaactacctggattacatgaccagcatgaagagatttaaaaatgaatccgaccccgagggcgccctctggtga

SEQ ID NO: 19106 - RNA, 9879 nt, synthetic construct
  misc_feature 1..9879: note = derived and/or modified CDS sequence (opt5) from DENV-1__FJ898404__SS-prME
  source 1..9879: mol_type = other RNA
agcgtgaccatgctgctcatgctgatgcccaccgcccttgctttccacctgacgaccagaggcggggagcctcatatgatcgtgacaaagcaggaacggggaaaatccctcctgtttaagacctctgccggcgttaatatgtgcacccttattgccatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgctagcctgttccccctctgtctgtctaccacctcccagaagacaacctggcttcctgtgctgctggggagcctcggatgcaaaccgctgacaatgtttcttattacggagaccaagatctggggcagaaaatcttggcccctgaatgaaggcattatggccgtcggggtggtttccatcctcctgagctccctcctgaagaacgatgtgcctcttgcgggacccctgatcgccggcgggatgctgattgcttgttatgtcatcagcggatctagcgccgacctctccctggagaaagctgccgaggtgtcttgggaagaggaagccgagcacagcggcgcttcccataacattcttgttgtggtccaggatgacgggacaatgaagatcaaagatgaggaacgggacgataccctgacaattctcctgaaggcgaccctcctggccgtgtctggagtctaccctcttagcatccccgctacgctgttcgtgtggtatttttggcaaaagaaaaagcagcgctccggcgttctgtgggacaccccttctcccccggaggtggaaagagccgtcctcgatgacggcatctaccggattatgcagcgcgggctgcttggaagaagccaggtgggcgttggggtgttccaagagaatgtcttccacacaatgtggcacgtgacccggggagccgtgctgatgtatcagggcaaacgcctcgaaccttcctgggctagcgttaagaaagacctgatctcttacgggggaggctggagactccagggctcctggaacacaggggaggaggtccaggtgattgccgtggaacccggaaagaatcctaagaacgtccaaaccgcgcccggcacatttaaaacgccggagggggaagtgggagctatcgccctggatttcaagcctggcaccagcgggtctcccattgttaatcgggagggaaaaatcgtgggcctttacggcaacggggtcgtgacaacctccggaacctatgttagcgccattgctcaggccaaggcgtcccaggaaggccctctgcccgagatcgaggacgaagtgtttagaaaacgcaatctgacaatcatggatctccatcccgggtctggaaagacgcggagatacctgcctgctattgtccgcgaggccatcaagcggaaacttagaaccctgattctcgccccgacacgcgtggttgctagcgaaatggccgaggctctgaagggcatgcccatccggtatcaaaccacagccgtgaaatccgaacacaccgggaaggagattgtcgacctgatgtgccatgcgacgttcacaatgagactccttagccctgtgcgcgtgcccaactacaatatgatcatcatggatgaggcccactttaccgacccttcttccattgctgcccggggctatatcagcaccagagtcggaatgggcgaagctgccgccattttcatgacagctacaccccctgggtctgttgaggcgtttccgcagagcaacgccgtgatccaggatgaggaacgggacattcccgaacgctcctggaactctggatacgagtggatcacagatttccctggcaaaaccgtgtggtttgtccccagcatcaagtccgggaacgacattgctaattgtctgagaaagaacggaaaacgggtgatccagctgtctcgcaagacgttcgatacagagtatcagaagaccaagaataacgactgggactacgttgtgacaaccgatattagcgaaatgggcgccaactttagagccgaccgggtcatcgatcctagacgctgcctcaaacccgtgattctgaaggacgggccggagcgggttatccttgctggccctatgcccgtgacggtcgcctccgcggctcagagacgcggacggattggcagaaatcataacaaggaaggggatcagtacatctatatgggacagcccctgaataacgacgaggatcacgcccactggaccgaggccaaaatgctcctggacaatatcaacacacctgaaggcattatccccgctctgttcgagcctgaacgcgaaaagagcgccgcgattgatggggaataccggctcagaggagaggcccgcaaaaccttcgtggagcttatgagacggggcgacctgccggtctggctgtcttataaggtggcttccgaagggtttcaatacagcgatcgcagatggtgcttcgacggcgagcggaataaccaggttctcgaagagaatatggatgtggaaatctggacaaaagagggagagcgcaagaaactgagaccccggtggcttgacgccagaacctattccgaccctctggctctccgcgaatttaaggagttcgccgctggccggagatctgtgagcggggatctgattctggaaatcggaaagctcccccagcatcttacacagcgcgcccaaaacgcgctggacaatctggtcatgctccacaactccgagcagggcgggcgggcctacagacatgctatggaggaactgcctgataccatcgagacgcttatgctgctcgccctgattgctgttctgacaggaggcgtgaccctctttttcctttctggccgggggctgggaaaaaccagcatcggcctgctctgtgtgatggcctccagcgtcctgctttggatggcctctgtggaaccccactggattgctgcgtccatcattctggagtttttcctcatggttctgctgatcccggaacctgaccgccagagaacaccccaggataatcaactcgcctatgtggtcatcgggcttctgtttatgattctgaccgtggctgccaacgagatgggactcctggagacaacgaagaaagaccttggcatcgggcacgtcgccgtggaaaatcatcaccatgctaccatgctggatgttgacctccaccctgccagcgcgtggacactgtacgccgtggctaccacaattatcacccccatgatgcggcatacgattgagaacaccacagccaacatctctctgaccgctattgccaatcaggcggccatcctcatgggacttgataagggctggcctatctccaaaatggacattggcgtccccctgctggctctcgggtgctacagccaggtgaacccgctgacacttaccgccgctgttctgatgctcgtggcccactatgctatcattggacctggcctgcaagccaaggcgacgcgcgaagcccagaagagaacagctgccgggatcatgaaaaatcccaccgtcgatggaattgtggctatcgacctggatcccgtggtttacgacgccaagttcgagaaacagctcggccagatcatgcttctgattctgtgtacatctcaaatcctcctgatgcggaccacctgggccctttgcgaaagcattacactggcgacggggcctctcaccacactgtgggagggatccccgggcaagttttggaacaccacaatcgctgtctctatggccaatattttccgcggcagctatctggctggggccggactcgccttttcccttatgaaaagcctgggcgggggaagacggggcaccggggctcagggagagacgctgggcgaaaagtggaagcgccagctcaaccagctgtccaaatctgagttcaatatctacaagagaagcggcatcatggaagtggaccggtccgaggccaaagaagggcttaagagaggagagacaacccgccacgcggtgtctcggggcaccgccaaactgagatggttcgtcgagcgcaacctcgttaagcccgaagggaaggtgattgatctgggatgtggcagagggggatggagctattactgcgctggcctgaaaaaggtgacagaggtcaaaggctataccaaagggggacctggccatgaggagcccatccctatggccacatacgggtggaatctcgtgaaacttcactccggaaaggacgtctttttcacgccccctgaaaaatgtgataccctgctgtgcgacattggcgagtctagcccgaaccccacaatcgaggaagggagaaccctccgcgtgctgaagatggtcgagccttggcttcggggaaatcaattttgtattaagatcctgaacccctacatgccttccgtggttgaaacactcgagcagatgcagagaaaacatggcggcatgctggtgcgcaatcccctgagccggaactctacccacgagatgtattgggtctcctgcgggacgggaaatattgtgagcgctgtgaacatgacctctagaatgctcctgaatcgcttcacaatggcccaccggaagccgacctacgaaagagatgtcgaccttggcgcggggacacgccatgttgccgtggagcctgaagtggctaacctggatatcatcggacagagaattgagaacatcaaacacgaacataagtccacctggcactatgacgaggataatccctacaaaacatgggcctatcatggcagctacgaggtcaagccctctgggtccgctagctccatggtgaacggagttgtgaagctcctgaccaaaccttgggacgtcattcccatggtgacgcaaatcgccatgacagataccaccccttttggccagcagcgggttttcaaggaaaaagtggacacacgcacgccgaaggctaaaagaggcaccgcccaaattatggaggtcacagcgcggtggctttgggggtttctgagcagaaataagaagccccggatctgtacccgcgaagagttcacaagaaaagtgcggtctaacgccgctatcggagccgtttttgtggacgaaaatcagtggaacagcgctaaggaggccgtcgaggatgaacgcttctgggacctcgtgcagaaagagagagaactgcacaagcagggcaaatgcgcgacctgcgtctataatatgatggggaagcgggagaagaaactgggagaatttggcaaggcgaaagggtcccgcgctatttggtacatgtggctcggcgccagattcctggagtttgaggcccttggattcatgaacgaagatcactggttctctcgggagaatagcctgtccggcgtggaaggggagggactccataagctgggctacatccttcgcgacatttctaaaatccctgggggaaacatgtatgctgatgacacagccggctgggataccagaattacggaggacgatctgcaaaatgaagctaagatcaccgacatcatggagcccgaacacgccctcctggcgacaagcatttttaaactgacctaccagaacaaggttgtgcgggtccagcgccctgccaagaatgggacagtgatggatgtgatctccagacgggaccagcgcggctctggacaagttggcacctatgggctcaacacgttcacaaatatggaggctcagctgattagacagatggaaagcgagggaatctttcttccctccgagctggaaaccccgaacctcgccgagcgggtgctggattggcttgaaaaatacggcgtcgagagactgaagcgcatggctattagcggggacgactgtgtggttaaacctatcgatgaccggttcgccacagcgctcaccgccctgaacgatatgggaaaggtgagaaaagacatcccccagtgggaaccttctaagggctggaatgattggcaacaggtccccttttgctcccatcacttccaccagctgattatgaaggacgggcgcgagatcgtggtcccttgtcggaaccaggatgagctcgtgggcagagctcgcgttagccaaggagccggctggtctctgcgggaaacggcttgccttgggaaatcctatgcccagatgtggcagctgatgtactttcatagacgcgacctccggctggctgccaatgcgatttgtagcgccgtgcccgtcgattgggtgccgacctccagaacaacctggtctatccacgctcatcaccaatggatgacaaccgaggacatgcttagcgtttggaaccgcgtgtggattgaagagaatccttggatggaagataagacacatgtctccagctggggagacgtgccctatctgggcaaacgggaggaccagtggtgcgggtctctcatcggactgaccgccagagccacgtgggcttccaacattcaggtggccatcaatcaggttcggagactgatcggcaacgagaattacctcgattacatgacaagcatgaagcgcttcaaaaacgaaggggaccccgagggcgcgctgtggtga

SEQ ID NO: 19107 - RNA, 9879 nt, synthetic construct
  misc_feature 1..9879: note = derived and/or modified CDS sequence (opt5) from DENV-1__GQ199840__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgccatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagtttacggttgtggtcggagatgtggctggcattctggcccaggggaaaaagatgatccggccgcaacccatggagtacaaatatagctggaagtcctggggaaaggccaaaattatcggcgctgacgtgcagaatacaaccttcatcattgatgggcctaacacccccgaatgtcctgacgatcagagagcgtggaatatctgggaggtcgaggactacggatttggcattttcacaaccaacatctggctcaagctgcgcgatagctatacgcaggtttgcgaccaccggctgatgtctgccgctattaaagattccaaggccgtgcacgccgacatgggctactggatcgaaagcgagaaaaatgaaacatggaaacttgctagagcctctttcatcgaggtgaagacctgtatttggcccaaatcccatacactctggagcaacggggtcctggaatctgagatgatcattccgaagatctatggaggccctattagccaacacaattaccgccccgggtactttacccagacagcgggaccttggcatctgggcaaactcgagctggatttcgacctttgcgaagggaccacggtggttgtggatgagcactgcggaaaccggggcccctccctgagaaccacaaccgtcacaggcaagatcatccacgaatggtgttgccggagctgtaccctccctcccctgcgctttaaaggggaggacggatgctggtatggcatggagattagaccggtgaaggaaaaggaggaaaatctggttaaatctatggtgtccgctgggagcggagaggtcgactccttctctcttggcctcctgtgtatcagcattatgatcgaagaggtgatgcggtccagatggtctcgcaagatgctgatgacggggacactcgccgtctttttcctgcttattaccggacagctgacatggaacgatctcatccggctgtgcattatggtgggcgccaatgctagcgacagaatgggcatggggaccacctacctggcccttatggcgacatttaaaatgcgccctatgttcgctgtcggactgctctttagacggctgacgtcccgcgaggtgctcctgcttaccatcggcctgtctctcgtggccagcgtcgaactgcccaactccctggaggaacttggggatggactggccatgggcatcatgattctcaagctgctcacagacttccaaagccatcagctgtgggctacccttctgtctctcacatttatcaaaaccacgttctccctgcactatgcctggaagacaatggctatggttctgagcattgtgtctctttttcccctgtgtctctccaccaccagccagaagacaacctggctgcctgtgctcctggggtctcttggatgcaaaccgctgacaatgttcctgatcgccgagaataagatttggggcagaaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggacgatgaagatcaaagatgaggagcgggacgataccctcacaatcctgcttaaggccaccctgctcgctgtgagcggagtctatcctctgtccattcccgccacactcttcgtgtggtacttttggcaaaagaaaaagcagcgctctggcgtcctgtgggacatcccttcccctcccgaagtggagagagccgttcttgatgacggcatttatcggatcatgcagcgcgggctgctgggaagatcccaggtgggcgtcggggtgttccaagaaaacgtttttcataccatgtggcacgtgacgcggggagctgtcctcatgtaccagggcaaacgcctggagcccagctgggcctctgtgaagaaagaccttatttcctacgggggaggctggagactgcagggcagctggaataccggggaggaagtgcaggttatcgcggtcgagcccggaaagaaccctaagaatgtgcaaacagctcccggcaccttcaaaacatctgaaggggaggtgggagccattgccctcgattttaagccgggcacctccgggagccctatcgtcaaccgggaaggaaaaatcgtgggcctgtatggcaatggggttgtgacaacgtccggaacctacgtctctgctattgcccaggcgaaggctagccaggagggccccctccctgagatcgaagacgaggtgttcagaaaacgcaacctgacaattatggatcttcaccccgggtccggaaagacccggagatatctgcccgccatcgttcgcgaagccattaagcggaaactgagaaccctcatcctggctcctacacgcgtggtcgccagcgagatggctgaagcccttaagggcatgccgatccggtaccaaacgaccgcggtgaaatctgagcatacagggaaggagattgttgacctgatgtgccacgccacctttacaatgagactcctgtcccccgtgcgcgtccctaattataacatgatcattatggatgaagctcatttcaccgaccccagctctatcgccgctcggggctacattagcacgagagtgggaatgggcgaggccgccgctatctttatgacagcgacccctcccgggtccgtggaagccttccctcagtctaatgctgtcatccaggatgaggaacgggacattccggagcgcagctggaactccggatatgagtggatcaccgattttcccggcaaaacagtttggttcgtgccttctattaagagcgggaatgacatcgccaactgtctgagaaagaatggaaaacgggtgattcagctctcccgcaagaccttcgatacagaataccagaagaccaagaacaacgactgggactacgtcgtgacgacagatatcagcgagatgggcgccaattttagagctgaccgggttattgatcccagacgctgccttaaacctgtgatcctgaaggacgggcccgaacgggtcatcctggccggcccgatgcctgtgaccgttgcgtctgctgcccagagacgcggacggattggcagaaaccacaataaggagggggatcagtatatctacatgggacagcccctcaacaatgacgaggatcatgcccactggacagaagctaaaatgctgcttgacaacattaatacccccgagggcatcattcctgccctgttcgaacccgagcgcgaaaagtccgcggccatcgatggggagtatcggctcagaggagaggctcgcaaaacgtttgtggaactgatgagacggggcgacctgcctgtctggctcagctacaaggtggcctccgaggggttccaatattctgatcgcagatggtgctttgacggcgaacggaacaatcaggtccttgaggaaaacatggatgtggagatctggaccaaagagggagaacgcaagaaactgagaccgcggtggctggacgctagaacatacagcgaccccctcgccctgcgcgagttcaaggaatttgctgccggccggagatccgtttctggggatcttattctggagatcggaaagctccctcagcacctgacccagcgcgcgcaaaatgccctggacaacctcgtgatgcttcataatagcgaacagggcgggcgggcttatagacacgccatggaggagctgcccgatacaattgaaaccctgatgctcctggctcttatcgccgtgctgacaggaggcgtcaccctcttctttctgtccggccgggggctgggaaaaacgagcattggcctcctttgtgttatggcctcttccgtgctgctgtggatggctagcgtggagcctcattggatcgcggcctctatcattctcgagttctttctgatggtccttctgatccccgagccggaccgccagagaacacctcaggataaccaactcgcttacgtggttattgggctgctgttcatgatcctcaccgtggccgccaatgagatgggacttctggaaaccacaaagaaagacctgggcattgggcacgtcgctgccgagaaccaccatcacgcggccatgctcgatgtggacctgcatcccgcttccgcctggaccctttacgctgtcgccacaacgatcattacccctatgatgcggcacacaatcgaaaacaccacagcgaatatcagcctgaccgccattgctaaccaggccgctatcctcatgggactggataagggctggcccatttctaaaatggacatcggcgtgcctctgctcgcccttgggtgctatagccaggttaatcccctgacgctgaccgctgccgtgctcatgctggtcgcgcattacgccattatcggaccgggccttcaagctaaggccacacgcgaggctcagaagagaaccgccgccgggatcatgaaaaaccctacagtggatggaattgttgcgatcgacctggatcccgtggtctatgacgctaagtttgaaaaacagctcggccagattatgctgctgatcctctgtacctcccaaattcttctgatgcggacgacatgggccctgtgcgagtctatcaccctcgctacagggcccctgaccaccctttgggagggaagccctggcaagttctggaatacaacgatcgccgtgtccatggccaacattttccgcggcagctacctggctggggccggactcgcgttttccctgatgaaatctctgggcgggggaagacggggcaccggggcccagggagaaacactcggcgagaagtggaagcgccagcttaatcagctgagcaaatccgagttcaacacctataagagatctggcatcatggaggtggaccggagcgaagctaaagaggggctgaagagaggagagacaaccaaacacgccgtttcccgcggcacggctaagctccggtggtttgtcgaaagaaatctggtgaagccggaggggaaagtgattgatcttggatgtggccgcgggggatggtcttactattgcgccggcctgaagaaagtcacagaagttaagggctacaccaaagggggacccggccacgaggaacctatccccatggcgacctacgggtggaacctcgtgaagctgcatagcggaaaagacgtgttctttattcctcccgagaagtgtgatacactgctctgcgacatcggcgagtccagccctaatccgaccattgaagaggggcggacacttagagtcctgaagatggtggaaccctggctgcgcggaaaccaattctgtatcaaaatcctcaatccttatatgccctctgttgtggagacgctggagcagatgcagcggaagcacggcggcatgcttgtcagaaaccctctgtcccgcaatagcacccatgaaatgtactgggtgtcttgcgggacaggaaacattgtttccgccgtgaatatgaccagccggatgctcctgaacagatttacaatggctcaccgcaaacccacctatgagcgggatgtcgacctgggcgccgggacgagacacgtggctgtggaaccggaggtcgccaacctcgatatcattggacagcgcatcgaaaatattaagcatgagcacaaatctacctggcattacgacgaggataacccttataagacatgggcttaccacggctcctatgaagttaagcccagcgggtccgccagctctatggtgaatggagtggtcaaactgcttaccaagccctgggacgtgatccctatggttacacaaatcgcgatgaccgatacaacccccttcggccagcagagagtgtttaaagagaaggtcgacacgcggacacctaaagccaagcgcggcaccgctcaaattatggaagtgaccgccaagtggctgtgggggttcctcagcagaaacaaaaagccgcggatctgtacaagagaggaatttacgcggaaagttcgctccaatgctgccattggagccgtgttcgtcgacgagaaccagtggaactctgcgaaggaggctgtggaagatgagagattttgggacctggttcatcgggaacgcgagcttcacaaacagggcaagtgcgcgacctgcgtgtacaacatgatggggaagagagagaagaagctgggagagttcggcaaagccaaggggagccgggctatctggtacatgtggctcggcgcccgcttcctggagtttgaagctctgggattcatgaatgaggatcactggttttccagagaaaactctctcagcggcgtcgagggggagggactgcataaacttggctatattctgcgggacatctccaagatccccgggggaaatatgtacgccgatgacacagcgggctgggatacccgcattacagaagacgatctccagaacgaggccaaaatcaccgacattatggaacctgagcacgctctgcttgccaagtctatcttcaagctgacatatcaaaataaagtggtcagagtgcagcggcccgctaagaacgggaccgttatggatgtgattagccgcagagaccagcggggctccggacaggtcggcacgtacgggctcaatacctttacaaacatggaagcccaactgatccgccagatggagagcgagggaatcttctctccttccgaactggagacccccaacctcgcgggcagagtgctggattggcttgaaaaatatggggtggagcggctgaagagaatggccattagcggagacgactgtgttgtgaaaccgatcgatgaccgctttgctacagccctcaccgctctgaatgatatgggcaaggtccggaaggacattcctcagtgggaaccctctaaagggtggaacgattggcagcaagtgcctttctgctcccatcactttcaccagcttatcatgaaggacggcagagagattgttgtgccctgtcgcaatcaggatgagctggtcggacgggccagagtgagccagggcgctgggtggtccctccgcgaaacggcctgcctgggaaaatcttacgcgcaaatgtggcagctgatgtatttccatcggagagacctccgcctggccgctaacgccatctgtagcgccgtccctgtggattgggttcccacatcccggaccacatggagcattcacgctcatcaccagtggatgaccacggaggacatgctttctgtgtggaatagagtctggatcgaagagaacccgtggatggaagataagacccatatctccagctggggcgacgtgccttacctggggaaacgcgaggaccaatggtgcggatctctcattggcctgacagcccgggcgacctgggctacaaatatccaggttgccattaaccaggtgagacggcttatcgggaatgagaactacctggattatatgaccagcatgaagagatttaagaatgaatccgaccccgagggcgccctctggtga

SEQ ID NO: 19108 - RNA, 9879 nt, synthetic construct
  misc_feature 1..9879: note = derived and/or modified CDS sequence (opt5) from DENV-1__FJ898405__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaaatccctcctgtttaagacctctgccggcgttaatatgtgcacccttattgccatggacctgggggaactctgtgaagataccatgacatacaaatgcccgcgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagcaatattgggaagatgtttgaggccacagctagaggcgcccgccggatggcgatcctgggagataccgcctgggacttcggctccatcgggggagtgtttacatctgttggcaaactggtccatcagattttcgggaccgcttacggagtgctctttagcggcgtgtcctggacgatgaagatcgggattggcgtcctgcttacctggctgggactcaacagcagatctacatccctgagcatgacctgtatcgccgtgggcctggttacactttacctcggggtgatggtccaggctgattctggatgcgtgattaattggaaaggccgcgaactgaagtgtgggtccggaatcttcgttaccaacgaggtgcacacatggaccgaacaatataagtttcaggccgacagccctaaacggctgtccgcggccattggcaaggcttgggaggagggggtctgcggcatcagatctgccacgcgcctcgaaaacatcatgtggaaacagattagcaatgagctgaaccatatccttctggaaaatgacatgaagttcacagtggttgtgggagatgtcgtgggcattctcgctcaggggaaaaagatgatccggccgcaacccatggagcacaaatactcctggaagtcttggggaaaggccaaaattatcggcgccgacgtgcagaacaccacctttatcattgatgggcctaatacacccgaatgtcctgacgatcagagagcttggaacatctgggaggtcgaggactatggattcggcatttttaccacgaatatctggctgaagctgcgcgatagctacacacaggtttgcgaccaccggcttatgtccgcggccattaaagatagcaaggctgtgcatgccgacatgggctattggatcgaatctgagaaaaacgaaacctggaagctcgccagagcttccttcatcgaggtgaagacatgtatttggcccaaaagccacaccctgtggtctaatggggtcctggaatccgagatgatcattccgaagatctacggaggccctattagccaacataactatcgccccgggtacttcacacagaccgccggaccttggcacctcggcaaactggagcttgattttgacctgtgcgaagggacgaccgtggttgtggatgagcactgcggaaatcggggcccctctctcagaacaaccacagtcaccggcaagatcatccatgaatggtgttgccggagctgtacgctgcctcccctgcgcttcaaaggggaggacggatgctggtacggcatggagattagaccggtgaaggaaaaggaggaaaaccttgttaaatccatggtgagcgcggggtctggagaggtcgactcctttagcctcggcctgctgtgtatctccattatgatcgaagaggtgatgcggtctagatggagccgcaagatgctcatgacagggaccctggctgttttccttctgctcattatgggacagctgacatggaatgatctgatccggctttgcattatggtgggcgccaacgcctccgacagaatgggcatggggaccacctatctggctctcatggccacatttaaaatgcgccctatgttcgcggtcggactgctctttagacggctgacgtctcgcgaggtgcttctgctcaccatcggcctgagcctggtggcttccgtcgaacttcccaattctctggaggaactcggggatggactggccatgggcatcatgattctcaagctgcttacagacttccaaagccaccagctgtgggccaccctcctgtccctgacatttatcaaaaccacgcttagcctgcattacgcttggaagacaatggccatggttctctctattgtgtccctgttccccctctgtctgagcaccacctctcagaagacaacctggcttcctgtgctgctggggtccctcggatgcaaaccgctgacaatgtttcttatcgctgagaacaagatttggggcagaaaaagctggcccctgaacgaaggcatcatggccgtcggggtggtttctatcctcctgtccagcctcctgaagaatgatgtgcctcttgcgggacccctgattgccggcgggatgctgatcgcttgttatgtcatttccggaagctctgccgacctcagcctggagaaagctgccgaggtgtcctgggaagaggaagccgagcactctggcgctagccataacatccttgttgaagtgcaggatgacgggacgatgaagattaaagatgaggagcgggacgataccctgacaatcctcctgaaggcgaccctcctggccgtctccggagtgtaccctctttctatccccgctacactgttcgtctggtatttttggcaaaagaaaaagcagcgcagcggcgtgctgtgggacacccctagccctcccgaagttgagagagccgtgctcgatgacggcatttaccggatcatgcagcgcgggctgcttggaagatctcaggtcggcgtgggggttttccaagaaaatgtgttccacacgatgtggcacgtcacccggggagccgtgctgatgtatcagggcaaacgcctcgagcccagctgggcttccgtgaagaaagacctgattagctacgggggaggctggagactccagggctcttggaacacaggggaggaagttcaggtcatcgccgtggagcccggaaagaatcctaagaacgtgcaaaccgcgcccggcacatttaaaaccccggaaggggaggtcggagctattgccctggatttcaagcctggcacatccgggagccccatcgtgaatcgggaaggaaaaattgttggcctttacggcaacggggtggtcacgacctctggaacatatgtgtccgccatcgctcaggccaaggcgagccaggagggccctctgcccgagatcgaagacgaggtttttagaaaacgcaatctgaccattatggatctccatcccgggtccggaaagacccggagatacctgcctgctatcgtgcgcgaagccattaagcggaaacttagaacactgatcctcgccccgacgcgcgtcgtggcttctgagatggccgaagctctgaagggcatgcccattcggtatcaaaccacagccgttaaaagcgagcacaccgggaaggagatcgtggacctgatgtgccatgcgacattcaccatgagactcctttcccctgtccgcgtgcccaactacaatatgatcattatggatgaagcccactttacggaccctagctctatcgctgcccggggctatatttccacaagagtgggaatgggcgaggctgccgccatcttcatgaccgctacaccccctgggagcgtcgaagcgtttccgcagtctaacgccgttattcaggatgaggaacgggacatccccgagcgcagctggaactccggatacgagtggatcacagatttccctggcaaaaccgtgtggtttgtgccctctattaagagcgggaacgacatcgctaattgtctgagaaagaacggaaaacgggtcattcagctgtcccgcaagacattcgataccgaatatcagaagacgaagaacaatgactgggactacgtggttacaaccgatatctctgagatgggcgccaactttagagccgaccgggtgattgatcctagacgctgcctcaaacccgtcatcctgaaggacgggccggaacgggtgattcttgctggccctatgcccgttacagtggccagcgcggctcagagacgcggacggatcggcagaaatcataacaaggagggggatcagtacatctatatgggacagcccctgaataacgacgaggatcacgcccactggaccgaagccaaaatgctcctggacaatattaacacgcctgagggcatcattcccgctctgttcgaacctgagcgcgaaaagtccgccgcgatcgatggggagtaccggctcagaggagaggcccgcaaaaccttcgtcgaacttatgagacggggcgacctgccggtgtggctgagctataaggtcgcttctgaggggtttcaatactccgatcgcagatggtgcttcgacggcgaacggaataaccaggtgctcgaggaaaatatggatgttgagatttggacaaaagagggagaacgcaagaaactgagaccccggtggcttgacgccagaacctatagcgaccctctggctctccgcgagtttaaggagttcgccgctggccggagatccgtgtctggggatctgatcctggagatcggaaagctcccccagcatcttacacagcgcgcccaaaacgcgctggacaatctggtgatgctccacaacagcgaacagggcgggcgggcctacagacatgctatggaggagctgcctgataccattgaaacacttatgctgctcgccctgatcgctgtcctgaccggaggcgttacgctctttttcctttccggccgggggctgggaaaaacatctattggcctgctctgtgtgatggccagctccgtgctgctttggatggccagcgtcgagccccactggatcgctgcgtctattatcctggaatttttcctcatggtgctgctgatcccggagcctgaccgccagagaacaccccaggataatcaactcgcctatgttgtgattgggcttctgtttatgatcctgaccgtcgctgccaacgagatgggactcctggaaacaaccaagaaagaccttggcattgggcacgtggccgtcgagaaccatcaccatgctacaatgctggatgtggacctccaccctgcctccgcgtggacgctgtacgccgttgctaccacaatcattacccccatgatgcggcatacaatcgaaaataccacggccaacattagcctgaccgctatcgccaatcaggcggccatcctcatgggacttgataagggctggcctatttctaaaatggacatcggcgtgcccctgctggctctcgggtgctactcccaggtcaacccgctgacacttaccgccgctgtgctgatgctcgttgcccactatgctattatcggacctggcctgcaagccaaggcgacacgcgaggcccagaagagaaccgctgccgggattatgaaaaatcccacggtggatggaatcgtcgctatcgacctggatcccgtggtgtacgacgccaagttcgaaaaacagctcggccagattatgcttctgatcctgtgtacaagccaaattctcctgatgcggaccacatgggccctttgcgagtctatcaccctggcgaccgggcctctcacaacgctgtgggagggaagcccgggcaagttttggaacaccacaattgctgtttccatggccaatatcttccgcggctcttatctggctggggccggactcgcctttagccttatgaaatccctgggcgggggaagacggggcaccggggctcagggagaaacactgggcgagaagtggaagcgccagctcaaccagctgagcaaatccgagttcaatatctacaagagatctggcattatggaggtcgaccggagcgaagccaaagaggggcttaagagaggagagaccacgcgccacgcggtgtcccggggcacagccaaactgagatggttcgtggaacgcaacctcgtcaagcccgaggggaaggttatcgatctgggatgtggcagagggggatggtcttattactgcgctggcctgaaaaaggtgaccgaagtgaaaggctataccaaagggggacctggccatgaggaacccattcctatggccacatacgggtggaatctcgtcaaacttcacagcggaaaggacgtgtttttcacaccccctgagaaatgtgatacactgctgtgcgacatcggcgagtcctctccgaaccccacgattgaagaggggagaaccctccgcgttctgaagatggtggaaccttggcttcggggaaatcaattttgtatcaagattctgaacccctacatgcctagcgtcgtggagacactcgagcagatgcagagaaaacatggcggcatgctggttcgcaatcccctgtcccggaacagcacccacgaaatgtattgggtgtcttgcgggacaggaaatatcgtctccgctgtgaacatgaccagcagaatgctcctgaaccgcttcacgatggcccaccggaagccgacctacgagagagatgtggaccttggcgcggggacacgccatgtcgccgttgaacctgaggtggctaatctggatatcattggacagagaatcgaaaacattaaacacgagcataagtctacctggcactatgacgaggataatccctacaaaacatgggcctatcatggctcctacgaagtgaagcccagcgggtctgcttccagcatggtcaacggagtggttaagctcctgaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctttgggggtttctgtccagaaataagaagccccggatctgtacccgcgaggagttcacaagaaaagtccggagcaacgccgctattggagccgtgtttgttgacgagaatcagtggaactctgctaaggaggccgtggaagatgagcgcttctgggacctcgtccagaaagaaagagagctgcacaagcagggcaaatgcgcgacctgcgtgtataatatgatggggaagcgggaaaagaaactgggagagtttggcaaggcgaaagggagccgcgctatctggtacatgtggctcggcgccagattcctggagtttgaagcccttggattcatgaacgaggatcactggttctcccgggaaaattctctgagcggcgtcgagggggagggactccataagctgggctacattcttcgcgacatctccaaaattcctgggggaaacatgtatgctgatgacacagccggctgggataccagaatcacagaagacgatctgcaaaatgaggctaagatcaccgacattatggaacccgagcacgccctcctggcgacgtctatctttaaactgacctaccagaacaaggtggttcgggtgcagcgccctgccaagaatgggacagtcatggatgtgattagcagacgggaccagcgcggctccggacaagtgggcacctatgggctcaacacattcaccaacatggaagctcagctgatcagacagatggagtctgagggaatttttagcccctccgaacttgagatcccgaatctggccgaacgggttctcgattggctggagaaatacggcgtggaaagacttaagcgcatggctatcagcggggacgactgtgtcgtgaaacctattgatgaccggttcgccacggcgctgacagccctcaacgatatgggaaaggttagaaaagacgtgccccagtgggagccttctaagggctggaatgattggcaacaggtccccttttgctcccatcacttccaccagctgatcatgaaggacgggcgcgagattgtggtcccttgtcggaaccaggatgaactggtgggcagagctcgcgttagccaaggagccggctggtctctccgggagaccgcttgcctggggaaatcctatgcccagatgtggcagcttatgtactttcatagacgcgacctgcggctcgctgccaatgcgatctgtagcgccgtgcccgtcgattgggtgccgacatccagaaccacgtggtctattcacgctcatcaccaatggatgaccacagaagacatgctgagcgtttggaaccgcgtgtggatcgaggaaaatccttggatggaggataagacccatgtctccagctggggagacgtgccctatcttggcaaacgggaggaccagtggtgcgggtctctgattggactcacagccagagccacctgggcttccaacatccaggtggccatcaatcaggttcggagactgattggcaacgaaaattacctggattacatgacaagcatgaagcgcttcaaaaacgagggggaccccgaaggcgcgctctggtga

SEQ ID NO: 19109 - RNA, 9879 nt, synthetic construct
  misc_feature 1..9879: note = derived and/or modified CDS sequence (opt5) from DENV-1__FJ898406__SS-prME
  source 1..9879: mol_type = other RNA
tccgtgaccatgctgctcatgctgatgcccaccgcccttgctttccacctgacgaccagaggcggggaacctcatatgatcgtcaccaagcaggaacggggaaaatccctcctgtttaagacctctgccggcgttaatatgtgcacccttattgccatggacctgggggaactctgtgaagataccatgacatacaaatgcccgcgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagcaatattgggaagatgtttgaggccacagctagaggcgcccgccggatggcgatcctgggagataccgcctgggacttcggctccatcgggggagtgtttacatctgttggcaaactggtccatcagattttcgggaccgcttacggagtgctctttagcggcgtgtcctggacgatgaagatcgggattggcgtcctgcttacctggctgggactcaacagcagatctacatccctgagcatgacctgtatcgccgtgggcctggttacactttacctcggggtgatggtccaggctgattctggatgcgtgattaattggaaaggccgcgaactgaagtgtgggtccggaatcttcgttaccaacgaggtgcacacatggaccgaacaatataagtttcaggccgacagccctaaacggctgtccgcggccattggcaaggcttgggaggagggggtctgcggcatcagatctgccacgcgcctcgaaaacatcatgtggaaacagattagcaatgagctgaaccatatccttctggaaaatgacatgaagttcacagtggttgtgggagatgtcgtgggcattctcgctcaggggaaaaagatgatccggccgcaacccatggagcacaaatactcctggaagtcttggggaaaggccaaaattatcggcgccgacgtgcagaacaccacctttatcattgatgggcctaatacacccgaatgtcctgacgatcagagagcttggaacatctgggaggtcgaggactatggattcggcatttttaccacgaatatctggctgaagctgcgcgatagctacacacaggtttgcgaccaccggcttatgtccgcggccattaaagatagcaaggctgtgcatgccgacatgggctattggatcgaatctgagaaaaacgaaacctggaagctcgccagagcttccttcatcgaggtgaagacatgtatttggcccaaaagccacaccctgtggtctaatggggtcctggaatccgagatgatcattccgaagatctacggaggccctattagccaacataactatcgccccgggtacttcacacagaccgccggaccttggcacctcggcaaactggagcttgattttgacctgtgcgaagggacgaccgtggttgtggatgagcactgcggaaatcggggcccctctctcagaacaaccacagtcaccggcaagatcatccatgaatggtgttgccggagctgtacgctgcctcccctgcgcttcaaaggggaggacggatgctggtacggcatggagattagaccggtgaaggaaaaggaggaaaaccttgttaaatccatggtgagcgcggggtctggagaggtcgactcctttagcctcggcctgctgtgtatctccattatgatcgaagaggtgatgcggtctagatggagccgcaagatgctcatgacagggaccctggctgttttccttctgctcattatgggacagctgacatggaatgatctgatccggctttgcattatggtgggcgccaacgcctccgacagaatgggcatggggaccacctatctggctctcatggccacatttaaaatgcgccctatgttcgcggtcggactgctctttagacggctgacgtctcgcgaggtgcttctgctcaccatcggcctgagcctggtggcttccgtcgaacttcccaattctctggaggaactcggggatggactggccatgggcatcatgattctcaagctgcttacagacttccaaagccaccagctgtgggccaccctcctgtccctgacatttatcaaaaccacgcttagcctgcattacgcttggaagacaatggccatggttctctctattgtgtccctgttccccctctgtctgagcaccacctctcagaagacaacctggcttcctgtgctgctggggtccctcggatgcaaaccgctgacaatgtttcttatcgctgagaacaagatttggggcagaaaaagctggcccctgaacgaaggcatcatggccgtcggggtggtttctatcctcctgtccagcctcctgaagaatgatgtgcctcttgcgggacccctgattgccggcgggatgctgatcgcttgttatgtcatttccggaagctctgccgacctcagcctggagaaagctgccgaggtgtcctgggaagaggaagccgagcactctggcgctagccataacatccttgttgaagtgcaggatgacgggacgatgaagattaaagatgaggagcgggacgataccctgacaatcctcctgaaggcgaccctcctggccgtctccggagtgtaccctctttctatccccgctacactgttcgtctggtatttttggcaaaagaaaaagcagcgcagcggcgtgctgtgggacacccctagccctcccgaagttgagagagccgtgctcgatgacggcatttaccggatcatgcagcgcgggctgcttggaagatctcaggtcggcgtgggggttttccaagaaaatgtgttccacacgatgtggcacgtcacccggggagccgtgctgatgtatcagggcaaacgcctcgagcccagctgggcttccgtgaagaaagacctgattagctacgggggaggctggagactccagggctcttggaacacaggggaggaagttcaggtcatcgccgtggagcccggaaagaatcctaagaacgtgcaaaccgcgcccggcacatttaaaaccccggaaggggaggtcggagctattgccctggatttcaagcctggcacatccgggagccccatcgtgaatcgggaaggaaaaattgttggcctttacggcaacggggtggtcacgacctctggaacatatgtgtccgccatcgctcaggccaaggcgagccaggagggccctctgcccgagatcgaagacgaggtttttagaaaacgcaatctgaccattatggatctccatcccgggtccggaaagacccggagatacctgcctgctatcgtgcgcgaagccattaagcggaaacttagaacactgatcctcgccccgacgcgcgtcgtggcttctgagatggccgaagctctgaagggcatgcccattcggtatcaaaccacagccgttaaaagcgagcacaccgggaaggagatcgtggacctgatgtgccatgcgacattcaccatgagactcctttcccctgtccgcgtgcccaactacaatatgatcattatggatgaagcccactttacggaccctagctctatcgctgcccggggctatatttccacaagagtgggaatgggcgaggctgccgccatcttcatgaccgctacaccccctgggagcgtcgaagcgtttccgcagtctaacgccgttattcaggatgaggaacgggacatccccgagcgcagctggaactccggatacgagtggatcacagatttccctggcaaaaccgtgtggtttgtgccctctattaagagcgggaacgacatcgctaattgtctgagaaagaacggaaaacgggtcattcagctgtcccgcaagacattcgataccgaatatcagaagacgaagaacaatgactgggactacgtggttacaaccgatatctctgagatgggcgccaactttagagccgaccgggtgattgatcctagacgctgcctcaaacccgtcatcctgaaggacgggccggaacgggtgattcttgctggccctatgcccgttacagtggccagcgcggctcagagacgcggacggatcggcagaaatcataacaaggagggggatcagtacatctatatgggacagcccctgaataacgacgaggatcacgcccactggaccgaagccaaaatgctcctggacaatattaacacgcctgagggcatcattcccgctctgttcgaacctgagcgcgaaaagtccgccgcgatcgatggggagtaccggctcagaggagaggcccgcaaaaccttcgtcgaacttatgagacggggcgacctgccggtgtggctgagctataaggtcgcttctgaggggtttcaatactccgatcgcagatggtgcttcgacggcgaacggaataaccaggtgctcgaggaaaatatggatgttgagatttggacaaaagagggagaacgcaagaaactgagaccccggtggcttgacgccagaacctatagcgaccctctggctctccgcgagtttaaggagttcgccgctggccggagatccgtgtctggggatctgatcctggagatcggaaagctcccccagcatcttacacagcgcgcccaaaacgcgctggacaatctggtgatgctccacaacagcgaacagggcgggcgggcctacagacatgctatggaggagctgcctgataccattgaaacacttatgctgctcgccctgatcgctgtcctgaccggaggcgttacgctctttttcctttccggccgggggctgggaaaaacatctattggcctgctctgtgtgatggccagctccgtgctgctttggatggccagcgtcgagccccactggatcgctgcgtctattatcctggaatttttcctcatggtgctgctgatcccggagcctgaccgccagagaacaccccaggataatcaactcgcctatgttgtgattgggcttctgtttatgatcctgaccgtcgctgccaacgagatgggactcctggaaacaaccaagaaagaccttggcattgggcacgtggccgtcgagaaccatcaccatgctacaatgctggatgtggacctccaccctgcctccgcgtggacgctgtacgccgttgctaccacaatcattacccccatgatgcggcatacaatcgaaaataccacggccaacattagcctgaccgctatcgccaatcaggcggccatcctcatgggacttgataagggctggcctatttctaaaatggacatcggcgtgcccctgctggctctcgggtgctactcccaggtcaacccgctgacacttaccgccgctgtgctgatgctcgttgcccactatgctattatcggacctggcctgcaagccaaggcgacacgcgaggcccagaagagaaccgctgccgggattatgaaaaatcccacggtggatggaatcgtcgctatcgacctggatcccgtggtgtacgacgccaagttcgaaaaacagctcggccagattatgcttctgatcctgtgtacaagccaaattctcctgatgcggaccacatgggccctttgcgagtctatcaccctggcgaccgggcctctcacaacgctgtgggagggaagcccgggcaagttttggaacaccacaattgctgtttccatggccaatatcttccgcggctcttatctggctggggccggactcgcctttagccttatgaaatccctgggcgggggaagacggggcaccggggctcagggagaaacactgggcgagaagtggaagcgccagctcaaccagctgagcaaatccgagttcaatatctacaagagatctggcattatggaggtcgaccggagcgaagccaaagaggggcttaagagaggagagaccacgcgccacgcggtgtcccggggcacagccaaactgagatggttcgtggaacgcaacctcgtcaagcccgaggggaaggttatcgatctgggatgtggcagagggggatggtcttattactgcgctggcctgaaaaaggtgaccgaagtgaaaggctataccaaagggggacctggccatgaggaacccattcctatggccacatacgggtggaatctcgtcaaacttcacagcggaaaggacgtgtttttcacaccccctgagaaatgtgatacactgctgtgcgacatcggcgagtcctctccgaaccccacgattgaagaggggagaaccctccgcgttctgaagatggtggaaccttggcttcggggaaatcaattttgtatcaagattctgaacccctacatgcctagcgtcgtggagacactcgagcagatgcagagaaaacatggcggcatgctggttcgcaatcccctgtcccggaacagcacccacgaaatgtattgggtgtcttgcgggacaggaaatatcgtctccgctgtgaacatgaccagcagaatgctcctgaaccgcttcacgatggcccaccggaagccgacctacgagagagatgtggaccttggcgcggggacacgccatgtcgccgttgaacctgaggtggctaatctggatatcattggacagagaatcgaaaacattaaacacgagcataagtctacctggcactatgacgaggataatccctacaaaacatgggcctatcatggctcctacgaagtgaagcccagcgggtctgcttccagcatggtcaacggagtggttaagctcctgaccaaaccttgggacgtgatccccatggtcacacaaattgccatgaccgatacgacaccttttggccagcagcgggtgttcaaggagaaagttgacacccgcaccccgaaggctaaaagaggcacagcccaaatcatggaagtgacggcgcggtggctttgggggtttctgtccagaaataagaagccccggatctgtacccgcgaggagttcacaagaaaagtccggagcaacgccgctattggagccgtgtttgttgacgagaatcagtggaactctgctaaggaggccgtggaagatgagcgcttctgggacctcgtccagaaagaaagagagctgcacaagcagggcaaatgcgcgacctgcgtgtataatatgatggggaagcgggaaaagaaactgggagagtttggcaaggcgaaagggagccgcgctatctggtacatgtggctcggcgccagattcctggagtttgaagcccttggattcatgaacgaggatcactggttctcccgggaaaattctctgagcggcgtcgagggggagggactccataagctgggctacattcttcgcgacatctccaaaattcctgggggaaacatgtatgctgatgacacagccggctgggataccagaatcacagaagacgatctgcaaaatgaggctaagatcaccgacattatggaacccgagcacgccctcctggcgacgtctatctttaaactgacctaccagaacaaggtggttcgggtgcagcgccctgccaagaatgggacagtcatggatgtgattagcagacgggaccagcgcggctccggacaagtgggcacctatgggctcaacacattcaccaacatggaagctcagctgatcagacagatggagtctgagggaatttttagcccctccgaacttgagatcccgaatctggccgaacgggttctcgattggctggagaaatacggcgtggaaagacttaagcgcatggctatcagcggggacgactgtgtcgtgaaacctattgatgaccggttcgccacggcgctgacagccctcaacgatatgggaaaggttagaaaagacgtgccccagtgggagccttctaagggctggaatgattggcaacaggtccccttttgctcccatcacttccaccagctgatcatgaaggacgggcgcgagattgtggtcccttgtcggaaccaggatgaactggtgggcagagctcgcgttagccaaggagccggctggtctctccgggagaccgcttgcctggggaaatcctatgcccagatgtggcagcttatgtactttcatagacgcgacctgcggctcgctgccaatgcgatctgtagcgccgtgcccgtcgattgggtgccgacatccagaaccacgtggtctattcacgctcatcaccaatggatgaccacagaagacatgctgagcgtttggaaccgcgtgtggatcgaggaaaatccttggatggaggataagacccatgtctccagctggggagacgtgccctatcttggcaaacgggaggaccagtggtgcgggtctctgattggactcacagccagagccacctgggcttccaacatccaggtggccatcaatcaggttcggagactgattggcaacgaaaattacctggattacatggcgagcatgaagcgcttcaaaaacgagggggaccccgaaggcgctctctggtga

SEQ ID NO: 19110 - RNA, 9879 nt, synthetic construct
  misc_feature 1..9879: note = derived and/or modified CDS sequence (opt5) from DENV-1__GQ199841__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctccgctgacctttctctggagaaggccgccgaggtcagctgggaagaggaagctgagcattccggcgcgtctcacaatatcctggtggaagttcaggatgacgggacgatgaaaattaaggatgaggagcgggacgataccctcacaatcctgcttaaggccaccctgctcgctgtgagcggagtctatcctctgtccatccccgccacactcttcgtgtggtacttttggcagaaaaagaaacaacgctctggcgtcctgtgggacaccccttcccctcccgaagtggagagagccgttcttgatgacggcatttatcggatcatgcagcgcgggctgctgggaagatcccaggtgggcgtcggggtgttccaggaaaacgtttttcatacgatgtggcacgtgacccggggagctgtcctcatgtaccaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtatggcaatggggttgtgacgacctccggaacatacgtctctgctatcgcccaagcgaaagctagccaggagggccccctccctgagatcgaagacgaggtgttcagaaagcgcaacctgaccattatggatcttcaccccgggtccggaaagacccggagatatctgcccgccatcgttcgcgaagccattaaacggaagctgagaacactcatcctggctcctacgcgcgtggtcgccagcgagatggctgaagcccttaaaggcatgccgattcggtaccagaccacagcggtgaagtctgagcataccgggaaagagatcgttgacctgatgtgccacgccacatttaccatgagactcctgtcccccgtgcgcgtccctaattataacatgatcattatggatgaagctcatttcacggaccccagctctatcgccgctcggggctacattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatatgagtggatcacagattttcccggcaagaccgtttggttcgtgccttctattaagagcgggaatgacatcgccaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccacaataaagagggggatcagtatatctacatgggacagcccctcaacaatgacgaggatcatgcccactggaccgaagctaagatgctgcttgacaacattaatacgcccgagggcatcattcctgccctgttcgaacccgagcgcgaaaaatccgcggccatcgatggggagtatcggctcagaggagaggctcgcaagacctttgtggaactgatgagacggggcgacctgcctgtctggctcagctacaaagtggcctccgaggggttccagtattctgatcgcagatggtgctttgacggcgaacggaacaatcaagtccttgaggaaaacatggatgtggagatttggacaaaggagggagaacgcaaaaagctgagaccgcggtggctggacgctagaacctacagcgaccccctcgccctgcgcgagttcaaggaatttgctgccggccggagatccgtttctggggatcttatcctggagatcggaaaactccctcagcacctgacacagcgcgcgcagaatgccctggacaacctcgtgatgcttcataatagcgaacaaggcgggcgggcttatagacacgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgctctgctgtggatggcgagcgtggagcctcattggatcgccgcttctattatcctcgagttctttctgatggtgcttctgatccccgagccggaccgccagagaacccctcaggataaccagctcgcctacgtcgtgattgggctgctgttcatgatcctcaccgttgccgctaatgagatgggacttctggaaacaaccaaaaaggacctgggcattgggcacgtggccgtcgagaaccaccatcacgcggccatgctcgatgtggacctgcatcccgcttccgcctggacactttacgctgtcgccacgaccatcattacacctatgatgcggcacaccatcgaaaacacaaccgcgaatattagcctgacggccatcgctaaccaagccgctatcctcatgggactggataaaggctggcccatttctaagatggacatcggcgtgcctctgctcgcccttgggtgctatagccaggttaatcccctgaccctgacagctgccgtgctcatgctggtcgcgcattacgccattatcggaccgggccttcaggctaaggccacccgcgaggctcagaagagaacagccgccgggattatgaagaaccctaccgtggatggaatcgttgcgatcgacctggatcccgtggtctatgacgctaaatttgaaaagcagctcggccagattatgctgctgatcctctgtacgtcccagattcttctgatgcggacaacctgggccctgtgcgagtctatcacactcgctaccgggcccctgaccacactttgggagggaagccctggcaaattctggaatacgaccattgccgtgtccatggccaacatcttccgcggcagctacctggctggggccggactcgcgttttccctgatgaagtctctgggcgggggaagacggggcacaggggcccaaggagaaaccctcggcgagaagtggaaacgccagcttaatcagctgagcaagtccgagttcaacacatataaaagatctggcatcatggaggtggaccggagcgaagctaaggaggggctgaaaagaggagagaccacgaagcacgccgtttcccgcggcacagctaagctccggtggtttgtcgaaagaaatctggtgaaaccggaggggaaggtgattgatcttggatgtggccgcgggggatggtcttactattgcgccggcctgaaaaaggtcaccgaagttaaaggctacaccaaagggggacccggccacgaggaacctatccccatggcgacatacgggtggaacctcgtgaaactgcatagcggaaaggacgtgttctttattcctcccgagaagtgtgataccctgctctgcgacatcggcgagtccagccctaatccgacaattgaagaggggcggacgcttagagtcctgaaaatggtggaaccctggctgcgcggaaaccagttctgtatcaagattctcaatccttatatgccctctgttgtggagaccctggagcaaatgcagcggaaacacggcggcatgcttgtcagaaaccctctgtcccgcaatagcacacatgaaatgtactgggtgtcttgcgggaccggaaacatcgtttccgccgtgaatatgacaagccggatgctcctgaacagatttaccatggctcaccgcaagcccacgtatgagcgggatgtcgacctgggcgccgggaccagacacgtggctgtggaaccggaggtcgccaacctcgatatcattggacagcgcatcgaaaatattaaacatgagcacaagtctacatggcattacgacgaggataacccttataagacctgggcttaccacggctcctatgaagttaaacccagcgggtccgccagctctatggtgaatggagtggtcaagctgcttacaaaaccctgggacgtgatccctatggttacccagattgcgatgacagataccacgcccttcggccaacagagagtgtttaaggagaaagtcgacacacggacccctaaggccaagcgcggcaccgctcagatcatggaagtgacagccaaatggctgtgggggttcctcagcagaaacaagaaaccgcggatctgtacgagagaggaatttacccggaaggttcgctccaatgctgccattggagccgtgttcgtcgacgagaaccaatggaactctgcgaaagaggctgtggaagatgagagattttgggacctggttcatcgggaacgcgagcttcacaagcagggcaagtgcgccacatgcgtgtacaacatgatggggaaaagagaaaagaaactgggagagttcggcaaggccaaagggagccgggctatctggtacatgtggctcggcgcccgcttcctggagtttgaagctctgggattcatgaatgaggatcactggttttccagagaaaactctctcagcggcgtcgagggggagggactgcataaacttggctatattctgcgggacatctccaaaattcccgggggaaatatgtacgccgatgacaccgcgggctgggatacacgcatcaccgaagacgatctccagaacgaggccaagatcacagacattatggaacctgagcacgctctgcttgccaagtctatcttcaaactgacctatcagaataaggtggtcagagtgcaacggcccgctaaaaacgggacggttatggatgtgattagccgcagagaccagcggggctccggacaggtcggcacctacgggctcaatacatttaccaacatggaagcccagctgatccgccaaatggagagcgagggaattttctctccttccgaactggagacacccaacctcgcgggcagagtgctggattggcttgaaaagcatggggtggagcggctgaaaagaatggccatcagcggagacgactgtgttgtgaagccgatcgatgaccgctttgctaccgccctcacggctctgaatgatatgggcaaggtccggaaagacattcctcagtgggaaccctctaaggggtggaacgattggcaacaggtgcctttctgctcccaccactttcatcaacttatcatgaaagacggcagagagattgttgtgccctgtcgcaatcaggatgagctggtcggacgggccagagtgagccagggcgctgggtggtccctccgcgaaacagcctgcctgggaaagtcttatgcgcagatgtggcaactgatgtacttccaccggagagacctccgcctggccgctaacgccatctgtagcgccgtccctgtggattgggttcccacctcccggacaacctggagcattcatgctcaccatcagtggatgacgaccgaggacatgctttctgtgtggaatagagtctggatcgaagagaacccgtggatggaagataaaacacacatttccagctggggcgacgtgccttatctggggaagcgcgaggaccagtggtgcggatctctcatcggcctgaccgcccgggcgacatgggctaccaatatccaagttgccattaaccaggtgagacggcttatcgggaatgagaactacctggattacatgacaagcatgaagagatttaaaaatgaatccgaccccgagggcgccctctggtga

SEQ ID NO: 19111 - RNA, 9879 nt, synthetic construct
  misc_feature 1..9879: note = derived and/or modified CDS sequence (opt5) from DENV-1__FJ898407__SS-prME
  source 1..9879: mol_type = other RNA
agcgtgaccatgctgctcatgctgatgcccaccgctcttgctttccacctgacgaccagaggcggggaacctcatatgatcgtctccaagcaggaacggggaaagtctctcctgtttaagaccagcgccggcgttaatatgtgcacccttatcgcgatggacctgggggagctctgtgaagatacgatgacctacaagtgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccagacaaaggctagccaggagggccctctgcccgagattgaagacgaggtgttcagaaaacgcaaccttaccatcatggatctgcaccccgggtccggaaagacccggagatatctgcctgccattgtccgcgaagcgatcaagcggaaactcagaacactgattcttgctccgacgcgcgtggttgccagcgagatggccgaagctctgaagggcatgcccatccggtaccaaaccacagccgtgaaatctgagcataccgggagagagatcgtcgacctcatgtgccacgctacatttaccatgcgcctgctgtcccctgtgcgggtgcccaattataacatgattatcatggatgaagcccatttcacggaccctagctctattgcggccagaggctacatcagcacacgggtcggaatgggcgaggctgccgctatttttatgaccgccacaccccctgggtccgttgaagccttcccgcagtctaatgctgtgatccaggatgaggaacgcgacatccccgagagaagctggaactccggatatgagtggattacagattttcctggcaagaccgtgtggttcgtcccctctatcaaaagcgggaatgacattgcgaactgtctccggaagaatggaaagcgcgtgatccagctttccagaaaaacatttgataccgaataccaaaagacgaaaaacaacgactgggactacgttgtgacaaccgatattagcgagatgggcgccaatttccgggctgacagagtcatcgatcctcgccggtgcctgaagcccgtgattctgaaagacgggccggaaagagttatcctcgccggccctatgcccgtgacagtcgcctctgctgcccagcgccggggaagaatcggccgcaaccacaataaggagggggatcagtatatttacatgggacagcccctgaacaatgacgaggatcatgcgcactggaccgaagctaagatgcttctggacaacatcaatacgcctgagggcattatccccgccctcttcgaacctgagcgggaaaaatccgccgctattgatggggagtatagactgcgcggagaggccagaaagacctttgtggaactgatgcggcgcggcgacctcccggtctggcttagctacaaagtggcgtccgaggggttccaatattctgatagacggtggtgctttgacggcgaacgcaacaatcaggttctggaggaaaacatggatgtggagatctggacaaaggagggagaacgcaagaagctgcggcccagatggctcgacgcccgcacctacagcgaccctctggcccttcgggagttcaaagaatttgccgctggcagacgctccgtgtctggggatctgatcctcgagattggaaagctgccccagcacctgacacagcgggcccaaaatgctctcgacaaccttgtcatgctgcataatagcgaacagggcgggagagcctatcggcacgcgatggaggagctgcctgataccatcgaaacactcatgctgcttgccctgattgctgttctcaccggaggcgtgacgctgttctttctgtccggccgcgggctcggaaagacaagcatcggccttctgtgtgtgatggcctcttccgctctgctctggatggccagcgtcgagccccattggattgccgcttctatcatcctggagttctttcttatggtgctgctcattccggagcctgacagacagcggacaccccaggataaccaactggcgtacgttgtgatcgggctcctgttcatgattcttaccgtcgccgctaatgagatgggactgctggaaacaaccaaaaaggacctcggcatcgggcacgtggccgtcgagaaccaccatcacgccacaatgctggatgtggaccttcatcctgcttccgcctggacgctgtacgcggttgccaccacaattatcacccccatgatgcgccacacaattgaaaacaccacggctaatatcagcctcaccgccatcgctaaccaggccgcgattctgatgggactggataaaggctggcctatctctaagatggacattggcgtgcccctccttgccctggggtgctatagccaggtcaatccgctgacactcaccgctgccgtgctgatgcttgttgctcattacgccatcattggacctggcctgcaagctaaagccacaagagaggcgcagaagcggaccgccgctgggatcatgaagaaccccacggtggatggaatcgtcgccattgacctcgatcccgtggtgtatgacgctaaatttgaaaagcagctgggccagatcatgctgctcattctttgtacatcccaaatcctgctgatgcgcaccacatgggccctctgcgagtctattaccctggccaccgggcctcttacaacgctgtgggagggaagcccgggcaaattctggaataccacaatcgcggtttccatggctaacatctttagaggcagctacctcgccggggctggactggccttctccctgatgaagtctctcggcgggggacggcgcggcaccggggcccagggagaaacacttggcgagaaatggaagagacagctgaatcagctgagcaagtccgagttcaacacctataaacggtctggcattatggaggtcgacagaagcgaagctaaggaggggctccgccggggagagacgacaaaacacgccgtgtccagaggcaccgcgaagctgcgctggtttgtggaacggaatcttgtcaaacccgaggggaaggttatcgatctgggatgtggcagagggggatggtcttactattgcgccggcctcaagaaagtgaccgaagtgaagggctacacaaaagggggacctggccacgaggaacccattcctatggctacctacgggtggaacctggtcaagctgcatagcggaaaagacgtgttctttattccccctgagaagtgtgatacactcctttgcgacattggcgagtccagcccgaatcccacgatcgaagaggggcgcaccctgcgggttctgaaaatggtggaaccttggctcagaggaaaccaattctgtattaagatcctgaatccctatatgccttctgtcgtggagacacttgagcagatgcagcgcaagcacggcggcatgctggttcggaaccccctctccagaaatagcacccatgaaatgtactgggtgtcttgcgggacaggaaacatcgtctccgccgtgaatatgaccagccgcatgctgctgaaccggtttacgatggctcacagaaaaccgacctatgagcgcgatgtggacctcggcgccgggacaagacacgtcgcggttgaacctgaggtggccaacctggatattatcggacagcggattgaaaatatcaagcatgagcacaaatctacctggcattacgacgaggataacccctataagacatgggcttaccacggctcctatgaagtgaaacccagcgggtccgccagctctatggtcaatggagtggttaaacttctgaccaagccttgggacgtgattcccatggtcacacaaatcgctatgaccgatacgacacctttcggccagcagcgcgtgtttaaagagaaggttgacaccagaaccccgaaagccaagcggggcacagctcaaatcatggaagtgacggccagatggctctgggggttcctgagccggaacaaaaagccccgcatttgtaccagagaggaatttacacggaaggtccgctccaatgcggccatcggagctgtgttcgttgacgagaaccagtggaactctgccaaagaggctgtggaagatgagagattttgggaccttgtccatcgggaacgcgagctgcacaagcagggcaaatgcgctacctgcgtgtacaacatgatggggaagagagagaagaagctcggagagttcggcaaggccaaagggagccgggcgatttggtacatgtggctgggcgctcgctttctggagttcgaagccctcggattcatgaatgaggatcactggttttccagagaaaactctctgagcggcgtcgagggggagggacttcataagctgggctatatcctccgggacatttccaaaatccctgggggaaatatgtacgccgatgacacagctggctgggatacccgcatcacagaagacgatctgcagaacgaggccaagattaccgacatcatggaacccgagcacgcccttctggccacgtctattttcaaactcacctatcaaaataaggtggttagagtgcagcggcctgcgcgcaacgggacagtcatggatgtgatcagcagacgggaccagagaggctccggacaggtgggcacctacgggctgaatacatttaccaacatggaagcccaactgattcgccagatggagagcgagggaatcttctctccctccgaactcgagacgccgaacctggctgaacgggttcttgattggctggagaaacatggcgtggaaagactcaagcgcatggccatcagcggggacgactgtgtcgtgaagcctattgatgaccggtttgctacagccctgtctgcgcttaatgatatgggaaaagttagaaaggacatcccccagtgggagccttccaaaggctggaacgattggcagcaagtgcccttctgcagccaccactttcatcagctgattatgaaggacgggcgcgagatcgtcgtgccttgtcggaatcaggatgaactcgtcggcagagcccgcgtgtcccagggagctggctggtctctgcgggagaccgcctgcctggggaaaagctatgctcaaatgtggcagctcatgtacttccacagacgcgacctgcggcttgccgctaacgccatttgttccgcggttcccgtggattgggtcccgacaagcagaaccacgtggtctatccatgcccaccatcagtggatgaccacagaagacatgctgtccgtgtggaatcgggtttggattgaggaaaacccttggatggaggataagacccacatcagctcttggggagacgtgccctatctcggcaagagagaggaccaatggtgcgggagcctgatcggacttacagctcgcgccacctgggccacaaatattcaggtcgctatcaaccaggtgcggagactgattggcaatgaaaactacctcgattacatgacctccatgaaacgctttaagaatgagtctgaccccgaaggggccctgtggtga

SEQ ID NO: 19112 - RNA, 9879 nt, synthetic construct
  misc_feature 1..9879: note = derived and/or modified CDS sequence (opt5) from DENV-1__FJ898408__SS-prME
  source 1..9879: mol_type = other RNA
agcgtgaccatgctgctgatgctgatgcccaccgcccttgctttccacctgacgacccggggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacggaatgaagttcacagtggttgtgggcgacgtcgtggggattctcgctcagggcaaaaagatgatccggccgcaacccatggagcacaaatactcttggaaaagctggggcaaggccaagattatcggggccgatgtgcagaataccacctttatcattgacggacctaacacacccgaatgtcctgatgaccagagagcttggaatatctgggaggtcgaggattatggcttcggcatttttaccacgaacatctggctgaagctgcgcgactcctacacacaggtttgcgatcaccggcttatgagcgcggccattaaagactctaaggctgtgcatgccgatatggggtattggatcgaatccgagaaaaatgaaacctggaagctcgccagagctagcttcatcgaggtgaagacatgtatttggcccaaatctcacaccctgtggtccaacggagtcctggaaagcgagatgatcattccgaagatctacggcgggcctatttctcaacataattatcgccccggatacttcacacagaccgccggcccttggcacctcgggaaactggagcttgactttgatctgtgcgaaggaacgaccgtggttgtggacgagcactgcggcaaccggggccccagcctcagaacaaccacagtcaccgggaagatcatccatgaatggtgttgccggtcctgtacgctgcctcccctgcgcttcaaaggagaggatggctgctggtacgggatggagattagaccggtgaaggaaaaggaggaaaatcttgttaaaagcatggtgtctgcgggatccggcgaggtcgacagcttttccctcgggctgctgtgtacatctatcatgattgaagaggtgatgcggagcagatggtcccgcaagatgctcatgaccggaacactggctgttttccttctgctcatcatgggccagctgacctggaacgacctgattcggctttgcatcatggtgggcgccaatgcctctgatagaatggggatgggaaccacatatctggctctcatggccacgtttaaaatgcgccctatgttcgcggtcggcctgctctttagacggctgaccagccgcgaggtgcttctgctcacaattgggctgtccctggtggcttctgtcgaacttcccaacagcctggaggaactcggagacggcctggccatggggatcatgatcctcaagctgcttaccgatttccaatcccaccagctgtgggccacactcctgagcctgacctttattaaaacgacactttctctgcattacgcttggaagaccatggccatggttctctccatcgtgagcctgttccccctctgtctgtctaccacatcccagaagaccacatggcttcctgtgctgctgggaagcctcggctgcaaaccgctgacgatgtttcttattgctgagaataagatctggggcagaaaatcttggcccctgaacgaagggattatggccgtcggagtggtttccatcctcctgagctccctcctgaagaacgacgtgcctcttgcgggccccctgatcgccgggggaatgctgattgcttgttatgtcatcagcggctctagcgccgatctctccctggagaaagctgccgaggtgtcttgggaagaggaagccgagcacagcggggcttcccataatattcttgttgaagtgcaggacgatggaaccatgaagatcaaagacgaggagcgggatgacacactgaccattctcctgaaggcgacactcctggccgtctctggcgtgtaccctcttagcatccccgctaccctgttcgtctggtatttttggcaaaagaaaaagcagcgctccggcgtgctgtgggatacgccttctcccccggaagttgagagagccgtgctcgacgatgggatctaccggattatgcagcgcggactgcttggcagaagccaggtcggggtgggagttttccaagaaaacgtgttccacaccatgtggcacgtcacacggggcgccgtgctgatgtatcaggggaaacgcctcgagccttcctgggctagcgtgaagaaagacctgatctcttacggaggcggctggagactccaggggtcctggaataccggagaggaagttcaggtcattgccgtggagcccggcaagaaccctaagaatgtgcaaacagcgcccgggacctttaaaacaccggaaggagaggtcggcgctatcgccctggacttcaagcctgggacgagcggatctcccattgtgaaccgggaaggcaaaatcgttggcctttacgggaatggagtggtcaccacatccggcacctatgtgagcgccattgctcaggccaaggcgtcccaggaggggcctctgcccgagatcgaagatgaggtttttagaaaacgcaacctgaccatcatggacctccatcccggatctggcaagacacggagatacctgcctgctattgtgcgcgaagccatcaagcggaaacttagaacgctgattctcgccccgacccgcgtcgtggctagcgagatggccgaagctctgaaggggatgcccatccggtatcaaacaaccgccgttaaatccgagcacacaggcaaggagattgtggatctgatgtgccatgcgaccttcacgatgagactccttagccctgtccgcgtgcccaattacaacatgatcatcatggacgaagcccactttacagatccttcttccattgctgcccggggatatatcagcaccagagtgggcatgggggaggctgccgccattttcatgaccgctacaccccctggatctgtcgaagcgtttccgcagagcaatgccgttatccaggacgaggaacgggatattcccgagcgctcctggaactctggctacgagtggatcaccgacttccctgggaaaacagtgtggtttgtgcccagcatcaagtccggaaatgatattgctaactgtctgagaaagaatggcaaacgggtcatccagctgtctcgcaagaccttcgacacggaatatcagaaaaccaagaacaacgattgggactacgtggttaccacagacattagcgagatgggggccaattttagagccgatcgggtgatcgaccctagacgctgcctcaaacccgtcattctgaaggatggcccggaacgggtgatccttgctggacctatgcccgttaccgtggcctccgcggctcagagacgcggccggattgggagaaaccataataaggagggagaccagtacatctatatgggccagcccctgaacaatgatgaggaccacgcccactggacggaagccaaaatgctcctggataacatcaatacccctgaggggattatccccgctctgttcgaacctgagcgcgaaaagagcgccgcgattgacggagagtaccggctcagaggcgaggcccgcaaaacattcgtcgaacttatgagaagaggggatctgccggtgtggctgtcttataaggtcgcttccgagggctttcaatacagcgaccgcagatggtgcttcgatggagaacggaacaatcaggtgctcgaggaaaacatggacgttgagatctggaccaaagagggcgaacgcaagaaactgagaccccggtggcttgatgccagaacatattccgaccctctggctctccgcgagtttaaggagttcgccgctgggcggagatctgtgagcggagacctgattctggagatcggcaagctcccccagcatcttacccagcgcgcccaaaatgcgctggataacctggtgatgctccacaattccgaacaaggcgggcgggcctacagacatgctatggaggagctgcctgacacaatcgaaacccttatgctgctcgccctgattgctgtcctgacagggggcgttacgctctttttcctttctgggcggggactgggcaaaaccagcatcgggctgctctgtgtgatggcctccagcgtgctgctttggatggcctctgtcgagccccactggattgctgcgtccatcattctggaatttttcctcatggtgctgctgatcccggagcctgatcgccagagaacaccccaggacaaccaactcgcctatgttgtgatcggacttctgtttattatcctgacagtcgctgccaatgagatgggcctcctggaaaccacaaagaaagatcttgggattggacacgtggccgtcgagaaccatcaccatgctacgatgctggacgtggatctccaccctgccagcgcgtggaccctgtacgccgttgctacaaccatcattacacccatgatgcggcataccatcgaaaacacgaccgccaatatttctctgacagctatcgccaaccaggcggccatcctcatgggccttgacaagggctggcctatttccaaaatggatatcggggtgcccctgctggctctcggatgctacagccaggtcaatccgctgacccttacagccgctgtgctgatgctcgttgcccactatgctattatcggccctgggctgcaagccaaggcgacccgcgaggcccagaagagaacggctgccggaattatgaaaaaccccacagtggacggcatcgtcgctatcgatctggaccccgtggtgtacgatgccaagttcgaaaaacagctcgggcagattatgcttctgatcctgtgtacctctcaaattctcctgatgcggacaacctgggccctttgcgagagcatcaccctggcgacaggacctctcacgaccctgtgggagggctccccgggcaagttttggaatacaaccattgctgtttctatggccaacatcttccgcgggagctatctggctggagccggcctcgccttttcccttatgaaaagcctcgggggaggcagacgggggacaggagctcagggcgaaaccctgggcgagaagtggaagcgccagctcaatcagctgtccaaatctgagttcaacatctacaagagaagcgggattatggaggtcgaccggtccgaagccaaagagggacttaagagaggcgagacgacacgccacgcggtgtctcgggggaccgccaaactgagatggttcgtggaacgcaatctcgtcaagcccgagggaaaggttatcgacctgggctgtgggcggggaggctggagctattactgcgctggcctgaaaaaggtgaccgaagtgaaagggtatacaaagggaggccctgggcatgaggaacccattcctatggccacctacggatggaacctcgtcaaacttcactccggcaaggatgtgtttttcacaccccctgagaaatgtgacacgctgctgtgcgatatcggggagtctagcccgaatcccaccattgaagagggaagaacactccgcgttctgaagatggtggaaccttggcttcggggcaaccaattttgtatcaagattctgaatccctacatgccttccgtcgtggagaccctcgagcagatgcagagaaaacatggcgggatgctggttcgcaaccccctgagcagaaattctacacacgaaatgtattgggtgtcctgcggaaccggcaacatcgtcagcgctgtgaatatgacgtctagaatgctcctgaaccgcttcaccatggcccaccggaagccgacatacgagagagacgtggatcttggggcgggaacccgccatgtcgccgttgaacctgaggtggctaacctggacatcattggccagagaatcgaaaatattaaacacgagcataagtccacatggcactatgatgaggacaacccctacaaaacctgggcctatcatgggagctacgaagtgaagccctctggatccgctagctccatggtcaatggcgtggttaagctcctgacaaaaccttgggatgtgatccccatggtcacccaaattgccatgacggacacaaccccttttggccagcagcgggtgttcaaggagaaagttgatacccgcacaccgaaggctaaaagagggacggcccaaatcatggaagtgaccgcgcggtggctttggggatttctgagcagaaacaagaagccccggatctgtacacgcgaggagttcaccagaaaagtccggtctaatgccgctattggcgccgtgtttgttgacgagaaccagtggaatagcgctaaggaggccgtggaagacgagcgcttctgggatctcgtccagaaagaaagagagctgcacaagcaggggaaatgcgccacatgcgtgtataacatgatgggaaagcgggaaaagaaactgggcgagtttgggaaggcgaaaggctcccgcgctatctggtacatgtggctcggagccagattcctggagtttgaagcccttggcttcatgaatgaggaccactggttctctcgggaaaacagcctgtccggggtcgagggagagggcctccataagctggggtacattcttcgcgatatctctaaaattcctggaggcaatatgtatgctgacgataccgccgggtgggacacaagaatcaccgaagatgacctgcaaaacgaggctaagatcacggatattatggaacccgagcacgccctcctggcgaccagcatctttaaactgacataccagaataaggtggttcgggtgcagcgccctgccaagaacggcaccgtcatggacgtgatttccagacgggatcagcgcggatctggccaagtggggacatatggactcaataccttcacgaacatggaagctcagctgatcagacagatggagagcgagggcatttttcttccctccgaactggagacaccgaacctcgccgaacgggttctggactggcttgagaaatacggggtggaaagactgaagcgcatggctatcagcggagatgactgtgtcgtgaaacctatcgacgatcggttcgccaccgcgctcacagccctgaatgacatgggcaaggttagaaaagatattccccagtgggagccttctaaggggtggaacgactggcaacaggtgcccttttgctcccatcacttccaccagctgatcatgaaggatggccgcgagattgtcgtgccttgtcggaatcaggacgaactcgtcggacgggctcgcgtgagccaaggcgccgggtggtctctgcgggagaccgcttgccttggaaaatcctatgcccagatgtggcagctgatgtactttcatagacgcgatctccggctggctgccaacgcgatctgtagcgccgaccccggcgattgggttccgacgtccagaaccacatggtctattcacgctcatcaccaatggatgaccacagaagacatgcttagcgtgtggaatcgcgtctggatcgaggaaaacccttggatggaggataagacccatgtgtccagctggggagacgttccctatctgggaaaacgggaggaccagtggtgcggctctctcattgggctgacagccagagccacctgggcttccaatatccaggtggccatcaaccaggtccggagactgattggcaatgaaaactacctcgattacatgacgagcatgaagcgcttcaaaaatgagggagaccccgaaggcgcgctgtggtga

SEQ ID NO: 19113 - RNA, 9879 nt, synthetic construct
  misc_feature 1..9879: note = derived and/or modified CDS sequence (opt5) from DENV-1__GQ199843__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacgagcgccggcgttaatatgtgcacccttatcgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcgtgcagtacgaaaacctgaagtattccgtcatcgtgacggttcacaccggcgaccagcatcaagtggggaatgagagcacagaacacggaaccacagccaccattacgccccaggctcctacctctgagatccagctcacagactacggcgccctgaccctggattgttcccccagaacaggcctcgacttcaacgaaatggtcctgcttaccatgaaagaaaagtcctggctggtgcataaacagtggtttctcgatctgcctcttccctggacgtccggggcctctacaagccaagagacctggaatcggcaggacctgctcgtcacattcaagaccgctcacgcgaagaaacaggaagtggttgtgctgggatcccaagagggcgccatgcacaccgctctgacaggggccacggaaattcagaccagcggaacaaccacaatctttgccggccatctcaagtgccgcctgaaaatggataaacttaccctgaaagggatgtcttatgtcatgtgtacgggctccttcaagctcgagaaggaagtggctgagacacagcacggaaccgttctggtgcagattaaatacgagggcaccgacgccccgtgcaagatccctttcagcacacaagatgaaaaaggggtcacccagaacggaagactgatcacagcgaatcccattgtgacggacaaggagaaacctgtgaacatcgaagctgagccgccctttggcgagtcttatattgttatcggggccggagaaaaggcccttaagctcagctggttcaaaaagggctcctctattgggaaaatgtttgaggctaccgcccggggcgctagacgcatggccatcctgggagatacagcgtgggacttcggcagcatcgggggagtctttacctccgtgggcaagctggtgcatcagattttcgggacagcctacggagtcctctttagcggcgtgtcttggaccatgaaaatcgggattggcgttctgcttacgtggctgggactcaattcccggagcacctctctgtccatgacatgtatcgctgtgggcctggtcaccctttacctcggggtgatggttcaggccgatagcggatgcgtgattaactggaagggcagagaactgaagtgtgggtccggaatcttcgtcacaaatgaggtgcacacctggacagaacaatataaatttcaggctgactctcctaagcgcctgagcgccgcgattggcaaagcctgggaggagggggtttgcggcatccggtccgctaccagactcgaaaacatcatgtggcgccagatttctaacgagctgaatcatatccttctggaaaacgacatgaagttcacggtggtcgtgggagatgtggtcggcattctcgcccaggggaaaaagatgatccggccgcaacccatggagcacaaatacagctggaagtcctggggaaaggctaaaattatcggcgccgacgttcagaatacaacctttatcattgatgggcctaacacccccgaatgtcctgacgatcagagagcctggaatatctgggaggtggaggactatggattcggcatttttacaaccaacatctggctgaagctgcgcgatagctacacacaggtgtgcgaccaccggcttatgtctgctgcgattaaagattccaaggccgtccatgctgacatgggctattggatcgaaagcgagaaaaatgaaacatggaagctcgccagagcctctttcatcgaggtgaagacctgtatttggcccaaatcccacacactgtggagcaacggggttctggaatctgagatgatcattccgaagatctacggaggccctattagccaacataattatcgccccgggtacttcacccagacagctggaccttggcacctcggcaaactggagcttgattttgacctgtgcgaagggaccacggtggtcgtggatgagcactgcggaaaccggggcccctccctcagaaccacaaccgttacaggcaagatcatccatgaatggtgttgccggagctgtaccctgcctcccctgcgcttcaaaggggaggacggatgctggtacggcatggagattagaccggtgaaggaaaaggaggaaaatcttgtcaaatctatggtgtccgccgggagcggagaggttgactccttttctctcggcctgctgtgtatcagcattatgatcgaagaggtgatgcggtccagatggtctcgcaagatgctcatgacggggacactggcggtcttctttcttctgattatgggacagctcacctggaacgatctgatccggagctgcattatggtgggcgctaatgcctccgacagaatgggcatggggacaacctatctggcccttatggctaccttcaaaatgcgccctatgtttgccgtgggactcctgttcagacggctgacatctcgcgaggtcctcctgcttacgatcggcctgagcctcgttgcgtccgtggaactgcccaacagcctggaggaacttggggatggactggctatgggcatcatgattctcaagctgctcaccgactttcaatcttaccagctgtgggccacacttctgtccctcaccttcatcaaaacaacctttagcctgcactatgcctggaagacgatggctatggtgctgtctattgtctcccttctgcccctctgtctgagcacaacctctcagaagaccacatggctccctgtgctgcttgggtccctgggatgcaaaccgctgaccatgttcctcatcgccgagaataagatttggggcagaaaaagctggcccctgaacgaaggcatcatggctgttgggatcgtgtccattcttctgagctctctcctgaagaacgatgtccctctcgccggacccctgatcgcgggcgggatgcttattgcctgttacgtgatcagcggatcctctgctgacctgagcctggagaaagccgctgaggtttcctgggaagaggaagccgagcattctggcgccagccacaatattctcgtggaagtccaggatgacgggacaatgaagatcaaagatgaggagcgggacgatacgctgaccatccttctgaaggctacactcctggcggtgtccggagtctatcctctctctattcccgccaccctgtttgtgtggtacttctggcaaaagaaaaagcagcgcagcggcgttctttgggacacacctagccctcccgaagtggagagagctgtcctggatgacggcatctatcggattatgcagcgcgggctgctcggaagaagccaggtgggcgttggggtgttccaagaaaacgtctttcataccatgtggcacgtgacgcggggagccgtgctgatgtaccagggcaaacgccttgagccctcttgggcctccgttaagaaagacctgatcagctacgggggaggctggagactccagggctcttggaataccggggaggaagtccaggtgattgctgtggagcccggaaagaaccctaagaatgtccaaacagcccccggcaccttcaaaacaccggaaggggaggtgggagcgatcgctctggattttaagcctggcacctccgggagccccattgttaaccgggaaggaaaaatcgtgggcctctatggcaatggggtcgtgacaacgtccggaacctacgtttctgccatcgcccaggctaaggccagccaggagggccctctgcccgagattgaagacgaggtgttcagaaaacgcaaccttacaatcatggatctgcaccccgggtccggaaagacccggagatatctgcctgcgattgtccgcgaagctatcaagcggaaactcagaaccctgattcttgccccgacacgcgtggttgccagcgagatggctgaagccctgaagggcatgcccatccggtaccaaacgaccgctgtgaaatctgagcatacagggagagagatcgtcgacctcatgtgccacgccacctttacaatgcgcctgctgtcccctgtgcgggtgcccaattataacatgattatcatggatgaagcgcatttcaccgaccctagctctattgccgctagaggctacatcagcacgcgggtcggaatgggcgaggccgctgccatttttatgacagccacaccccctgggtccgttgaggctttcccgcagtctaatgcggtgatccaggatgaggaacgcgacatccccgagagaagctggaactccggatatgagtggattaccgattttcctggcaagacagtgtggttcgtcccctctatcaaaagcgggaatgacattgccaactgtctccggaagaatggaaagcgcgtgatccagctttccagaaaaacctttgatacagaataccaaaagaccaaaaacaacgactgggactacgttgtgacgacagatattagcgagatgggcgctaatttccgggccgacagagtcatcgatcctcgccggtgcctgaagcccgtgattctgaaagacgggccggaaagagttatcctcgccggccctatgcccgtgaccgtcgcttctgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatccgctgccattgatggggagtatagactgcgcggagaggcgagaaagacgtttgtggaactgatgcggcgcggcgacctcccggtctggcttagctacaaagtggcctccgaggggttccaatattctgatagacggtggtgctttgacggcgaacgcaacaatcaggttctggaggaaaacatggatgtggagatctggaccaaggagggagaacgcaagaagctgcggcccagatggctcgacgctcgcacatacagcgaccctctggcccttcgggagttcaaagaatttgctgccggcagacgctccgtgtctggggatctgatcctcgagattggaaagctgccccagcacctgacccagcgggctcaaaatgccctcgacaaccttgtcatgctgcataatagcgaacagggcgggagagcgtatcggcacgccatggaggagctgcctgatacaatcgaaaccctcatgctgcttgctctgattgccgttctcacaggaggcgtgaccctgttctttctgtccggccgcgggctcggaaagacgagcatcggccttctgtgtgtgatggcttcttccgccctgctctggatggccagcgtcgagccccattggattgctgcgtctatcatcctggagttctttcttatggtgctgctcattccggagcctgacagacagcggacaccccaggataaccaactggcctacgttgtgatcgggctcctgttcatgattcttaccgtcgctgccaatgagatgggactgctggaaaccaccaagaaggacctcggcatcgggcacgccgctgtggagaaccaccatcacgccaccatgctggatgtcgaccttcatcctgcgtccgcctggacactgtacgctgtggccacgaccattatcacacccatgatgcgccacaccattgaaaacacaaccgctaatatcagcctcacggccatcgcgaaccaggccgctattctgatgggactggataaaggctggcctatctctaagatggacattggcgttcccctccttgccctggggtgctatagccaggtgaatccgctgaccctcacagctgccgtcctgatgcttgtggctcattacgccatcattggacctggcctgcaagcgaaagccaccagagaggctcagaagcggacagccgctgggatcatgaagaaccccaccgttgatggaatcgtggccattgacctcgatcccgtcgtgtatgacgccaaatttgaaaagcagctgggccagatcatgctgctcattctttgtacgtcccaaatcctgctgatgcgcacaacctgggcgctctgcgagtctattacactggctaccgggcctcttaccacactgtgggagggaagcccgggcaaattctggaatacgaccatcgccgtgtccatggctaacatctttagaggcagctacctcgccggggccggactggctttctccctgatgaagtctctcggcgggggacggcgcggcacaggggcccagggagaaacccttggcgagaaatggaagagacagctgaatcagctgagcaagtccgagttcaacacatataaacggtctggcattatggaggttgacagaagcgaagcgaaggaggggctccgccggggagagaccacgaaacacgccgtctccagaggcacagctaagctgcgctggtttgtggaacggaatcttgtgaaacccgaggggaaggtcatcgatctgggatgtggcagagggggatggtcttactattgcgccggcctcaagaaagttaccgaagtgaagggctacaccaaagggggacctggccacgaggaacccattcctatggctacatacgggtggaacctggtgaagctgcatagcggaaaagacgtcttctttattccccctgagaagtgtgataccctcctttgcgacattggcgagtccagcccgaatcccacaatcgaagaggggcgcacgctgcgggtgctgaaaatggttgaaccttggctcagaggaaaccaattctgtattaagatcctgaatccctatatgccttctgtggtcgagacccttgagcagatgcagcgcaagcacggcggcatgctggtgcggaaccccctctccagaaatagcacacatgaaatgtactgggtttcttgcgggaccggaaacatcgtgtccgccgtcaatatgacaagccgcatgctgctgaaccggtttaccatggcgcacagaaaaccgacgtatgagcgcgatgtggacctcggcgccgggaccagacacgtggctgtcgaacctgaggttgccaacctggatattatcggacagcggattgaaaatatcaagcatgagcacaaatctacatggcattacgacgaggataacccctataagacctgggcttaccacggctcctatgaagtgaaacccagcgggtccgccagctctatggtgaatggagtcgtgaaacttctgacaaagccttgggacgttattcccatggtgacccaaatcgctatgacagataccacgcctttcggccagcagcgcgtctttaaagagaaggtggacacaagaaccccgaaagccaagcggggcaccgcgcaaatcatggaagttacagccagatggctctgggggttcctgagccggaacaaaaagccccgcatttgtacgagagaggaatttacccggaaggtgcgctccaatgctgccatcggagctgtcttcgtggacgagaaccagtggaactctgccaaagaggccgttgaagatgagagattttgggaccttgtgcatcgggaacgcgagctgcacaagcagggcaaatgcgcgacatgcgtctacaacatgatggggaagagagagaagaagctcggagagttcggcaaggctaaagggagccgggccatttggtacatgtggctgggcgcccgctttctggagttcgaagctctcggattcatgaatgaggatcactggttttccagagaaaactctctgagcggcgtggagggggagggacttcataagctgggctatatcctccgggacatttccaaaatccctgggggaaatatgtacgccgatgacaccgctggctgggatacacgcatcaccgaagacgatctgcagaacgaggccaagattacagacatcatggaacccgagcacgcgcttctggccacctctattttcaaactcacgtatcaaaataaggtcgtgagagttcagcggcctgctcgcaacgggaccgtgatggatgtcatcagcagacgggaccagagaggctccggacaggtgggcacatacgggctgaatacctttacaaacatggaagcccaactgattcgccagatggagagcgagggaatcttctctccctccgaactcgagaccccgaacctggctgaacgggtgcttgattggctggagaaacatggcgttgaaagactcaagcgcatggccatcagcggggacgactgtgtggtcaagcctattgatgaccggtttgcgacggccctgtctgctcttaatgatatgggaaaagtgagaaaggacatcccccagtgggagccttccaaaggctggaacgattggcagcaagttcccttctgcagccaccactttcatcagctgattatgaaggacgggcgcgagatcgtggtcccttgtcggaatcaggatgaactcgtgggcagagcccgcgtctcccagggagctggctggtctctgcgggagacagcctgcctggggaaaagctatgctcaaatgtggcagctcatgtacttccacagacgcgacctgcggcttgccgcgaacgccatttgttccgctgtgcccgttgattgggtgccgaccagcagaacaacctggtctatccatgcccaccatcagtggatgacgaccgaagacatgctgtccgtctggaatcgggtgtggattgaggaaaacccttggatggaggataagacacacatcagctcttggggagacgttccctatctcggcaagagagaggaccaatggtgcgggagcctgatcggacttaccgcccgcgctacatgggccaccaatattcaggtggcgatcaaccaggtccggagactgattggcaatgaaaactacctcgattacatgacatccatgaaacgctttaagaatgagtctgaccccgaaggggctctgtggtga

SEQ ID NO: 19114 - RNA, 9879 nt, synthetic construct
  misc_feature 1..9879: note = derived and/or modified CDS sequence (opt5) from DENV-1__GQ199844__SS-prME
  source 1..9879: mol_type = other RNA
agcgtgaccatgctgctcatgctgatgcccacggcccttgctttccacctgacgaccagaggcggggagcctcatatgatcgtgacaaagcaggaacggggaaaatccctcctgtttaagacctctgccggcgttaatatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaattgctaccatcacgccccaggcccctaccagcgagattcagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaatccagacctccggaacaaccacaatttttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaatccctttctccacacaagatgaaaagggggttacccagaacggacggctgattacagctaatcccatcgtgacggacaaagagaagcctgtcaacattgaagccgagccgccctttggcgagagctatatcgtgattggggccggagaaaaagctcttaagctctcttggttcaagaaaggcagctccatcgggaagatgtttgaggccaccgctagaggcgcccgccggatggcgatcctgggagatacagcctgggacttcggctctgtcgggggagtttttaccagcgtcggcaaactggtgcatcagattttcgggacagcttacggagtgctcttttccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatcttcgtgacaaatgaggtccacacctggacagaacaatataagtttcaggccgactcccctaaacggctgtctgcggccattggcaaggcttgggaggagggggtgtgcggcatcagaagcgccacccgcctcgaaaacatcatgtggaaacagatttccaacgagctgaatcatatccttctggaaaacgacatgaagttcacggttgtggtcggagatgtggtgggcattctcgctcaggggaaaaagatgatccggccgcaacccatggagcacaaatactcttggaaaagctggggaaaggccaagattatcggcgccgacgtccagaatacaacctttatcattgatgggcctaacacccccgaatgtcctgacgatcagagagcttggaatatctgggaggttgaggactatggattcggcatttttacaaccaacatctggctgaagctgcgcgattcctacacacaggtgtgcgaccaccggcttatgagcgcggccattaaagattctaaggctgtgcatgccgacatgggctattggatcgaatccgagaaaaatgaaacatggaagctcgccagagctagcttcatcgaggtcaagacctgtatttggcccaaatctcacacactgtggtccaacggggtgctggaaagcgagatgatcattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgctagcctgttccccctctgtctgtctacaacctcccagaagaccacatggcttcctgtgctgctggggagcctcggatgcaaaccgctgaccatgtttcttatcacagagacgaagatttggggcagaaaatcttggcccctgaatgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataacatccttgttgtggtccaggatgacgggaccatgaagattaaagatgaggaacgggacgatacactgaccatcctcctgaaggcgacactcctggccgtgtctggagtctaccctcttagcatccccgctaccctgttcgtgtggtatttttggcaaaagaaaaagcagcgctccggcgttctgtgggacacgccttctcccccggaggtggaaagagccgtcctcgatgacggcatttaccggatcatgcagcgcgggctgcttggaagaagccaggtgggcgttggggtgttccaagagaatgtcttccacaccatgtggcacgtgacacggggagccgtgctgatgtatcagggcaaacgcctcgaaccttcctgggctagcgttaagaaagacctgatttcttacgggggaggctggagactccagggctcctggaacaccggggaggaggtccaggtgatcgccgtggaacccggaaagaatcctaagaacgtccaaacagcgcccggcacctttaaaacaccggagggggaagtgggagctattgccctggatttcaagcctggcacgagcgggtctcccatcgttaatcgggagggaaaaattgtgggcctttacggcaacggggtcgtgaccacatccggaacctatgttagcgccatcgctcaggccaaggcgtcccaggaaggccctctgcccgagatcgaggacgaagtgtttagaaaacgcaatctgaccattatggatctccatcccgggtctggaaagacacggagatacctgcctgctatcgtccgcgaggccattaagcggaaacttagaacgctgatcctcgccccgacccgcgtggttgctagcgaaatggccgaggctctgaagggcatgcccattcggtatcaaacaaccgccgtgaaatccgaacacacagggaaggagatcgtcgacctgatgtgccatgcgaccttcacgatgagactccttagccctgtgcgcgtgcccaactacaatatgatcattatggatgaggcccactttacagacccttcttccatcgctgcccggggctatattagcaccagagtcggaatgggcgaagctgccgccatcttcatgaccgctacaccccctgggtctgttgaggcgtttccgcagagcaacgccgtgattcaggatgaggaacgggacatccccgaacgctcctggaactctggatacgagtggatcaccgatttccctggcaaaacagtgtggtttgtccccagcattaagtccgggaacgacatcgctaattgtctgagaaagaacggaaaacgggtgattcagctgtctcgcaagaccttcgatacggagtatcagaagaccaagaataacgactgggactacgttgtgaccacagatatcagcgaaatgggcgccaactttagagccgaccgggtcattgatcctagacgctgcctcaaacccgtgatcctgaaggacgggccggagcgggttattcttgctggccctatgcccgtgaccgtcgcctccgcggctcagagacgcggacggatcggcagaaatcataacaaggaaggggatcagtacatctatatgggacagcccctgaataacgacgaggatcacgcccactggacggaggccaaaatgctcctggacaatattaacacccctgaaggcatcattcccgctctgttcgagcctgaacgcgaaaagagcgccgcgatcgatggggaataccggctcagaggagaggcccgcaaaacattcgtggagcttatgagacggggcgacctgccggtctggctgtcttataaggtggcttccgaagggtttcaatacagcgatcgcagatggtgcttcgacggcgagcggaataaccaggttctcgaagagaatatggatgtggaaatttggaccaaagagggagagcgcaagaaactgagaccccggtggcttgacgccagaacatattccgaccctctggctctccgcgaatttaaggagttcgccgctggccggagatctgtgagcggggatctgatcctggaaatcggaaagctcccccagcatcttacccagcgcgcccaaaacgcgctggacaatctggtcatgctccacaactccgagcagggcgggcgggcctacagacatgctatggaggaactgcctgatacaattgagacccttatgctgctcgccctgatcgctgttctgacgggaggcgtgacactctttttcctttctggccgggggctgggaaaaaccagcattggcctgctctgtgtgatggcctccagcgtcctgctttggatggcctctgtggaaccccactggatcgctgcgtccattatcctggagtttttcctcatggttctgctgatcccggaacctgaccgccagagaacaccccaggataatcaactcgcctatgtggtcattgggcttctgtttatgatcctgacagtggctgccaacgagatgggactcctggagaccacaaagaaagaccttggcattgggcacgtcgccgtggaaaatcatcaccatgctacgatgctggatgttgacctccaccctgccagcgcgtggaccctgtacgccgtggctacaaccatcattacacccatgatgcggcataccatcgagaacacgaccgccaacatttctctgacagctatcgccaatcaggcggccatcctcatgggacttgataagggctggcctatttccaaaatggacatcggcgtccccctgctggctctcgggtgctacagccaggtgaacccgctgacccttacagccgctgttctgatgctcgtggcccactatgctattatcggacctggcctgcaagccaaggcgacccgcgaagcccagaagagaacggctgccgggattatgaaaaatcccacagtcgatggaatcgtggctatcgacctggatcccgtggtttacgacgccaagttcgagaaacagctcggccagattatgcttctgatcctgtgtacctctcaaattctcctgatgcggacaacctgggccctttgcgaaagcatcaccctggcgacagggcctctcacgaccctgtgggagggatccccgggcaagttttggaacacaaccattgctgtctctatggccaatatcttccgcggcagctatctggctggggccggactcgccttttcccttatgaaaagcctgggcgggggaagacggggcacaggggctcagggagagaccctgggcgaaaagtggaagcgccagctcaaccagctgtccaaatctgagttcaatatctacaagagaagcggcattatggaagtggaccggtccgaggccaaagaagggcttaagagaggagagacgacacgccacgcggtgtctcggggcaccgccaaactgagatggttcgtcgagcgcaacctcgttaagcccgaagggaaggtgatcgatctgggatgtggcagagggggatggagctattactgcgctggcctgaaaaaggtgaccgaggtcaaaggctatacaaaagggggacctggccatgaggagcccattcctatggccacctacgggtggaatctcgtgaaacttcactccggaaaggacgtctttttcacaccccctgaaaaatgtgatacgctgctgtgcgacatcggcgagtctagcccgaaccccaccattgaggaagggagaacactccgcgtgctgaagatggtcgagccttggcttcggggaaatcaattttgtatcaagattctgaacccctacatgccttccgtggttgaaaccctcgagcagatgcagagaaaacatggcggcatgctggtgcgcaatcccctgagccggaactctacacacgagatgtattgggtctcctgcgggaccggaaatatcgtgagcgctgtgaacatgacgtctagaatgctcctgaatcgcttcaccatggcccaccggaagccgacatacgaaagagatgtcgaccttggcgcggggacccgccatgttgccgtggagcctgaagtggctaacctggatatcattggacagagaatcgagaacattaaacacgaacataagtccacatggcactatgacgaggataatccctacaaaacctgggcctatcatggcagctacgaggtcaagccctctgggtccgctagctccatggtgaacggagttgtgaagctcctgacaaaaccttgggacgtcatccccatggtgacccaaattgccatgacggatacaaccccttttggccagcagcgggttttcaaggaaaaagtggacacccgcacaccgaaggctaaaagaggcacggcccaaatcatggaggtcaccgcgcggtggctttgggggtttctgagcagaaataagaagccccggatctgtacacgcgaagagttcaccagaaaagtgcggtctaacgccgctattggagccgtttttgtggacgaaaatcagtggaacagcgctaaggaggccgtcgaggatgaacgcttctgggacctcgtgcagaaagagagagaactgcacaagcagggcaaatgcgccacatgcgtctataatatgatggggaagcgggagaagaaactgggagaatttggcaaggcgaaagggtcccgcgctatctggtacatgtggctcggcgccagattcctggagtttgaggcccttggattcatgaacgaagatcactggttctctcgggagaatagcctgtccggcgtggaaggggagggactccataagctgggctacattcttcgcgacatctctaaaattcctgggggaaacatgtatgctgatgacaccgccggctgggatacaagaatcaccgaggacgatctgcaaaatgaagctaagatcacggacattatggagcccgaacacgccctcctggcgaccagcatctttaaactgacataccagaacaaggttgtgcgggtccagcgccctgccaagaatgggaccgtgatggatgtgatttccagacgggaccagcgcggctctggacaagttggcacatatgggctcaacaccttcacgaatatggaggctcagctgatcagacagatggaaagcgagggaatttttcttccctccgagctggaaacaccgaacctcgccgagcgggtgctggattggcttgaaaaatacggcgtcgagagactgaagcgcatggctatcagcggggacgactgtgtggttaaacctatcgatgaccggttcgccaccgcgctcacagccctgaacgatatgggaaaggtgagaaaagacattccccagtgggaaccttctaagggctggaatgattggcaacaggtccccttttgctcccatcacttccaccagctgatcatgaaggacgggcgcgagattgtggtcccttgtcggaaccaggatgagctcgtgggcagagctcgcgttagccaaggagccggctggtctctgcgggaaaccgcttgccttgggaaatcctatgcccagatgtggcagctgatgtactttcatagacgcgacctccggctggctgccaatgcgatctgtagcgccgtgcccgtcgattgggtgccgacgtccagaaccacatggtctattcacgctcatcaccaatggatgaccacagaggacatgcttagcgtttggaaccgcgtgtggatcgaagagaatccttggatggaagataagacccatgtctccagctggggagacgtgccctatctgggcaaacgggaggaccagtggtgcgggtctctcattggactgacagccagagccacctgggcttccaacatccaggtggccatcaatcaggttcggagactgattggcaacgagaattacctcgattacatgacgagcatgaagcgcttcaaaaacgaaggggaccccgagggcgcgctgtggtga

SEQ ID NO: 19115 - RNA, 9879 nt, synthetic construct
  misc_feature 1..9879: note = derived and/or modified CDS sequence (opt5) from DENV-1__GQ199845__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggccaccgctagaggcgcccgccggatggcgatcctcggagatacagcctgggactttggcagcatcgggggaatgttcacctccgttggcaaactggtccatcagatttttgggacagcttacggagtgctgttcagcggcgtgtcttggaccatgaagatcgggattggcgtcctcctgacgtggcttggactgaattccagaagcacctctctctccatgacatgtatcgccgtgggcctggttaccctgtaccttggggtgatggtccaggctgatagcggatgcgtgattaactggaaaggccgcgaactcaagtgtgggtccggaatctttgttacaaatgaggtgcacacctggacagaacaatataagttccaggccgactctcctaaacggctgagcgcggccattggcaaggcttgggaggagggggtctgcggcatcagatccgccacccgcctggaaaacatcatgtggaaacagatttctaacgagctcaatcatatcctgcttgaaaacgacatgaagctgacggtggttgtgggagatgtcgctggcattctcgcccaggggaaaaagatgatccggccgcaacccatggagtacaaatatagctggaagatttggggaaaggccaaaatcatcggcgctgacgtgcagaatacaacctttattatcgatgggcctaacacccccgaatgtcctgacgatcagagagcgtggaatatttgggaggtggaggactacggattcggcatctttacaaccaacatttggctgaagctgcgcgattcctatacgcaggtctgcgaccaccggcttatgagcgccgctatcaaagattctaaggccgttcacgccgacatgggctactggatcgaatccgagaaaaatgaaacatggaagctcgctagagccagcttcattgaggtgaagacctgtatctggcccaaatctcatacactgtggtccaacggggtgctggaaagcgagatgattatcccgaagatttatggaggccctatctctcaacacaattaccgccccgggtacttcacccagacagcgggaccttggcatctcggcaaactggagcttgattttgacctgtgcgaagggaccacggtcgtggttgatgagcactgcggaaaccggggccccagcctcagaaccacaaccgtgacaggcaagatcattcacgaatggtgttgccggtcctgtaccctgcctcccctgcgcttcaaaggggaggacggatgctggtatggcatggagatcagaccggtcaaggaaaaggaggaaaatcttgtgaaaagcatggtttctgctgggtccggagaggtggacagcttttccctcggcctgctgtgtatttctatcatgattgaagaggtcatgcggagcagatggtcccgcaagatgctcatgacggggacactggccgtgttctttcttctgatcatgggacagctcacctggaacgatctgattcggctgtgcatcatggttggcgccaatgcttctgacagaatgggcatggggacaacctaccttgccctgatggcgaccttcaaaatgcgccctatgtttgctgtgggactcctgttcagacggctcacaagccgcgaggtcctgcttctgacgatcggcctctccctggtggcctctgtggaactgcccaacagccttgaggaactgggggatggactcgccatgggcattatgatcctgaagctcctgaccgactttcaatcccatcagctttgggctacactgctcagcctgaccttcattagaacaaccttttctctgcactatgcctggaaaacgatggctatggtcctttccatcgttagcctgttccccctctgtctgtctacaacctcccagaagaccacatggctccctgtgctgcttgggagcctgggatgcaagccgctgaccatgtttctcattgccgagaataaaatctggggccggaagtcttggcccctgaacgaaggcatcatggcggtggggattgtctccatccttctgagctccctcctgaaaaacgatgtgcctctcgccggacccctgattgctggcgggatgcttatcgcctgttacgttattagcggatctagcgctgacctgtccctggagaaggccgccgaggtgtcttgggaagaggaagctgagcatagcggcgcgtcccacaatatcctcgtcgaagtgcaggatgacgggacaatgaaaatcaaggatgaggagcgcgacgatacgctgaccattcttctgaaagccacactcctggctgtttctggagtgtatcctctcagcatccccgccaccctgttcgtctggtacttctggcaaaagaagaaacagagatccggcgtgctttgggacacaccttctcccccggaagtcgagcgggccgtgctggatgacggcatttatcgcatcatgcagagagggctgctcggacggagccaggttggcgtgggggtctttcaagaaaacgtgttccataccatgtggcacgttacgcgcggagctgtgctgatgtaccagggcaagagacttgagccttcctgggccagcgtcaaaaaggacctgatttcttacgggggaggctggcggctccagggctcctggaataccggggaggaagtgcaggtgatcgcggttgagcccggaaaaaaccctaagaatgtccaaacagctcccggcacctttaagacaagcgaaggggaggtgggagccattgccctggatttcaaaccgggcacctctgggtcccctatcgtgaacagagaaggaaagatcgtcggcctctatggcaatggggtggttacaacgagcggaacctacgtgtccgctattgcccaggcgaaagcttctcaggagggccccctgcctgagatcgaagacgaggtctttcgcaagcggaaccttacaattatggatctgcaccccgggagcggaaaaaccagacgctatctgcccgccatcgtgcgggaagccaccaagagacgcctccggacactgattcttgctcctacgagagttgtggcctccgagatggctgaagccctgaagggcatgccgatccgctaccaaaccacagcggtcaaaagcgagcataccgggaaggagatcgtggacctcatgtgccacgccacattcaccatgcggctgctgtctcccgttagagtgcctaattataacatgattatcatggatgaagctcattttacggacccctccagcattgccgctcggggctacatctctacacgcgtcggaatgggcgaggccgccgctattttcatgaccgcgacccctcccgggagcgtggaagcctttcctcagtccaatgctgtgatccaggatgaggaaagagacatcccggagcggtcttggaacagcggatatgagtggattacagatttccccggcaaaaccgtctggtttgttccttccatcaagtctgggaatgacattgccaactgtctccgcaaaaatggaaagagagtgatccagcttagccggaagacattcgataccgaataccaaaaaacgaagaacaacgactgggactacgtggtcacaaccgatatttccgagatgggcgccaatttcagagctgaccgcgtgatcgatccccggagatgcctgaaacctgttattctgaaggacgggcccgaacgcgtgatcctcgccggcccgatgcctgtcacagtggcgagcgctgcccagcggagaggacgcatcggccggaaccacaataaagagggggatcagtatatttacatgggacagcccctgaacaatgacgaggatcatgcccactggaccgaagctaagatgcttctggacaacatcaatacgcccgagggcattatccctgccctctttgaacccgagagagaaaagtctgcggccattgatggggagtatcgcctgagaggagaggctcggaaaaccttcgttgaactgatgcgcagaggcgacctccctgtgtggctttcctacaaggtcgccagcgaggggtttcaatattccgatcggcgctggtgcttcgacggcgaaagaaacaatcaggtgctggaggaaaacatggatgtcgagatctggacaaaagagggagaacggaagaaactgagaccgcgctggctcgacgctcggacctactctgaccccctggcccttagagagtttaaggaattcgctgccggccgccggagcgtgtccggggatctgatcctcgagattggaaaactgcctcagcacctgacacagagagcgcaaaatgccctcgacaaccttgttatgctgcataattctgaacagggcgggcgggcttatcgccacgccatggaggagctgcccgataccatcgaaacactcatgctgcttgctctgattgccgtgctcaccggaggcgtgacgctgtttttcctgagcggcagagggctcggaaagacatccatcggccttctgtgtgtcatggccagctctgttctgctctggatggcttccgtggagcctcattggattgcggccagcatcatcctggaatttttccttatggtgctgctcattcccgagccggaccggcagcgcacccctcaggataaccaactggcttacgtcgtgatcgggctgctctttatgattcttaccgttgccgccaatgagatgggactgctggaaacaaccaagaaagacctcggcatcgggcacgtggctgtcgagaaccaccatcacgccgcgatgctggatgtggaccttcatcccgcctctgcttggacactgtacgccgtcgctacgaccattatcacacctatgatgagacacaccattgaaaacacaaccgccaatatctccctcacggcgatcgccaaccaggctgccattctgatgggactggataagggctggcccatcagcaaaatggacattggcgtgcctctccttgctctggggtgctattctcaggttaatcccctgaccctcacagccgctgtgctgatgcttgtcgcccattacgcgatcattggaccgggcctgcaagccaaggctacccgggaggcccagaaacgcacagctgccgggatcatgaagaaccctaccgtggatggaatcgttgccattgacctcgatcccgtggtctatgacgcgaagttcgaaaaacagctgggccagatcatgctgctcattctttgtacgagccaaatcctgctgatgagaacaacctgggctctctgcgagtccattacactggccaccgggccccttaccacactgtgggagggatctcctggcaagttttggaatacgaccatcgctgtgagcatggccaacatcttccggggctcctacctcgccggggctggactggccttcagcctgatgaaatccctcggcgggggacgcagaggcacaggggcgcagggagaaacccttggcgagaagtggaaacggcagctgaatcagctgtctaagagcgaatttaacacatataagagatccggcattatggaggtggaccgctctgaagccaaagaggggctcaagcggggagagaccacgaaacacgctgttagcagaggcacagccaagctgcgctggttcgtcgaacggaatcttgtgaaaccggaggggaaggtgatcgatctgggatgtggcagagggggatggtcctactattgcgctggcctcaagaaagtcaccgaagttaagggctacaccaaagggggacccggccacgaggaacctattcccatggccacatacgggtggaacctggtgaagctgcattctggaaaagacgtgtttttcatccctcccgagaagtgtgataccctcctttgcgacattggcgagagctcccctaatccgacaatcgaagaggggcgcacgctgcgggtcctgaaaatggtggaaccctggctcagaggaaaccaattttgtattaagatcctgaatccttatatgcccagcgttgtggagacccttgagcagatgcagcgcaagcacggcggcatgctggtccggaaccctctctctagaaattccacacatgaaatgtactgggtgagctgcgggaccggaaacatcgtttctgcggtgaatatgacatcccgcatgctgctgaaccggttcaccatggcccacagaaaacccacgtatgagcgcgatgtcgacctcggcgctgggaccagacacgtggccgtggaaccggaggtcgctaacctggatattatcggacagcggattgaaaatatcaagcatgagcacaaaagcacatggcattacgacgaggataacccttataagacctgggcctaccacggctcttatgaagttaaaccctccgggagcgcttccagcatggtgaatggagtggtcaagcttctgacaaagccctgggacgtgattcctatggttacccaaatcgccatgacagataccacgccctttggccagcagcgcgtgttcaaagagaaggtcgacacaagaacccctaaagcgaagcggggcaccgcccaaatcatggaagtgacagctaaatggctctgggggtttctgtctagaaacaagaagccgcggatttgtacgcgcgaggaattcaccagaaaagttcggagcaatgccgctatcggagccgtgtttgtcgacgagaaccagtggaattccgccaaggaggcggtggaagatgagcgcttctgggaccttgttcatagagaacgggagctgcacaaacagggcaagtgcgctacatgcgtgtacaacatgatggggaaacgcgaaaagaagctcggagagtttggcaaagccaaggggtctagagccatttggtacatgtggctgggcgctcggttcctggagttcgaagccctcggatttatgaatgaggatcactggttcagccgcgaaaactccctgtctggcgtcgagggggagggacttcataaactgggctatatcctcagagacattagcaagatccccgggggaaatatgtacgctgatgacaccgccggctgggatacacggatcaccgaagacgatctgcagaacgaggcgaaaattacagacatcatggaacctgagcacgcccttctggctaagtccatttttaaactcacctatcaaaataaggtggtccgcgtgcagagacccgccaagaacgggacggttatggatgtgatctctcggcgcgaccagagaggcagcggacaggtcggcacctacgggctgaatacattcaccaacatggaagctcaactgattcggcagatggagtccgagggaatctttagcccttctgaactcgagacacccaacctggccggcagagtgcttgattggctggaaaaacatggggtggagcgcctcaagcggatggcgatctccggagacgactgtgttgtgaaaccgattgatgacagattcgccaccgctctgacggcccttaatgatatgggcaaggtccgcaaagacatccctcagtgggaacccagcaaggggtggaacgattggcagcaagtgcctttttgctctcaccacttccatcagctgattatgaaggacggccgggagatcgttgtgccctgtagaaatcaggatgagctcgtcggacgcgctcgggtgtcccagggcgccgggtggagcctgagagaaacagcttgcctgggaaaatcctatgcccaaatgtggcagctcatgtactttcaccgccgggacctgagacttgcggccaacgctatttgttctgccgtccctgtggattgggttcccaccagccgcacaacctggtccatccatgcccaccatcagtggatgacgaccgaggacatgctgagcgtgtggaatcgggtctggattgaagagaacccgtggatggaagataagacacacgtgtcttcctggggcgacgttccttatctcgggaaaagagaggaccaatggtgcggaagcctgatcggccttaccgctcgggccacatgggcgaccaatatccaggtggctattaaccaggtcagacgcctgctcgggaatgagaactacctggattacatgacatctatgaagcggttcaaaaatgaaagcgaccccgagggcgccctgtggtga

SEQ ID NO: 19116 - RNA, 9879 nt, synthetic construct
  misc_feature 1..9879: note = derived and/or modified CDS sequence (opt5) from DENV-1__GQ199846__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccatcatggctcgcgataagcccacactggacattgaactgctcaaaaccgaggtcacaaaccctgccgttctgagaaagctttgcatcgaagcgaaaatttctaataccacgacagattcccggtgtccgacccaaggagaggccaccctgatggaagagcaggacgctaacttcgtgtgccgcagaacatttgtggatcggggctggggcaatgggtgtggactcttcggcaaggggagcctgatcacctgcgccaaatttaagtgcgtcacaaagcttgagggaaaaatcgtgcagtacgaaaacctgaagtattctgttattgtgacggtccacaccggcgaccagcatcaagtggggaatgagtccacagaacacggaaccacagctaccatcacgccccaggcccctaccagcgagattcagctcacagactacggcgccctgaccctggattgttctccccgcacaggcctcgacttcaacgaaatggttctgcttaccatgaaagagaagtcctggctggtgcataaacagtggtttctcgatctgcctcttccctggacgagcggggcttccacatctcaagagacctggaatagacaggacctgctcgtcacattcaagaccgcgcacgccaaaaagcaggaagtggtcgtgctgggaagccaagagggcgctatgcacaccgccctgacaggggccacggaaatccagacctccggaacaaccacaatttttgctggccatctcaagtgccggctgaaaatggataagcttaccctgaaagggatgagctatgttatgtgtacgggctctttcaagctcgagaaagaagtggccgagacacagcacggaaccgtcctggtgcagatcaagtacgagggcaccgacgcgccgtgcaagatccctttctccacacaagatgaaaaaggggttacccagaacggaagactgattacagctaatcccatcgtgacggacaaggagaaacctgtcaacattgaagccgagcccccctttggcgagagctatatcgtgattggggccggagaaaaggctcttaaactctcttggttcaagaagggcagctccatcgggaaaatgtttgaggccaccgctcgcggcgcccggagaatggcgatcctgggagatacagcctgggacttcggctctgtggggggagtttttaccagcgtcggcaagctggtgcatcagattttcgggacagcttacggagtgctcttttccggcgtcagctggaccatgaaaatcgggattggcgtgctgcttacgtggctgggactcaattctcgctccaccagcctgtctatgacatgtatcgccgttggcctggtgaccctttacctcggggtcatggtgcaggctgattccggatgcgttattaactggaagggccgggaactgaaatgtgggagcggaatcttcgtgacaaatgaggtccacacctggacagaacaatataagtttcaggccgactcccctaagagactgtctgcggccattggcaaagcttgggaggagggggtgtgcggcatccgcagcgccacccggctcgaaaacatcatgtggaagcagatttccaacgagctgaatcatatccttctggaaaacgacatgaaattcacggttgtggtcggagatgtggtgggcattctcgctcaggggaagaaaatgatcagaccgcaacccatggagcacaagtactcttggaaaagctggggaaaggccaagattatcggcgccgacgtccagaatacaacctttatcattgatgggcctaacacccccgaatgtcctgacgatcagcgcgcttggaatatctgggaggttgaggactatggattcggcatttttacaaccaacatctggctgaaactgcgggattcctacacgcaggtgtgcgaccacagacttatgagcgcggccattaaggattctaaagctgtgcatgccgacatgggctattggatcgaatccgagaagaatgaaacatggaaactcgcccgcgctagcttcatcgaggtcaagacctgtatttggcccaagtctcacacactgtggtccaacggggtgctggaaagcgagatgatcattccgaaaatctacggaggccctatttctcaacataattatcggcccgggtacttcacccagacagccggaccttggcacctcggcaagctggagcttgattttgacctgtgcgaagggaccacggttgtggtcgatgagcactgcggaaacagaggccccagcctccggaccacaaccgtgacaggcaaaatcatccatgaatggtgttgccgctcctgtaccctgcctcccctgagattcaagggggaggacggatgctggtacggcatggagattcggccggttaaagaaaaggaggaaaatcttgtgaagagcatggtctctgcggggtccggagaggtggacagcttttccctcggcctgctgtgtatctctattatgatcgaagaggttatgagaagccgctggtcccggaaaatgctcatgacggggacactggctgtgttccttctgctcattatgggacagctgacctggaacgatctgatcagactttgcattatggtcggcgccaatgcctctgaccgcatgggcatggggacaacctatctggctctcatggccacctttaagatgagacctatgttcgcggtgggactgctctttcggcgcctgacaagcagagaggtgcttctgctcacgatcggcctgtccctggtcgcttctgttgaacttcccaacagcctggaggaactcggggatggactggccatgggcatcatgattctcaaactgcttaccgacttccaatcccaccagctgtgggccacactcctgagcctgacctttatcaagacaaccctttctctgcattacgcttggaaaacgatggccatggtgctctccattgctagcctgttccccctctgtctgtctacaacctcccagaagaccacatggcttcctgtgctgctggggagcctcggatgcaagccgctgaccatgtttcttatcacagagacgaaaatttggggccggaagtcttggcccctgaatgaaggcatcatggccgtcggggtggtttccatcctcctgagctccctcctgaaaaacgatgtgcctcttgcgggacccctgattgccggcgggatgctgatcgcttgttatgtcattagcggatctagcgccgacctctccctggagaaggctgccgaggtgtcttgggaagaggaagccgagcacagcggcgcttcccataacatccttgttgtggtccaggatgacgggaccatgaaaattaaggatgaagagcgcgacgatacactgaccatcctcctgaaagcgacactcctggccgtgtctggagtctaccctcttagcatccccgctaccctgttcgtgtggtatttttggcaaaagaagaaacagagatccggcgttctgtgggacacgccttctcccccggaggtggaacgggccgtcctcgatgacggcatttaccgcatcatgcagagagggctgcttggacggagccaggtgggcgttggggtgttccaagagaatgtcttccacaccatgtggcacgtgacacgcggagccgtgctgatgtatcagggcaagagactcgaaccttcctgggctagcgttaaaaaggacctgatttcttacgggggaggctggcggctccagggctcctggaacaccggggaggaggtccaggtgatcgccgtggaacccggaaaaaatcctaagaacgtccaaacagcgcccggcacctttaagacaccggagggggaagtgggagctattgccctggatttcaaacctggcacgagcgggtctcccatcgttaatagagagggaaagattgtgggcctttacggcaacggggtcgtgaccacatccggaacctatgttagcgccatcgctcaggccaaagcgtcccaggaaggccctctgcccgagatcgaggacgaagtgtttcgcaagcggaatctgaccattatggatctccatcccgggtctggaaaaacaagacgctacctgcctgctatcgtccgggaggccattaagagaaagcttcgcacgctgatcctcgccccgacccgggtggttgctagcgaaatggccgaggctctgaaaggcatgcccattagatatcaaacaaccgccgtgaagtccgaacacacagggaaagagatcgtcgacctgatgtgccatgcgaccttcacgatgcgcctccttagccctgtgcgggtgcccaactacaatatgatcattatggatgaggcccactttacagacccttcttccatcgctgccagaggctatattagcacccgggtcggaatgggcgaagctgccgccatcttcatgaccgctacaccccctgggtctgttgaggcgtttccgcagagcaacgccgtgattcaggatgaagagcgcgacatccccgaaagatcctggaattctggatacgagtggatcaccgatttccctggcaagacagtgtggtttgtccccagcattaaatccgggaacgacatcgctaattgtctgcggaagaacggaaagcgcgtgattcagctgtctagaaaaaccttcgatacggagtatcaaaagacaaaaaataacgactgggactacgttgtgaccacagatatcagcgaaatgggcgccaactttcgggccgacagagtcattgatcctcgccggtgcctcaagcccgtgatcctgaaagacgggccggagagagttattcttgctggccctatgcccgtgaccgtcgcctccgcggctcagcgccggggaagaatcggccgcaatcataacaaggaaggggatcagtacatctatatgggacagcccctgaataacgacgaggatcacgcccactggacggaggccaagatgctcctggacaatattaacacccctgaaggcatcattcccgctctgttcgagcctgaacgggagaaaagcgccgcgatcgatggggaatacagactccgcggagaggccagaaagacattcgtggagcttatgcggcgcggcgacctgccggtctggctgtcttataaagtggcttccgaagggtttcaatacagcgatagacggtggtgcttcgacggcgagcgcaataaccaggttctcgaagagaatatggatgtggaaatttggaccaaggagggagagagaaaaaagctgcggcccagatggcttgacgcccgcacatattccgaccctctggctctccgggaatttaaagagttcgccgctggcagacgctctgtgagcggggatctgatcctggaaatcggaaagctcccccagcatcttacccagcgggcccaaaacgcgctggacaatctggtcatgctccacaactccgagcagggcgggagagcctaccggcatgctatggaagagctgcctgatacaattgagacccttatgctgctcgccctgatcgctgttctgacgggaggcgtgacactctttttcctttctggccgcgggctgggaaagaccagcattggcctgctctgtgtgatggcctccagcgtcctgctttggatggcctctgtggaaccccactggatcgctgcgtccattatcctggagtttttcctcatggttctgctgatcccggaacctgacagacagcggaccccccaggataatcaactcgcctatgtggtcattgggcttctgtttatgatcctgacagtggctgccaacgagatgggactcctggagaccacaaaaaaggaccttggcattgggcacgtcgccgtggaaaatcatcaccatgctacgatgctggatgttgacctccaccctgccagcgcgtggaccctgtacgccgtggctacaaccatcattacacccatgatgcgccataccatcgagaacacgaccgccaacatttctctgacagctatcgccaatcaggcggccatcctcatgggacttgataaaggctggcctatttccaagatggacatcggcgtccccctgctggctctcgggtgctacagccaggtgaacccgctgacccttacagccgctgttctgatgctcgtggcccactatgctattatcggacctggcctgcaagccaaagcgaccagagaagcccagaagcggacggctgccgggattatgaagaatcccacagtcgatggaatcgtggctatcgacctggatcccgtggtttacgacgccaaattcgagaagcagctcggccagattatgcttctgatcctgtgtacctctcaaattctcctgatgcgcacaacctgggccctttgcgaaagcatcaccctggcgacagggcctctcacgaccctgtgggagggatccccgggcaaattttggaacacaaccattgctgtctctatggccaatatcttcagaggcagctatctggctggggccggactcgccttttcccttatgaagagcctgggcgggggacggcgcggcacaggggctcagggagagaccctgggcgaaaaatggaagagacagctcaaccagctgtccaagtctgagttcaatatctacaaacggagcggcattatggaagtggacagatccgaggccaaggaagggcttaaacgcggagagacgacacggcacgcggtgtctagaggcaccgccaagctgcgctggttcgtcgagcggaacctcgttaaacccgaagggaaggtgatcgatctgggatgtggcagagggggatggagctattactgcgctggcctgaagaaagtgaccgaggtcaagggctatacaaaagggggacctggccatgaagagcccattcctatggccacctacgggtggaatctcgtgaagcttcactccggaaaagacgtttttttcacaccccctgaaaagtgtgatacgctgctgtgcgacatcggcgagtctagcccgaaccccaccattgaggaagggcgcacactccgggtgctgaaaatggtcgagccttggcttagaggaaatcaattttgtatcaagattctgaacccctacatgccttccgtggttgaaaccctcgagcagatgcagcgcaagcatggcggcatgctggtgcggaatcccctgagcagaaactctacacacgagatgtattgggtctcctgcgggaccggaaatatcgtgagcgctgtgaacatgacgtctcgcatgctcctgaatcggttcaccatggcccacagaaaaccgacatacgaacgcgatgtcgaccttggcgcggggaccagacatgttgccgtggagcctgaagtggctaacctggatatcattggacagcggatcgagaacattaagcacgaacataaatccacatggcactatgacgaggataatccctacaagacctgggcctatcatggcagctacgaggtcaaaccctctgggtccgctagctccatggtgaacggagttgtgaagctcctgacaaagccttgggacgtcatccccatggtgacccaaattgccatgacggatacaaccccttttggccagcagcgcgttttcaaagaaaaggtggacaccagaacaccgaaagctaagcggggcacggcccaaatcatggaggtcaccgcgagatggctttgggggtttctgagccggaataaaaagccccgcatctgtacaagagaagagttcacccggaaggtgcgctctaacgccgctattggagccgtttttgtggacgaaaatcagtggaacagcgctaaagaggccgtcgaggatgaaagattctgggacctcgtgcagaaggagcgggaactgcacaaacagggcaagtgcgccacatgcgtctataatatgatggggaaacgcgagaagaagctgggagaatttggcaaagcgaaggggtccagagctatctggtacatgtggctcggcgcccggttcctggagtttgaggcccttggattcatgaacgaagatcactggttctctcgcgagaatagcctgtccggcgtggaaggggagggactccataaactgggctacattcttagagacatctctaagattcctgggggaaacatgtatgctgatgacaccgccggctgggatacacggatcaccgaggacgatctgcaaaatgaagctaaaatcacggacattatggagcccgaacacgccctcctggcgaccagcatctttaagctgacataccagaacaaagttgtgcgcgtccagagacctgccaagaatgggaccgtgatggatgtgatttcccggcgcgaccagagaggctctggacaagttggcacatatgggctcaacaccttcacgaatatggaggctcagctgatccggcagatggaaagcgagggaatttttcttccctccgagctggaaacaccgaacctcgccgagagagtgctggattggcttgaaaagtacggcgtcgagcgcctgaaacggatggctatcagcggggacgactgtgtggttaagcctatcgatgacagattcgccaccgcgctcacagccctgaacgatatgggaaaagtgcgcaaggacattccccagtgggaaccttctaaaggctggaatgattggcaacaggtccccttttgctcccatcacttccaccagctgatcatgaaggacgggcgggagattgtggtcccttgtagaaaccaggatgagctcgtgggccgcgctcgggttagccaaggagccggctggtctctgagagaaaccgcttgccttgggaagtcctatgcccagatgtggcagctgatgtactttcatcgccgggacctcagactggctgccaatgcgatctgtagcgccgtgcccgtcgattgggtgccgacgtcccgcaccacatggtctattcacgctcatcaccaatggatgaccacagaggacatgcttagcgtttggaaccgggtgtggatcgaagagaatccttggatggaagataaaacccatgtctccagctggggagacgtgccctatctgggcaagagagaggaccagtggtgcgggtctctcattggactgacagcccgggccacctgggcttccaacatccaggtggccatcaatcaggttagacgcctgattggcaacgagaattacctcgattacatgacgagcatgaaacggttcaagaacgaaggggaccccgagggcgcgctgtggtga

SEQ ID NO: 19117 - RNA, 9879 nt, synthetic construct
  misc_feature 1..9879: note = derived and/or modified CDS sequence (opt5) from DENV-1__GQ199847__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccgccctgctcaaaaacgatgttcctctggctggacccctcatcgccggcgggatgctgattgcttgttacgtgatcagcggatctagcgccgacctttccctggagaaggccgctgaggtctcttgggaagaggaagcggagcatagcggcgcctcccacaatattctggtggaagttcaggatgacgggacaatgaaaatcaaggatgaggagcgggacgatacgctcaccatcctgcttaaggctacactgctcgccgtgtctggagtctatcctctgagcattcccgccaccctcttcgtgtggtacttttggcagaaaaagaaacaacgctccggcgtcctgtgggacacaccttctcccccggaagtggagagagctgttcttgatgacggcatctatcggattatgcagcgcgggctgctgggaagaagccaggtgggcgtcggggtgttccaggaaaacgtttttcataccatgtggcacgtgacgcggggagccgtcctcatgtaccaaggcaagcgcctggagccttcctgggcgagcgtgaaaaaggaccttatctcttacgggggaggctggagactgcagggctcctggaataccggggaggaagtgcaggttattgctgtcgagcccggaaagaaccctaaaaatgtgcagacagcccccggcaccttcaagacaagcgaaggggaggtgggagccatcgctctcgattttaaaccgggcacctctgggtcccctattgtcaaccgggaaggaaagatcgtgggcctgtatggcaatggggttgtgacaacgagcggaacctacgtctccgccatcgcgcaagctaaagcctctcaggagggccccctccctgagattgaagacgaggtgttcagaaagcgcaacctgacaatcatggatcttcaccccgggagcggaaagacccggagatatctgcccgccattgttcgcgaagctatcaaacggaagctgagaaccctcattctggcccctacacgcgtggtcgcttccgagatggccgaagcgcttaaaggcatgccgatccggtaccagacgaccgccgtgaagtccgagcatacagggaaagagatcgttgacctgatgtgccacgctacctttacaatgagactcctgtctcccgtgcgcgtccctaattataacatgattatcatggatgaagcccatttcaccgacccctccagcattgctgcccggggctacatctctacgagagtgggaatgggcgaggccgctgcgatttttatgacagccacccctcccgggagcgtggaggctttccctcaatccaatgccgtcatccaggatgaagaacgggacatcccggagcgctcttggaacagcggatatgagtggattaccgattttcccggcaagacagtttggttcgtgccttccatcaagtctgggaatgacattgccaactgtctgcgcaagaatggaaagcgggtgatccagctcagccgcaaaaccttcgatacagaataccagaagaccaaaaacaacgactgggactacgtcgtgacgacagatatttccgagatgggcgctaattttagagccgaccgggttatcgatcccagacgctgccttaagcctgtgattctgaaggacgggcccgaacgggtcatcctggcgggcccgatgcctgtgaccgttgctagcgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatctgccgctattgatggggagtatcggctcagaggagaggcccgcaagacgtttgtggaactgatgagacggggcgacctgcctgtctggctctcctacaaagtggctagcgaggggttccagtattccgatcgcagatggtgctttgacggcgaacggaacaatcaagtccttgaggaaaacatggatgtggagatctggaccaaggagggagaacgcaaaaagctgagaccgcggtggctggacgccagaacatactctgaccccctcgctctgcgcgagttcaaggaatttgccgcgggccggagaagcgtttccggggatcttatcctggagattggaaaactccctcagcacctgacccagcgcgcccagaatgctctggacaacctcgtgatgcttcataattctgaacaaggcgggcgggcctatagacacgctatggaggagctgcccgatacaatcgaaaccctgatgctcctggcccttattgccgtgctgacaggaggcgtcaccctcttctttctgagcggccgggggctgggaaagacgtccatcggcctcctttgtgttatggctagctctgtgctgctgtggatggcgtccgtggagcctcattggattgccgctagcatcatcctcgagttctttctgatggtccttctgattcccgagccggaccgccagagaacacctcaggataaccagctcgcctacgtggttatcgggctgctgttcatgattctcaccgtggccgctaatgagatgggacttctggaaaccaccaagaaggacctgggcatcgggcacgtcgccgtggagaaccaccatcacgcggccatgctcgatgtcgacctgcatcccgcttctgcctggaccctttacgctgtggccacaacgattatcacccctatgatgcggcacacaattgaaaacaccacagcgaatatctccctgaccgccatcgctaaccaagccgctattctcatgggactggataaaggctggcccatcagcaagatggacattggcgttcctctgctcgcccttgggtgctattctcaggtgaatcccctgacgctgaccgctgccgtcctcatgctggtggcgcattacgccatcattggaccgggccttcaggctaaggccacacgcgaggctcagaagagaaccgccgccgggatcatgaagaaccctacagttgatggaatcgtggcgattgacctggatcccgtcgtgtatgacgctaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggttgaccggtctgaagctaaggaggggctgaaaagaggagagacaaccaagcacgccgtcagccgcggcacggctaagctccggtggtttgtggaaagaaatctggtgaaaccggaggggaaggtcatcgatcttggatgtggccgcgggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggcggacacttagagtgctgaaaatggttgaaccctggctgcgcggaaaccagttctgtattaagatcctcaatccttatatgcccagcgtggtcgagacgctggagcaaatgcagcggaaacacggcggcatgcttgtgagaaaccctctgtctcgcaattccacccatgaaatgtactgggttagctgcgggacaggaaacatcgtgtctgccgtcaatatgacctcccggatgctcctgaacagatttacaatggctcaccgcaagcccacctatgagcgggatgtggacctgggcgccgggacgagacacgtggctgtcgaaccggaggttgccaacctcgatattatcggacagcgcattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccaacagagagtctttaaggagaaagtggacacgcggacacctaaggccaagcgcggcaccgctcagatcatggaagttaccgccaaatggctgtgggggttcctctctagaaacaagaaaccgcggatttgtacaagagaggaatttacgcggaaggtgcgcagcaatgctgccatcggagccgtcttcgtggacgagaaccaatggaactccgcgaaagaggctgttgaagatgagagattttgggacctggtgcatcgggaacgcgagcttcacaagcagggcaagtgcgccacatgcgtctacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtggagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtcgtgagagttcaacggcccgctaaaaacgggaccgtgatggatgtcatctctcgcagagaccagcggggcagcggacaggtgggcacgtacgggctcaatacctttacaaacatggaagcccagctgattcgccaaatggagtccgagggaatcttcagcccttctgaactggagacccccaacctcgcgggcagagtgctggattggcttgaaaagcatggggttgagcggctgaaaagaatggccatctccggagacgactgtgtggtcaagccgattgatgaccgctttgctacagccctcaccgctctgaatgatatgggcaaggtgcggaaagacatccctcagtgggaacccagcaaggggtggaacgattggcagcaggttcctttctgctctcaccactttcatcaacttattatgaaagacggcagagagatcgtggtcccctgtcgcaatcaggatgagctggtgggacgggccagagtctcccagggcgctgggtggagcctccgcgaaacggcctgcctgggaaagtcctatgcgcagatgtggcaactgatgtacttccaccggagagacctccgcctggccgctaacgccatttgttctgccgatcctgacgattgggtgcccacaagccggaccacatggtccatccatgctcaccatcagtggatgaccacggaggacatgcttagcgtttggaatagagtgtggattgaagagaacccgtggatggaagacaaaacccacatctcttcctggggcgatgtcccttatctggggaagcgcgaggaccagtggtgcggaagcctcatcggcctgacagcccgggcgacctgggctacaaatattcaagtggccatcaaccaggttagacggcttattgggaatgagaactacctggattacatgacctctatgaagagatttaaaaatgaaagcgaccccgagggcgccctctggtga

SEQ ID NO: 19118 - RNA, 9879 nt, synthetic construct
  misc_feature 1..9879: note = derived and/or modified CDS sequence (opt5) from DENV-1__GQ199849__SS-prME
  source 1..9879: mol_type = other RNA
agcgtgaccatgctgctgatgctgatgcccacagcccttgctttccacctgacgaccagaggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagcagaacaggcgagcaccggcgcgacaagagatccgtcgccctggctcctcatgtggggctgggactcgagacccggacggaaacatggatgtctagcgagggcgcctggaaacaaattcagcgcgttgaaacctgggctctgagacaccccggcttcacagtgatcgccctttttctggcgcatgccattgggacctccatcacccagaagggaatcattttcatcctcctgatgcttgtcacaccttctatggctatgcggtgcgtgggcattgggagccgcgattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgagaaaactttgcattgaagcgaagatctctaatacgacaaccgattcccggtgtccgacccagggagaggccacactgatggaagaacaagacgctaacttcgtgtgccgcagaacctttgtggatcggggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaggtggggaatgagtccaccgaacacggaacaaccgctacgattacaccccaagcccctacaagcgagatccagctcaccgactacggcgccctgacactggattgttctccccgcaccggcctcgacttcaacgaaatggttctgcttacgatgaaggagaaatcctggctggtgcataagcagtggtttctcgatctgcctcttccctggacaagcggggcttccacctctcaggagacatggaatagacaagacctgctcgtcaccttcaaaaccgcgcacgccaagaagcaggaagtggtcgtgctgggaagccaggagggcgctatgcacacagccctgacgggggccaccgaaattcaaacatccggaaccacaaccatctttgctggccatctcaaatgccggctgaagatggataaacttgccctgaaggggatgagctatgttatgtgtacgggctctttcaaactcgagaaggaagtggcggagacacagcacggaaccgtcctggtgcagattaagtacgagggcaccgacgctccgtgcaaaatccctttctccacacaggatgaaaagggggttacccaaaacggaagactgatcacagccaatcccattgtgacggacaaagagaagcctgtcaacatcgaagccgagccgccctttggcgagagctatattgtgatcggggctggagaaaaagcccttaagctctcttggttcaagaaaggcagctccattgggaagatgtttgaggctaccgcccgcggcgcgcggagaatggccatcctgggagatacagcttgggacttcggctctatcgggggagtgtttaccagcgttggcaaactggtccatcagattttcgggacagcctacggagtgctcttttccggcgtgagctggaccatgaagatcgggattggcgtcctgcttacgtggctgggactcaattctcgctccaccagcctgtctatgacatgtatcgctgtgggcctggttaccctttacctcggggtgatggtccaggccgattccggatgcgtgattaactggaaaggccgggaactgaagtgtgggagcggaatcttcgttacaaatgaggtgcacacctggacagaacagtataagtttcaagcggactcccctaaaagactgtctgccgctattggcaaggcctgggaggagggggtctgcggcatccgcagcgctacccggctcgaaaacatcatgtggaaacagatttccaacgagctgaatcatatccttctggaaaacggactcaagttcacggtggttgtgggcgacgtcgtggggattctggcccagggcaagaagatgatcagaccgcagcccatggagcacaaatactcttggaaaagctggggcaaggccaagattatcggggctgatgtgcaaaatacaacctttatcattgacggacctaacacccccgaatgtcctgatgaccagcgcgcgtggaatatctgggaggtcgaggattatggcttcggcatttttacaaccaacatctggctgaaacttcgggactcctacacgcaggtttgcgatcacagactcatgagcgccgctattaaagactctaaggccgtgcatgccgatatggggtattggatcgaatccgagcgcaatgaaacatggaaactggctcgggccagcttcatcgaggtgaagacctgtatttggcccaagtctcacacactgtggtccaacggagtcctcgaaagcgagatgatcattccgaaaatctacggcgggcctatttctcagcataattatagacccggatacttcacccaaacagcgggcccttggcacctggggaaacttgagctggactttgatctctgcgaaggaaccacggtggttgtggacgagcactgcggcaaccggggccccagcctgcgcaccacaaccgtcacagggaaaatcatccatgaatggtgttgcagatcctgtaccctgcctccccttcggttcaagggagaggatggctgctggtacgggatggagattagaccggtgaaagaaaaggaggaaaatctcgttaagagcatggtgtctgctggatccggcgaggtcgacagcttttccctggggctgctctgtacgtctatcatgattgaagaggtgatgcgcagccggtggtccagaaaaatgctgatgacaggaacccttgccgttttcctgctcctgatcatgggccagctgacatggaacgaccttattcgcctgtgcatcatggtgggcgccaatgcttctgatagaatggggatgggaaccacctatctcgccctgatggcgacatttaagatgcggcctatgttcgctgtcggcctcctgtttcgcagacttacgagccgggaggtgctgctcctgaccattgggctgtcccttgtggcctctgtcgaactgcccaacagcctcgaggaactgggagacggcctcgccatggggatcatgatcctgaaacttctgacagatttccagtcccaccaactctgggctaccctgctgagccttacatttattaagaccacgctgtctctccattacgcctggaaaacaatggctatggttctgtccatcgtgagcctcttccccctgtgtctttctaccacctcccagaagacaacctggctgcctgtgctgctcggaagcctgggctgcaagccgcttacaatgtttctgattgccgagaataaaatctggggccgcaagtcttggcccctcaacgaagggattatggcggtcggagtggtttccatcctgctcagctccctgcttaaaaacgacgtgcctctggccggccccctgatcgctgggggaatgctcattgcctgttatgtcatcagcggctctagcgctgatctgtcccttgagaaggccgccgaggtgtcttgggaagaggaagctgagcacagcggggcgtcccataatattttcgttgaagtgcaggacgatggaacgatgaaaatcaaggacgaggagagagatgacaccctgacaattctcctgaaagccaccctcctggctgtctctggcgtgtaccctcttagcatccccgccacactgtttgtctggtatttctggcagaagaagaaacaacggtccggcgtgctgtgggataccccttctcccccggaagttgagcgcgccgctctcgacgatgggatctacagaattatgcagcggggactgcttggccgcagccaggtgggggtcggagtgttccaggaaaacgtttttcacacgatgtggcacgtgaccagaggcgccgtcctgatgtatcaagggaagcggctcgagccttcctgggcgagcgtgaaaaaggacctgatctcttacggaggcggctggagactccaggggtcctggaatacaggagaggaagtgcaggttattgctgtcgagcccggcaaaaaccctaagaatgtgcagaccgcccccgggacattcaagaccccggaaggagaggtgggcgccatcgctctggactttaaacctgggacaagcggatctcccattgtcaaccgcgaaggcaagatcgtgggcctttacgggaatggagttgtgacgacctccggcacatatgtcagcgccattgcgcaaaccaaggcttcccaggaggggcctctgcccgagatcgaagatgaggtgttccggaagagaaacctgaccatcatggacctccatcccggatctggcaaaacacgccggtacctgcctgccattgttagagaagccatcaagcgcaaacttcggacgctgattctcgctccgaccagagtggtcgccagcgagatggctgaagccctgaaagggatgcccatccgctatcagacaaccgcggtgaagtccgagcacacaggcaaagagattgttgatctgatgtgccatgccacctttacgatgcggctccttagccctgtgagagtccccaattacaacatgatcatcatggacgaagctcacttcacagatccttcttccattgccgctcggggatatatcagcacccgcgtgggcatgggggaggccgccgctatttttatgaccgcgacaccccctggatctgtggaagccttcccgcaaagcaatgctgtcatccaggacgaggaaagagatattcccgagcggtcctggaactctggctacgagtggatcaccgactttcctgggaagacagtttggttcgtgcccagcatcaaatccggaaatgatattgccaactgtctgcgcaagaatggcaagagagtgatccagctgtctcggaaaacctttgacacggaatatcagaagaccaagaacaacgattgggactacgtcgtgaccacagacattagcgagatgggggccaatttcagagctgatcgcgttatcgaccctcggagatgcctcaagcccgtgattctgaaagatggcccggaacgcgtcatccttgccggacctatgcccgtgaccgttgcgtccgctgcccaacggagaggccgcattgggcggaaccataataaggagggagaccagtacatctatatgggccagcccctgaacaatgatgaggaccacgcccactggacggaagctaagatgctcctggataacatcaatacccctgaggggattatccccgccctgttcgaacctgagagagaaaagagcgcggccattgacggagagtaccgcctcagaggcgaggctcggaagacatttgtggagcttatgcgcagaggggatctgccggtctggctgtcttataaagtggcctccgagggcttccagtacagcgaccggcgctggtgctttgatggagaaagaaacaatcaagtcctcgaggaaaacatggacgtggagatctggaccaaggagggcgaacggaaaaagctgagaccccgctggcttgatgctcggacatattccgaccctctggccctcagagagttcaaagaatttgctgccgggcgccggtctgttagcggagacctgattctggagatcggcaagctcccccagcatcttacccagagagcgcagaatgccctggataacctggtgatgctccacaattccgaacaagggggacgggcttaccgccatgccatggaggagctgcctgacacaatcgaaacccttatgctgctcgctctgattgccgtgctgacgggcggcgtcacactcttctttctttctgggagaggactgggcaagaccagcatcgggctgctctgtgttatggcctccagcgtgctgctttggatggcttctgtggagccccactggattgcggcctccatcattctggagttctttctcatggtcctgctgatcccggagcctgatcggcagcgcacaccccaggacaaccagctcgcttatgtggttatcggacttctgttcattatcctgacagtggccgccaatgagatgggcctcctggaaaccaccaagaaggatcttgggattggacacgtcgctgtggagaaccatcaccatgccacgatgctggacgtcgatctccaccctgcgagcgcctggaccctgtacgctgtggccacaaccatcattacacccatgatgagacataccatcgaaaacacgaccgctaatatttctctgacagccatcgcgaaccaagccgctatcctcatgggccttgacaaaggctggcctatttccaagatggatatcggggttcccctgctggccctcggatgctacagccaggtgaatccgctgacccttacagctgccgtcctgatgctcgtggctcactatgccattatcggccctgggctgcaggcgaaagccacccgggaggctcaaaagcgcacggccgctggaattatgaagaaccccacagttgacggcatcgtggccatcgatctggaccccgtcgtgtacgatgccaaatttgaaaagcagctcgggcagattatgcttctgatcctgtgtacctctcagattctcctgatgagaacaacctgggcgctttgcgagagcatcaccctggctacaggacctctcacgaccctgtgggagggctccccgggcaaattctggaatacaaccattgccgtgtctatggctaacatctttcgggggagctatctggccggagccggcctcgctttctcccttatgaaaagcctcgggggaggccgcagagggacaggagcccaaggcgaaaccctgggcgagaaatggaagcggcagctcaatcagctgtccaagtctgagttcaacatctacaaaagaagcgggattatggaggttgaccgctccgaagcgaaggagggacttaaacggggcgagacgacaagacacgccgtctctcgcgggaccgctaagctgcggtggtttgtggaaagaaatctcgtgaaacccgagggaaaggtcatcgacctgggctgtgggcgcggaggctggagctattactgcgccggcctgaagaaagttaccgaagtgaaggggtatacaaaaggaggccctgggcatgaggaacccattcctatggctacctacggatggaacctcgtgaaacttcactccggcaaagatgtcttctttacaccccctgagaagtgtgacacgctgctgtgcgatatcggggagtctagcccgaatcccaccattgaagagggacggacactcagagtgctgaaaatggttgaaccttggcttcgcggcaaccagttctgtatcaagattctgaatccctacatgccttccgtggtcgagaccctcgagcaaatgcagcggaagcatggcgggatgctggtgagaaaccccctgagccgcaattctacacacgaaatgtattgggtttcctgcggaaccggcaacatcgtgagcgccgtcaatatgacgtctcggatgctcctgaacagatttaccatggcgcaccgcaaaccgacatacgagagagacgtggatcttggggccggaacccggcatgtggctgtcgaacctgaggttgccaacctggacatcattggccagcgcatcgaaaatattaagcacgagcataaatccacatggcactatgatgaggacaacccctacaagacctgggcttatcatgggagctacgaagtgaaaccctctggatccgccagctccatggtgaatggcgtcgtgaagctcctgacaaagccttgggatgttatccccatggtgacccagattgctatgacggacacaacccctttcggccaacagagagtctttaaagagaaggtggatacccggacaccgaaagccaagagagggacggcgcagatcatggaagttaccgcccggtggctttggggattcctgagccgcaacaaaaagcccagaatctgtacacgggaggaatttacccgcaaggtgagatctaatgctgccattggcgctgtcttcgtggacgagaaccaatggaatagcgccaaagaggccgttgaagacgagcggttttgggatctcgtgcagaaggaacgcgagctgcacaaacaggggaagtgcgcgacatgcgtctataacatgatgggaaaaagagaaaagaagctgggcgagttcgggaaagctaagggctcccgggccatctggtacatgtggctcggagcccgctttctggagttcgaagctcttggcttcatgaatgaggaccactggttttctagagaaaacagcctgtccggggtggagggagagggcctccataaactggggtacattcttcgggatatctctaagattcctggaggcaatatgtatgccgacgataccgctgggtgggacacacgcatcaccgaagatgacctgcagaacgaggccaaaatcacggatattatggaacccgagcacgcgctcctggccaccagcatcttcaagctgacataccaaaataaagtcgtgagagttcagcggcctgctaagaacggcaccgtgatggacgtcatttcccgcagagatcagcggggatctggccaggtggggacatatggactcaatacctttacgaacatggaagcccaactgatcagacagatggagagcgagggcattttccttccctccgaactggagacaccgaacctcgctgaacgcgtgctggactggcttgagaagtacggggttgaacggctgaaaagaatggccatcagcggagatgactgtgtggtcaagcctatcgacgatcgctttgcgaccgccctcacagctctgaatgacatgggcaaagtgcggaaggatattccccagtgggagccttctaaagggtggaacgactggcagcaagttcccttctgctcccatcactttcaccagctgatcatgaaggatggcagagagattgtggtcccttgtcgcaatcaggacgaactcgtgggacgggccagagtcagccagggcgctgggtggtctctgcgcgagaccgcctgccttggaaagtcctatgctcaaatgtggcagctgatgtacttccatcggagagatctccgcctggccgcgaacgccatctgtagcgctgtgcccgttgactgggtgccgacgtcccggaccacatggtctattcacgcccatcaccagtggatgaccacagaagatatgcttagcgtctggaatagagtgtggatcgaggaaaacccttggatggaggacaaaacccatgtttccagctggggcgatgtgccctatctggggaagcgggaggaccaatggtgcggatctctcattggcctgacagccagagctacctgggcctccaatatccaggtcgcgatcaaccaggtgcgccggctgattgggaatgaaaactacctcgactacatgacgagcatgaaaagatttaagaatgagggcgatcccgaaggagctctgtggtga

SEQ ID NO: 19119 - RNA, 9879 nt, synthetic construct
  misc_feature 1..9879: note = derived and/or modified CDS sequence (opt5) from DENV-1__FJ898410__SS-prME
  source 1..9879: mol_type = other RNA
agcgtgaccatgctgctcatgctgacacccacggcccttgctttccacctgaccacaagaggcggggagcctcatatgatcgtctccaagcaggaacggggaaaatctctcctgtttaagaccagcgccggcgttaacatgtgcacacttattgcgatggacctgggggagttctgtgaagataccatgacatacaaatgcccgcgcatcaccgaggctgaacccgacgatgtggactgttggtgcaatgccacggatacctgggtgacatatggaacctgttcccaaacaggcgagcacagacgggacaagcgctctgtcgccctcgctcctcatgtggggctgggactggagaccagaacggaaacatggatgagctccgagggcgcctggaaacagattcagcgggttgaaacctgggctctccgccaccccggctttacagtgatcgccctgttccttgcgcatgccattgggacctctatcacccagaagggaatcatttttatcctgctcatgctggtcacacctagcatggctatgagatgcgtgggcattgggtcccgggatttcgttgagggacttagcggcgccacgtgggtggacgtcgtgctggagcacgggtcttgtgtgaccacaatggctaaggataaacccaccctcgacatcgaactgctgaagacagaggtcaccaaccctgccgttctccgcaaactgtgcattgaagcgaagatctccaatacgacaaccgatagcagatgtccgacccaaggagaggccacacttgtggaagagcaggacgctaactttgtgtgccggcgcaccttcgtcgatagaggctggggcaatgggtgtggactgtttggcaaagggtctctcattacatgcgccaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgctacgattaccccccaggccccttctacagagatccagctgaccgactacggcgccctcacactggattgttccccccggaccggcctggactttaacgaaatggtgctcctgacgatgaaggagaaaagctggcttgtccataagcagtggttcctggatctccctctgccctggacatccggggcttctaccagccaagagacatggaatcgccaggaccttctggtgacctttaaaaccgcgcacgccaagaagcaggaagtcgtggttctcggatcccaagagggcgctatgcacacagccctgacgggggccaccgaaattcagacaagcggaaccacaaccatcttcgctggccatctgaaatgcagactcaagatggataaactgacgcttaaggggatgtcttatgtgatgtgtacaggctccttcaaactggagaaggaagtcgccgagacccagcacggaaccgtgctcgttcagattaagtacgagggcacagacgcgccgtgcaaaatcccttttagcacccaagatgaaaagggggtgacacagaacggacggctgatcacggctaatcccattgtcaccgacaaagagaagcctgtgaacatcgaagccgagccccccttcggcgagtcttatattgtgatcggggccggagaaaaagctctgaagcttagctggtttaagaaaggctcctctattgggaagatgttcgaggccacagctagaggcgcccgccggatggcgatcctcggagataccgcctgggactttggcagcatcgggggagttttcacatccgtcggcaaactggtgcatcagatttttgggaccgcttacggagtgctgttcagcggcgtctcttggacgatgaagatcgggattggcgtgctcctgacctggcttggactgaattccagaagcacatctctctccatgacctgtatcgccgttggcctggtgacactgtaccttggggtcatggtgcaggctgatagcggatgcgttattaactggaaaggccgcgaactcaagtgtgggtccggaatctttgtgaccaatgaggtccacacatggaccgaacaatataagttccaggccgactctcctaaacggctgagcgcggccattggcaaggcttgggaggagggggtgtgcggcatcagatccgccacgcgcctggaaaacatcatgtggaaacagatttctaacgagctcaatcatatcctgcttgaaaacgacatgaagctgacagttgtggtcggagatgtggctggcattctcgcccaggggaaaaagatgatccggccgcaacccatggagtacaaatatagctggaagatttggggaaaggccaaaatcatcggcgctgacgtgcagaataccacctttattatcgatgggcctaacacacccgaatgtcctgacgatcagagagcgtggaatatttgggaggtcgaggactacggattcggcatctttaccacgaacatttggctgaagctgcgcgattcctatacacaggtttgcgaccaccggcttatgagcgccgctatcaaagattctaaggccgtgcacgccgacatgggctactggatcgaatccgagaaaaatgaaacctggaagctcgctagagccagcttcattgaggtgaagacatgtatctggcccaaatctcataccctgtggtccaacggggtcctggaaagcgagatgattatcccgaagatttatggaggccctatctctcaacacaattaccgccccgggtacttcacacagaccgcgggaccttggcatctcggcaaactggagcttgattttgacctgtgcgaagggacgaccgtggttgtggatgagcactgcggaaaccggggccccagcctcagaacaaccacagtcaccggcaagatcattcacgaatggtgttgccggtcctgtacgctgcctcccctgcgcttcaaaggggaggacggatgctggtatggcatggagatcagaccggtgaaggaaaaggaggaaaatcttgttaaaagcatggtgtctgctgggtccggagaggtcgacagcttttccctcggcctgctgtgtatttctatcatgattgaagaggtgatgcggagcagatggtcccgcaagatgctcatgacagggaccctggccgttttctttcttctgatcatgggacagctcacatggaacgatctgattcggctgtgcatcatggtgggcgccaatgcttctgacagaatgggcatggggaccacctaccttgccctgatggcgacattcaaaatgcgccctatgtttgctgtcggactcctgttcagacggctcacgagccgcgaggtgctgcttctgaccatcggcctctccctggtggcctctgtcgaactgcccaacagccttgaggaactgggggatggactcgccatgggcattatgatcctgaagctcctgacagactttcaatcccatcagctttgggctaccctgctcagcctgacattcattagaaccacgttttctctgcactatgcctggaaaacaatggctatggttctttccatcgtgagcctgttccccctctgtctgtctaccacctcccagaagacaacctggctccctgtgctgcttgggagcctgggatgcaagccgctgacaatgtttctcattgccgagaataaaatctggggccggaagtcttggcccctgaacgaaggcatcatggcggtcgggattgtgtccatccttctgagctccctcctgaaaaacgatgttcctctcgccggacccctgattgctggcgggatgcttatcgcctgttacgtgattagcggatctagcgctgacctgtccctggagaaggccgccgaggtctcttgggaagaggaagctgagcatagcggcgcgtcccacaatatcctcgtggaagttcaggatgacgggacgatgaaaatcaaggatgaggagcgcgacgataccctgacaattcttctgaaagccaccctcctggctgtgtctggagtctatcctctcagcatccccgccacactgttcgtgtggtacttctggcaaaagaagaaacagagatccggcgtcctttgggacaccccttctcccccggaagtggagcgggccgttctggatgacggcatttatcgcatcatgcagagagggctgctcggacggagccaggtgggcgtcggggtgtttcaagaaaacgttttccatacgatgtggcacgtgacccgcggagctgtcctgatgtaccagggcaagagacttgagccttcctgggccagcgtgaaaaaggacctgatttcttacgggggaggctggcggctccagggctcctggaatacaggggaggaagtgcaggttatcgcggtcgagcccggaaaaaaccctaagaatgtgcaaaccgctcccggcacatttaagaccagcgaaggggaggtgggagccattgccctggatttcaaaccgggcacatctgggtcccctatcgtcaacagagaaggaaagatcgtgggcctctatggcaatggggttgtgacgaccagcggaacatacgtctccgctattgcccaggcgaaagcttctcaggagggccccctgcctgagatcgaagacgaggtgtttcgcaagcggaaccttaccattatggatctgcaccccgggagcggaaaaaccagacgctatctgcccgccatcgttcgggaagccattaagagacgcctccggacactgatccttgctcctacgagagtggtcgcctccgagatggctgaagccctgaagggcatgccgatccgctaccaaaccacagcggtgaaaagcgagcataccgggaaggagattgttgacctcatgtgccacgccacattcaccatgcggctgctgtctcccgtgagagtccctaattataacatgatcattatggatgaagctcattttacggacccctccagcatcgccgctcggggctacatttctacacgcgtgggaatgggcgaggccgccgctatcttcatgaccgcgacccctcccgggagcgtggaagcctttcctcagtccaatgctgtcatccaggatgaggaaagagacattccggagcggtcttggaacagcggatatgagtggatcacagatttccccggcaaaaccgtttggtttgtgccttccattaagtctgggaatgacatcgccaactgtctccgcaaaaatggaaagagagtgattcagcttagccggaagacattcgataccgaataccaaaaaacgaagaacaacgactgggactacgtcgtgacaaccgatatctccgagatgggcgccaatttcagagctgaccgcgttattgatccccggagatgcctgaaacctgtgatcctgaaggacgggcccgaacgcgtcatcctcgccggcccgatgcctgtgacagttgcgagcgctgcccagcggagaggacgcattggccggaaccacaataaagagggggatcagtatatctacatgggacagcccctgaacaatgacgaggatcatgcccactggaccgaagctaagatgcttctggacaacattaatacgcccgagggcatcattcctgccctctttgaacccgagagagaaaagtctgcggccatcgatggggagtatcgcctgagaggagaggctcggaaaaccttcgtggaactgatgcgcagaggcgacctccctgtctggctttcctacaaggtggccagcgaggggtttcaatattccgatcggcgctggtgcttcgacggcgaaagaaacaatcaggtcctggaggaaaacatggatgtggagatctggacaaaagagggagaacggaagaaactgagaccgcgctggctcgacgctcggacctactctgaccccctggcccttagagagtttaaggaattcgctgccggccgccggagcgtttccggggatctgattctcgagatcggaaaactgcctcagcacctgacacagagagcgcaaaatgccctcgacaaccttgtgatgctgcataattctgaacagggcgggcgggcttatcgccacgccatggaggagctgcccgataccattgaaacactcatgctgcttgctctgatcgccgtgctcaccggaggcgtcacgctgtttttcctgagcggcagagggctcggaaagacatccattggccttctgtgtgttatggccagctctgtgctgctctggatggcttccgtggagcctcattggatcgcggccagcatcattctggaatttttccttatggtcctgctcatccccgagccggaccggcagcgcacccctcaggataaccaactggcttacgtggttattgggctgctctttatgatccttaccgtggccgccaatgagatgggactgctggaaacaaccaagaaagacctcggcattgggcacgtcgctgtggagaaccaccatcacgccgcgatgctggatgtcgaccttcatcccgcctctgcttggacactgtacgccgtggctacgaccatcattacacctatgatgagacacaccatcgaaaacacaaccgccaatatctccctcacggcgattgccaaccaggctgccatcctgatgggactggataagggctggcccattagcaaaatggacatcggcgttcctctccttgctctggggtgctattctcaggtgaatcccctgaccctcacagccgctgtcctgatgcttgtggcccattacgcgattatcggaccgggcctgcaagccaaggctacccgggaggcccagaaacgcacagctgccgggatcatgaagaaccctaccgttgatggaattgtggccatcgacctcgatcccgtcgtgtatgacgcgaagttcgaaaaacagctgggccagattatgctgctcatcctttgtacgagccaaattctgctgatgagaacaacctgggctctctgcgagtccatcacactggccaccgggccccttaccacactgtgggagggatctcctggcaagttttggaatacgaccatcgctgtgagcatggccaacattttccggggctcctacctcgccggggctggactggccttcagcctgatgaaatccctcggcgggggacgcagaggcacaggggcgcagggagaaacccttggcgagaagtggaaacggcagctgaatcagctgtctaagccggaatttaacacatataagagaagcggcatcatggaggttgaccgctccgaagccaaagaggggctcaagcggggagagaccacgaaacacgctgtctctagaggcacagccaagctgcgctggttcgtggaacggaatcttgtgaaacccgaggggaaggtcattgatctgggatgtggcagagggggatggagctactattgcgctggcctcaagaaagttaccgaagtgaagggctacaccaaagggggacctggccacgaggaacccatccctatggccacatacgggtggaacctggtgaagctgcattccggaaaagacgtctttttcattccccctgagaagtgtgataccctcctttgcgacatcggcgagtctagcccgaatcccacaattgaagaggggcgcacgctgcgggtgctgaaaatggttgaaccttggctcagaggaaaccaattttgtatcaagatcctgaatccctatatgccttccgtggtcgagacccttgagcagatgcagcgcaagcacggcggcatgctggtgcggaaccccctcagcagaaattctacacatgaaatgtactgggtttcctgcgggaccggaaacattgtgagcgcggtcaatatgacatctcgcatgctgctgaaccggttcaccatggcccacagaaaaccgacgtatgagcgcgatgtggacctcggcgctgggaccagacacgtggccgtcgaacctgaggttgctaacctggatatcattggacagcggatcgaaaatattaagcatgagcacaaatccacatggcattacgacgaggataacccctataagacctgggcctaccacggcagctatgaagtgaaaccctctgggtccgctagctccatggtgaatggagtcgtgaagcttctgacaaagccttgggacgttatccccatggtgacccaaatcgccatgacagataccacgccttttggccagcagcgcgtcttcaaagagaaggtggacacaagaaccccgaaagcgaagcggggcaccgcccaaattatggaagttacagctaaatggctctgggggtttctgagcagaaacaagaagccccggatctgtacgcgcgaggaattcaccagaaaagtgcggtctaatgccgctattggagccgtctttgtggacgagaaccagtggaatagcgccaaggaggcggttgaagatgagcgcttctgggaccttgtgcatagagaacgggagctgcacaaacagggcaagtgcgctacatgcgtctacaacatgatggggaaacgcgaaaagaagctcggagagtttggcaaagccaaggggtccagagccatctggtacatgtggctgggcgctcggttcctggagttcgaagccctcggatttatgaatgaggatcactggttctctcgcgaaaacagcctgtccggcgtggagggggagggacttcataaactgggctatattctcagagacatctctaagatccctgggggaaatatgtacgctgatgacaccgccggctgggatacacggattaccgaagacgatctgcagaacgaggcgaaaatcacagacattatggaacccgagcacgcccttctggctaagagcatctttaaactcacctatcaaaataaggtcgtgcgcgttcagagacctgccaagaacgggacggtgatggatgtcatttcccggcgcgaccagagaggctctggacaggtgggcacctacgggctgaatacattcaccaacatggaagctcaactgatccggcagatggagagcgagggaatcttttcccccagcgaactcgagacaccgaacctggccggcagagtgcttgattggctggaaaaacatggggttgagcgcctcaagcggatggcgatttctggagacgactgtgtggtcaaacctatcgatgacagattcgccaccgctctgacggcccttaatgatatgggcaaggtgcgcaaagacattccccagtgggaaccttccaaggggtggaacgattggcagcaagttcccttttgcagccaccacttccatcagctgatcatgaaggacggccgggagattgtggtcccttgtagaaatcaggatgagctcgtgggacgcgctcgggtctctcagggcgccgggtggtccctgagagaaacagcttgcctgggaaaaagctatgcccaaatgtggcagctcatgtactttcaccgccgggacctgagacttgcggccaacgctatctgttccgccgtgcccgttgattgggtgccgacctctcgcacaacctggagcattcatgcccaccatcagtggatgacgaccgaggacatgctgtccgtctggaatcgggtgtggatcgaagagaacccttggatggaagataagacacacgttagctcttggggcgacgtgccctatctcgggaaaagagaggaccaatggtgcggatccctgatcggccttaccgctcgggccacatgggcgaccaatattcaggtcgctatcaaccaggtgagacgcctgctcgggaatgagaactacctggattacatgacaagcatgaagcggttcaaaaatgaatctgaccccgagggcgccctgtggtga

SEQ ID NO: 19120 - RNA, 9879 nt, synthetic construct
  misc_feature 1..9879: note = derived and/or modified CDS sequence (opt5) from DENV-1__FJ898411__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccgccctgctcaaaaacgatgttcctctggctggacccctcatcgccggcgggatgctgattgcttgttacgtgatcagcggatctagcgccgacctttccctggagaaggccgctgaggtctcttgggaagaggaagcggagcatagcggcgcctcccacaatattctggtggaagttcaggatgacgggacaatgaaaatcaaggatgaggagcgggacgatacgctcaccatcctgcttaaggctacactgctcgccgtgtctggagtctatcctctgagcattcccgccaccctcttcgtgtggtacttttggcagaaaaagaaacaacgctccggcgtcctgtgggacacaccttctcccccggaagtggagagagctgttcttgatgacggcatctatcggattatgcagcgcgggctgctgggaagaagccaggtgggcgtcggggtgttccaggaaaacgtttttcataccatgtggcacgtgacgcggggagccgtcctcatgtaccaaggcaagcgcctggagccttcctgggcgagcgtgaaaaaggaccttatctcttacgggggaggctggagactgcagggctcctggaataccggggaggaagtgcaggttattgctgtcgagcccggaaagaaccctaaaaatgtgcagacagcccccggcaccttcaagacaagcgaaggggaggtgggagccatcgctctcgattttaaaccgggcacctctgggtcccctattgtcaaccgggaaggaaagatcgtgggcctgtatggcaatggggttgtgacaacgagcggaacctacgtctccgccatcgcgcaagctaaagcctctcaggagggccccctccctgagattgaagacgaggtgttcagaaagcgcaacctgacaatcatggatcttcaccccgggagcggaaagacccggagatatctgcccgccattgttcgcgaagctatcaaacggaagctgagaaccctcattctggcccctacacgcgtggtcgcttccgagatggccgaagcgcttaaaggcatgccgatccggtaccagacgaccgccgtgaagtccgagcatacagggaaagagatcgttgacctgatgtgccacgctacctttacaatgagactcctgtctcccgtgcgcgtccctaattataacatgattatcatggatgaagcccatttcaccgacccctccagcattgctgcccggggctacatctctacgagagtgggaatgggcgaggccgctgcgatttttatgacagccacccctcccgggagcgtggaggctttccctcaatccaatgccgtcatccaggatgaagaacgggacatcccggagcgctcttggaacagcggatatgagtggattaccgattttcccggcaagacagtttggttcgtgccttccatcaagtctgggaatgacattgccaactgtctgcgcaagaatggaaagcgggtgatccagctcagccgcaaaaccttcgatacagaataccagaagaccaaaaacaacgactgggactacgtcgtgacgacagatatttccgagatgggcgctaattttagagccgaccgggttatcgatcccagacgctgccttaagcctgtgattctgaaggacgggcccgaacgggtcatcctggcgggcccgatgcctgtgaccgttgctagcgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatctgccgctattgatggggagtatcggctcagaggagaggcccgcaagacgtttgtggaactgatgagacggggcgacctgcctgtctggctctcctacaaagtggctagcgaggggttccagtattccgatcgcagatggtgctttgacggcgaacggaacaatcaagtccttgaggaaaacatggatgtggagatctggaccaaggagggagaacgcaaaaagctgagaccgcggtggctggacgccagaacatactctgaccccctcgctctgcgcgagttcaaggaatttgccgcgggccggagaagcgtttccggggatcttatcctggagattggaaaactccctcagcacctgacccagcgcgcccagaatgctctggacaacctcgtgatgcttcataattctgaacaaggcgggcgggcctatagacacgctatggaggagctgcccgatacaatcgaaaccctgatgctcctggcccttattgccgtgctgacaggaggcgtcaccctcttctttctgagcggccgggggctgggaaagacgtccatcggcctcctttgtgttatggctagctctgtgctgctgtggatggcgtccgtggagcctcattggattgccgctagcatcatcctcgagttctttctgatggtccttctgattcccgagccggaccgccagagaacacctcaggataaccagctcgcctacgtggttatcgggctgctgttcatgattctcaccgtggccgctaatgagatgggacttctggaaaccaccaagaaggacctgggcatcgggcacgtcgccgtggagaaccaccatcacgcggccatgctcgatgtcgacctgcatcccgcttctgcctggaccctttacgctgtggccacaacgattatcacccctatgatgcggcacacaattgaaaacaccacagcgaatatctccctgaccgccatcgctaaccaagccgctattctcatgggactggataaaggctggcccatcagcaagatggacattggcgttcctctgctcgcccttgggtgctattctcaggtgaatcccctgacgctgaccgctgccgtcctcatgctggtggcgcattacgccatcattggaccgggccttcaggctaaggccacacgcgaggctcagaagagaaccgccgccgggatcatgaagaaccctacagttgatggaatcgtggcgattgacctggatcccgtcgtgtatgacgctaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggttgaccggtctgaagctaaggaggggctgaaaagaggagagacaaccaagcacgccgtcagccgcggcacggctaagctccggtggtttgtggaaagaaatctggtgaaaccggaggggaaggtcatcgatcttggatgtggccgcgggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggcggacacttagagtgctgaaaatggttgaaccctggctgcgcggaaaccagttctgtattaagatcctcaatccttatatgcccagcgtggtcgagacgctggagcaaatgcagcggaaacacggcggcatgcttgtgagaaaccctctgtctcgcaattccacccatgaaatgtactgggttagctgcgggacaggaaacatcgtgtctgccgtcaatatgacctcccggatgctcctgaacagatttacaatggctcaccgcaagcccacctatgagcgggatgtggacctgggcgccgggacgagacacgtggctgtcgaaccggaggttgccaacctcgatattatcggacagcgcattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccaacagagagtctttaaggagaaagtggacacgcggacacctaaggccaagcgcggcaccgctcagatcatggaagttaccgccaaatggctgtgggggttcctctctagaaacaagaaaccgcggatttgtacaagagaggaatttacgcggaaggtgcgcagcaatgctgccatcggagccgtcttcgtggacgagaaccaatggaactccgcgaaagaggctgttgaagatgagagattttgggacctggtgcatcgggaacgcgagcttcacaagcagggcaagtgcgccacatgcgtctacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtggagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtcgtgagagttcaacggcccgctaaaaacgggaccgtgatggatgtcatctctcgcagagaccagcggggcagcggacaggtgggcacgtacgggctcaatacctttacaaacatggaagcccagctgattcgccaaatggagtccgagggaatcttcagcccttctgaactggagacccccaacctcgcgggcagagtgctggattggcttgaaaagcatggggttgagcggctgaaaagaatggccatctccggagacgactgtgtggtcaagccgattgatgaccgctttgctacagccctcaccgctctgaatgatatgggcaaggtgcggaaagacatccctcagtgggaacccagcaaggggtggaacgattggcagcaggttcctttctgctctcaccactttcatcaacttattatgaaagacggcagagagatcgtggtcccctgtcgcaatcaggatgagctggtgggacgggccagagtctcccagggcgctgggtggagcctccgcgaaacggcctgcctgggaaagtcctatgcgcagatgtggcaactgatgtacttccaccggagagacctccgcctggccgctaacgccatttgttctgccgtgcctgttgattgggtgcccacaagccggaccacatggtccatccatgctcaccatcagtggatgaccacggaggacatgcttagcgtctggaatagagtgtggattgaagagaacccgtggatggaagataaaacccacatctcttcctggggcgacgttccttatctggggaagcgcgaggaccagtggtgcggaagcctcatcggcctgacagcccgggcgacctgggctacaaatattcaagtggccatcaaccaggtcagacggcttattgggaatgagaactacctggattacatgacctctatgaagagatttaaaaatgaaagcgaccccgagggcgccctctggtga

SEQ ID NO: 19121 - RNA, 9879 nt, synthetic construct
  misc_feature 1..9879: note = derived and/or modified CDS sequence (opt5) from DENV-1__FJ898412__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaagatgctcatgacagggaccctggctgttttccttctgctcattatgggacagctgacatggaacgatctgatccggctttgcattatggtgggcgccaatgcctctgacagaatgggcatggggaccacctatctggctctcatggccacatttaaaatgcgccctatgttcgcggtcggactgctctttagacggctgacgagccgcgaggtgcttctgctcaccatcggcctgtccctggtggcttctgtcgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggttctctccattgtgagcctgttccccctctgtctgtctaccacctcccagaagacaacctggcttcctgtgctgctggggagcctcggatgcaaaccgctgacaatgtttcttatcgctgagaataagatttggggcagaaaatcttggcccctgaacgaaggcatcatggccgtcggggtggtttccatcctcctgagctccctcctgaagaacgatgtgcctcttgcgggacccctgattgccggcgggatgctgatcgcttgttatgtcattagcggatctagcgccgacctctccctggagaaagctgccgaggtgtcttgggaagaggaagccgagcacagcggcgcttcccataatatccttgttgaagtgcaggatgacgggacgatgaagattaaagatgaggagcgggacgataccctgacaatcctcctgaaggcgaccctcctggccgtctctggagtgtaccctcttagcatccccgctacactgttcgtctggtatttttggcaaaagaaaaagcagcgctccggcgtgctgtgggacaccccttctcccccggaagttgagagagccgtgctcgatgacggcatttaccggatcatgcagcgcgggctgcttggaagaagccaggtcggcgtgggggttttccaagaaaacgtgttccacacgatgtggcacgtcacccggggagccgtgctgatgtatcagggcaaacgcctcgagccttcctgggctagcgtgaagaaagacctgatttcttacgggggaggctggagactccagggctcctggaatacaggggaggaagttcaggtcatcgccgtggagcccggaaagaaccctaagaatgtgcaaaccgcgcccggcacatttaaaaccccggaaggggaggtcggagctattgccctggatttcaagcctggcacaagcgggtctcccatcgtgaaccgggaaggaaaaattgttggcctttacggcaatggggtggtcacgacctccggaacatatgtgagcgccatcgctcaggccaaggcgtcccaggagggccctctgcccgagatcgaagacgaggtttttagaaaacgcaacctgaccattatggatctccatcccgggtctggaaagacccggagatacctgcctgctatcgtgcgcgaagccattaagcggaaacttagaacactgatcctcgccccgacgcgcgtcgtggctagcgagatggccgaagctctgaagggcatgcccattcggtatcaaaccacagccgttaaatccgagcacaccgggaaggagatcgtggacctgatgtgccatgcgacattcaccatgagactccttagccctgtccgcgtgcccaattacaacatgatcattatggatgaagcccactttacggacccttcttccatcgctgcccggggctatattagcacaagagtgggaatgggcgaggctgccgccatcttcatgaccgctacaccccctgggtctgtcgaagcgtttccgcagagcaatgccgttattcaggatgaggaacgggacatccccgagcgctcctggaactctggatacgagtggatcacagatttccctggcaaaaccgtgtggtttgtgcccagcattaagtccgggaatgacatcgctaactgtctgagaaagaatggaaaacgggtcattcagctgtctcgcaagacattcgataccgaatatcagaagacgaagaacaacgactgggactacgtggttacaaccgatatcagcgagatgggcgccaattttagagccgaccgggtgattgatcctagacgctgcctcaaacccgtcatcctgaaggacgggccggaacgggtgattcttgctggccctatgcccgttacagtggcctccgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagagcgccgcgatcgatggggagtaccggctcagaggagaggcccgcaaaaccttcgtcgaacttatgagacggggcgacctgccggtgtggctgtcttataaggtcgcttccgaggggtttcaatacagcgatcgcagatggtgcttcgacggcgaacggaacaatcaggtgctcgaggaaaacatggatgttgagatttggacaaaagagggagaacgcaagaaactgagaccccggtggcttgacgccagaacctattccgaccctctggctctccgcgagtttaaggagttcgccgctggccggagatctgtgagcggggatctgatcctggagatcggaaagctcccccagcatcttacacagcgcgcccaaaatgcgctggacaacctggtgatgctccacaattccgaacagggcgggcgggcctacagacatgctatggaggagctgcctgataccattgaaacacttatgctgctcgccctgatcgctgtcctgaccggaggcgttacgctctttttcctttctggccgggggctgggaaaaacaagcattggcctgctctgtgtgatggcctccagcgtgctgctttggatggcctctgtcgagccccactggatcgctgcgtccattatcctggaatttttcctcatggtgctgctgatcccggagcctgaccgccagagaacaccccaggataaccaactcgcctatgttgtgattgggcttctgtttatgatcctgaccgtcgctgccaatgagatgggactcctggaaacaaccaagaaagaccttggcattgggcacgtggccgtcgagaaccatcaccatgtgacaatgctggatgttgacctccaccctgctagcgcctggacgctgtacgcggtggccaccacaatcattacccccatgatgcggcatacaatcgaaaacaccacggctaatatttctctgaccgccatcgctaaccaggccgcgatcctcatgggacttgataagggctggcctatttccaaaatggacatcggcgtccccctgctggccctcgggtgctacagccaggtgaatccgctgacacttaccgctgccgttctgatgctcgtggctcactatgccattatcggacctggcctgcaagctaaggccacacgcgaggcgcagaagagaaccgccgctgggattatgaaaaaccccacggtcgatggaatcgtggccatcgacctggatcccgtggtttacgacgctaagttcgaaaaacagctcggccagattatgcttctgatcctgtgtacatctcaaattctcctgatgcggaccacatgggccctttgcgagagcatcaccctggccaccgggcctctcacaacgctgtgggagggatccccgggcaagttttggaataccacaattgcggtctctatggctaacatcttccgcggcagctatctggccggggctggactcgccttttcccttatgaaaagcctgggcgggggaagacggggcaccggggcccagggagaaacactgggcgagaagtggaagcgccagctcaatcagctgtccaaatctgagttcaacatctacaagagaagcggcattatggaggtggaccggtccgaagctaaagaggggcttaagagaggagagaccacgcgccacgccgtgtctcggggcacagcgaaactgagatggttcgtcgaacgcaatctcgttaagcccgaggggaaggtgatcgatctgggatgtggcagagggggatggagctattactgcgccggcctgaaaaaggtgaccgaagtcaaaggctataccaaagggggacctggccatgaggaacccattcctatggctacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggtcgaaccttggcttcggggaaaccaattttgtatcaagattctgaatccctacatgccttccgtggttgagacactcgagcagatgcagagaaaacatggcggcatgctggtgcgcaaccccctgagcagaaattctacccacgaaatgtattgggtctcctgcgggacaggaaacatcgtgagcgccgtgaatatgacctctagaatgctcctgaaccgcttcacgatggctcaccggaagccgacctacgagagagatgtcgaccttggcgccgggacacgccatgttgcggtggaacctgaggtggccaacctggatatcattggacagagaatcgaaaatattaaacacgagcataagtccacctggcactatgacgaggataacccctacaaaacatgggcttatcatggcagctacgaagtcaagccctctgggtccgccagctccatggtgaatggagttgtgaagctcctgaccaaaccttgggacgtcatccccatggtgacacaaattgctatgaccgatacgacaccttttggccagcagcgggttttcaaggagaaagtggacacccgcaccccgaaggccaaaagaggcacagctcaaatcatggaagtcacggcccggtggctttgggggtttctgagcagaaacaagaagccccggatctgtacccgcgaggagttcacaagaaaagtgcggtctaatgcggccattggagctgtttttgtggacgagaaccagtggaatagcgccaaggaggctgtcgaagatgagcgcttctgggacctcgtgcagaaagaaagagagctgcacaagcagggcaaatgcgcgacctgcgtctataacatgatggggaagcgggaaaagaaactgggagagtttggcaaggccaaagggtcccgcgcgatctggtacatgtggctcggcgctagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgccgatgacacagctggctgggataccagaatcacagaagacgatctgcaaaacgaggccaagatcaccgacattatggaacccgagcacgctctcctggccacgagcatctttaaactgacctaccagaataaggttgtgcgggtccagcgccctgcgaagaacgggacagtgatggatgtgatttccagacgggaccagcgcggctctggacaagttggcacctatgggctcaatacattcaccaacatggaagcccagctgatcagacagatggagagcgagggaatttttcttccctccgaactggagacgccgaacctcgctgaacgggtgctggattggcttgagaaatacggcgtcgaaagactgaagcgcatggccatcagcggggacgactgtgtggttaaacctatcgatgaccggttcgctacagccctcaccgcgctgaatgatatgggaaaggtgagaaaagacattccccagtgggagccttctaagggctggaacgattggcaacaggtccccttttgctcccatcacttccaccagctgatcatgaaggacgggcgcgagattgtggtcccttgtcggaatcaggatgaactcgtgggcagagcccgcgttagccaaggagctggctggtctctgcgggagacagcctgccttgggaaatcctatgctcagatgtggcagctgatgtactttcatagacgcgacctccggctggccgctaacgccatctgtagcgcggtgcccgtcgattgggtgccgacctccagaacgacctggtctattcacgcccatcaccaatggatgacaaccgaagacatgcttagcgtttggaatcgcgtgtggatcgaggaaaacccttggatggaggataagacacatgtctccagctggggagacgtgccctatctgggcaaacgggaggaccagtggtgcgggtctctcattggactgaccgctagagccacatgggcctccaatatccaggtggctatcaaccaggttcggagactgattggcaatgaaaactacctcgattacatgaccagcatgaagcgcttcaaaaatgagggggaccccgaaggcgccctgtggtga

SEQ ID NO: 19122 - RNA, 9879 nt, synthetic construct
  misc_feature 1..9879: note = derived and/or modified CDS sequence (opt5) from DENV-1__GQ199852__SS-prME
  source 1..9879: mol_type = other RNA
agcgtgaccatgctgctcatgctgatgcccacagcccttgctttccacctgacgaccagaggcggggagcctcatatgatcgtgacaaagcaggaacggggaaaatccctcctgtttaagacctctgccggcgttaatatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcacaaccgggacactggctgtgttccttctgctcatcatgggacagctgacctggaacgatctgattcggctttgcatcatggtcggcgccaatgcctctgacagaatgggcatggggaccacatatctggctctcatggccacgtttaaaatgcgccctatgttcgcggtgggactgctctttagacggctgaccagccgcgaggtgcttctgctcacaattggcctgtccctggtcgcttctgttgaacttcccaacagcctggaggaactcggggatggactggccatgggcatcatgatcctcaagctgcttaccgacttccaatcccaccagctgtgggccacactcctgagcctgacctttattaaaacgacacttcccctgcattgtgcttggaagaccatggccatggtgctctctatcgcttccctgttccctctctgcctgagcaccacatctcagaagaccacatggcttccggtgctgctggggtccctcggatgtaaacccctgacgatgtttcttattaccgagacaaagatctggggcagaaaaagctggcctctgaatgaaggcattatggccgtcggggtggtttctatcctcctgtccagcctcctgaagaacgatgtgccccttgcgggacctctgatcgccggcgggatgctgattgcttgctacgtcatctccggaagctctgccgacctcagcctggagaaagctgccgaggtgtcctgggaagaggaagccgagcactctggcgctagccataacattcttgttgtggtccaggatgacgggaccatgaagatcaaagatgaggaacgggacgatacactgaccattctcctgaaggcgacgctcctggccgtgtccggagtctatcccctttctatccctgctaccctgttcgtgtggtacttttggcaaaagaaaaagcagcgcagcggcgttctgtgggacacaccctccccgcctgaggtggaaagagccgtcctcgatgacggcatctatcggattatgcagcgcgggctgcttggaagatctcaggtgggcgttggggtgttccaagagaatgtcttccacaccatgtggcacgtgacacggggagccgtgctgatgtaccagggcaaacgcctcgaacccagctgggcttccgttaagaaagacctgatcagctatgggggaggctggagactccagggctcttggaacaccggggaggaggtccaggtgattgccgtggaacctggaaagaatcccaagaacgtccaaacagcgccgggcacgtttaaaacccctgagggggaagtgggagctatcgccctggatttcaagcccggcacatccgggagccctattgttaatcgggagggaaaaatcgtgggcctttacggcaacggggtcgtgaccacctctggaacatacgtttccgccattgctcaggccaaggcgagccaggaaggccccctgcccgagatcgaggacgaagtgtttagaaaacgcaatctgacgatcatggatctccatcctgggtccggaaagacccggagatatctgccggctattgtccgcgaggccatcaagcggaaacttagaacactgattctcgcccccacccgcgtggttgcttctgaaatggccgaggctctgaagggcatgcctatccggtaccaaacaaccgccgtgaaaagcgaacacacggggaaggagattgtcgacctgatgtgtcatgcgacattcaccatgagactcctttcccccgtgcgcgtgcctaactataatatgatcatcatggatgaggcccactttaccgaccccagctctattgctgcccggggctacatctccacaagagtcggaatgggcgaagctgccgccattttcatgaccgctacacctccggggagcgttgaggcgtttccccagtctaacgccgtgatccaggatgaggaacgggacattcctgaacgcagctggaactccggatatgagtggatcaccgatttccccggcaaaacggtgtggtttgtcccttctatcaagagcgggaacgacattgctaattgcctgagaaagaacggaaaacgggtgatccagctgtcccgcaagacattcgataccgagtaccagaagaccaagaataacgactgggactatgttgtgaccacggatatttctgaaatgggcgccaactttagagccgaccgggtcatcgatcccagacgctgcctcaaaccggtgattctgaaggacgggcctgagcgggttatccttgctggccccatgcccgtgaccgtcgccagcgcggctcagagacgcggacggattggcagaaatcataacaaggaaggggatcagtacatctacatgggacagcctctgaataacgacgaggatcacgcccactggacagaggccaaaatgctcctggacaatatcaacacccccgaaggcattatccctgctctgttcgagccggaacgcgagaagtccgccgcgattgatggggaatatcggctcagaggagaggcccgcaaaacattcgtggagcttatgagacggggcgacctgcccgtctggctgagctacaaggtggcttctgaagggtttcaatattccgatcgcagatggtgtttcgacggcgagcggaataaccaggttctcgaagagaatatggatgtggaaatctggaccaaagagggagagcgcaagaaactgagacctcggtggcttgacgccagaacatacagcgaccccctggctctccgcgaatttaaggagttcgccgctggccggagatccgtgtctggggatctgattctggaaatcggaaagctccctcagcatcttacccagcgcgcccaaaacgcgctggacaatctggtcatgctccacaacagcgagcagggcgggcgggcctatagacatgctatggaggaactgcccgatacgatcgagacacttatgctgctcgccctgattgctgttctgaccggaggcgtgaccctctttttcctttccggccgggggctgggaaaaacatctatcggcctgctctgcgtgatggccagctccgtcctgctttggatggccagcgtggaaccgcactggattgctgcgtctatcattctggagtttttcctcatggttctgctgatccctgaacccgaccgccagagaacccctcaggataatcaactcgcctacgtggtcatcgggcttctgtttatgattctgacagtggctgccaacgagatgggactcctggagacgaccaagaaagaccttggcatcgggcacgtcgccgtggaaaatcatcaccatgctacaatgctggatgttgacctccaccccgcctccgcgtggaccctgtatgccgtggctacaaccattatcacgcctatgatgcggcataccattgagaacacaaccgccaacatcagcctgacagctattgccaatcaggcggccatcctcatgggacttgataagggctggcccatctctaaaatggacattggcgtcccgctgctggctctcgggtgttactcccaggtgaaccctctgacccttacggccgctgttctgatgctcgtggcccactacgctatcattggacccggcctgcaagccaaggcgacacgcgaagcccagaagagaaccgctgccgggatcatgaaaaatcccacagtcgatggaattgtggctatcgacctggatcctgtggtttatgacgccaagttcgagaaacagctcggccagatcatgcttctgattctgtgcaccagccaaatcctcctgatgcggaccacatgggccctttgtgaatctattacgctggcgaccgggccgctcacaaccctgtgggagggaagccccggcaagttttggaacacaaccatcgctgtctccatggccaatattttccgcggctcttacctggctggggccggactcgcctttagccttatgaaatccctgggcgggggaagacggggcacgggggctcagggagagacactgggcgaaaagtggaagcgccagctcaaccagctgagcaaatccgagttcaatatctataagagatctggcatcatggaagtggaccggagcgaggccaaagaagggcttaagagaggagagaccacccgccacgcggtgtcccggggcacagccaaactgagatggttcgtcgagcgcaacctcgttaagcctgaagggaaggtgattgatctgggatgcggcagagggggatggtcttactattgtgctggcctgaaaaaggtgaccgaggtcaaaggctacacaaaagggggacccggccatgaggagcctatccccatggccacgtatgggtggaatctcgtgaaacttcacagcggaaaggacgtctttttcacccctccggaaaaatgcgatacactgctgtgtgacattggcgagtcctctcccaaccctaccatcgaggaagggagaacactccgcgtgctgaagatggtcgagccctggcttcggggaaatcaattttgcattaagatcctgaacccttacatgcccagcgtggttgaaaccctcgagcagatgcagagaaaacatggcggcatgctggtgcgcaatccgctgtcccggaacagcacgcacgagatgtactgggtctcttgtgggaccggaaatattgtgtccgctgtgaacatgacaagcagaatgctcctgaatcgcttcaccatggcccaccggaagcctacatatgaaagagatgtcgaccttggcgcggggacccgccatgttgccgtggagcccgaagtggctaacctggatatcatcggacagagaattgagaacatcaaacacgaacataagtctacatggcactacgacgaggataatccctataaaacctgggcctaccatggctcctatgaggtcaagcctagcgggtctgcttccagcatggtgaacggagttgtgaagctcctgacgaaaccctgggacgtcattcctatggtgacacaaatcgccatgaccgataccacaccgtttggccagcagcgggttttcaaggaaaaagtggacacgcgcacccccaaggctaaaagaggcacagcccaaattatggaggtcaccgcgcggtggctttgggggtttctgtccagaaataagaagcctcggatctgcacacgcgaagagttcaccagaaaagtgcggagcaacgccgctatcggagccgtttttgtggacgaaaatcagtggaactctgctaaggaggccgtcgaggatgaacgcttctgggacctcgtgcagaaagagagagaactgcacaagcagggcaaatgcgccacatgtgtctacaatatgatggggaagcgggagaagaaactgggagaatttggcaaggcgaaagggagccgcgctatttggtatatgtggctcggcgccagattcctggagtttgaggcccttggattcatgaacgaagatcactggttctcccgggaaaattctctgagcggcgtggaaggggagggactccataagctgggctacatccttcgcgacatttccaaaatccccgggggaaacatgtacgctgatgacaccgccggctgggatacgagaattaccgaggacgatctgcaaaatgaagctaagatcacagacatcatggagcctgaacacgccctcctggcgacctctatttttaaactgacatatcagaacaaggttgtgcgggtccagcgccccgccaagaatgggaccgtgatggatgtgatcagcagacgggaccagcgcggctccggacaagttggcacgtacgggctcaacacattcaccaatatggaggctcagctgattagacagatggaatctgagggaatctttcttccgagcgagctggaaacacctaacctcgccgagcgggtgctggattggcttgaaaaatatggcgtcgagagactgaagcgcatggctatttccggggacgactgcgtggttaaacccatcgatgaccggttcgccaccgcgctcacggccctgaacgatatgggaaaggtgagaaaagacatccctcagtgggaacccagcaagggctggaatgattggcaacaggtccctttttgttctcatcacttccaccagctgattatgaaggacgggcgcgagatcgtggtcccctgccggaaccaggatgagctcgtgggcagagctcgcgtttcccaaggagccggctggagcctgcgggaaaccgcttgtcttgggaaatcttacgcccagatgtggcagctgatgtattttcatagacgcgacctccggctggctgccaatgcgatttgctccgccgtgccggtcgattgggtgcctacaagcagaaccacatggtccatccacgctcatcaccaatggatgaccacagaggacatgctttctgtttggaaccgcgtgtggattgaagagaatccctggatggaagataagacccatgtcagctcctggggagacgtgccctacctgggcaaacgggaggaccagtggtgtgggagcctcatcggactgacggccagagccacatgggcttctaacattcaggtggccatcaatcaggttcggagactgatcggcaacgagaattatctcgattacatgacctccatgaagcgcttcaaaaacgaaggggaccctgagggcgcgctgtggtga

SEQ ID NO: 19123 - RNA, 9879 nt, synthetic construct
  misc_feature 1..9879: note = derived and/or modified CDS sequence (opt5) from DENV-1__FJ898415__SS-prME
  source 1..9879: mol_type = other RNA
agcgtgaccatgctgctcatgctgatgcccaccgcccttgctttccacctgacgaccagaggcggggaacctcatatgatcgtcacaaagcaggaacggggaaagtcccttctgtttaagacctctgccggcgttaacatgtgcacacttattgcgatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaagcagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataagcccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttcctgacccaagatgaaaagggggttacacagaacggacggcttatcacggctaatcccattgtgaccgacaaagagaagcctgtcaacatcgaagccgagccgccctttggcgagtcctatattgtgatcggggccggagaaaaagctctcaagctgagctggttcaagaaaggctctaatattgggaagatgtttgaggccacagctagaggcgcccgccggatggcgatcctgggagataccgcctgggacttcggcagcatcgggggagtgtttacatccgttggcaaactcgtccatcagattttcgggaccgcttacggagtgctgttttctggcgtgagctggacgatgaagatcgggattggcgtccttctgacctggctcggactgaactccagaagcacatctctgtccatgacctgtatcgccgtgggccttgttacactctacctgggggtgatggtccaggctgatagcggatgcgtgattaattggaaaggccgcgaactgaagtgtgggtctggaatcttcgttaccaacgaggtgcacacatggaccgaacaatataagtttcaggccgactcccctaaacggctcagcgcggccattggcaaggcttgggaggagggggtctgcggcatcagatccgccacgcgcctggaaaacatcatgtggaaacagatttctaatgagcttaaccatatcctgctcgaaaatgacatgaagttcacagtggttgtgggagatgtcgtgggcattctggctcaggggaaaaagatgatccggccgcaacccatggagcacaaatacagctggaagtcctggggaaaggccaaaattatcggcgccgacgtgcagaacaccacctttatcattgatgggcctaatacacccgaatgtcctgacgatcagagagcttggaacatctgggaggtcgaggactatggattcggcatttttaccacgaatatctggctgaaacttcgcgattcttacacacaggtttgcgaccaccggctcatgagcgcggccattaaagattccaaggctgtgcatgccgacatgggctattggatcgaaagcgagaaaaacgaaacctggaagctggccagagcttctttcatcgaggtgaagacatgtatttggcccaaatcccacaccctgtggagcaatggggtcctcgaatctgagatgatcattccgaagatctacggaggccctatttcccaacataactatcgccccgggtacttcacacagaccgccggaccttggcacctgggcaaacttgagctggattttgacctctgcgaagggacgaccgtggttgtggatgagcactgcggaaatcggggccccagcctgagaacaaccacagtcaccggcaagacgatccatgaatggtgttgccggtcttgtacactgcctccccttcgcttcaaaggggaggacggatgctggtacggcatggagatcagaccggtgaaggaaaaggaggaaaacctcgttaaaagcatggtgtccgcggggagcggagaggtcgactctttttccctgggcctgctctgtattagcatcatgattgaagaggtgatgcggtccagatggtctcgcaagatgctgatgaccgggacacttgctgttttcctgctcctgatcatgggacagctgacctggaatgatcttattcggctgtgcatcatggtgggcgccaacgccagcgacagaatgggcatggggaccacatatctcgctctgatggccacgtttaaaatgcgccctatgttcgcggtcggactcctgtttagacggcttacctcccgcgaggtgctgctcctgacaattggcctgtctcttgtggctagcgtcgaactgcccaattccctcgaggaactgggggatggactcgccatgggcatcatgatcctgaaacttctgaccgacttccaatctcaccagctctgggccacactgctgagccttacctttattaaaacgacactgtccctccattacgcttggaagaccatggccatggttctgagcatcgtgtctctcttccccctgtgtctttccaccacaagccagaagaccacatggctgcctgtgctgctcgggtctctgggatgcaaaccgcttacgatgtttctgattgctgagaacaagatctggggcagaaaatcctggcccctcaacgaaggcattatggccgtcggggtggttagcatcctgctctcttccctgcttaagaatgatgtgcctctggcgggacccctgatcgccggcgggatgctcattgcttgttatgtcatcagcggatccagcgccgacctgtctcttgagaaagctgccgaggtgagctgggaagaggaagccgagcactccggcgcttctcataacattctggttgaagtgcaggatgacgggaccatgaagatcaaagatgaggagcgggacgatacactcaccattctgctcaaggcgacactgcttgccgtcagcggagtgtaccctctgtccatccccgctaccctgttcgtctggtatttttggcaaaagaaaaagcagcgctctggcgtgctctgggacacgcctagccctcccgaagttgagagagccgtgctggatgacggcatctaccggattatgcagcgcgggcttctgggaagatcccaggtcggcgtgggggttttccaagaaaatgtgttccacaccatgtggcacgtcacacggggagccgtgctcatgtatcagggcaaacgcctggagccctcttgggctagcgtgaagaaagacctcatctcctacgggggaggctggagactgcagggcagctggaacaccggggaggaagttcaggtcattgccgtggagcccggaaagaatcctaagaacgtgcaaacagcgcccggcacctttaaaacaccggaaggggaggtcggagctatcgcccttgatttcaagcctggcacgtctgggtcccccattgtgaatcgggaaggaaaaatcgttggcctgtacggcaacggggtggtcaccacaagcggaacctatgtgtctgccattgctcaggccaaggcgtcccaggagggccctctgcccgagatcgaagacgaggtttttagaaaacgcaatctcaccatcatggatctgcatcccgggagcggaaagacacggagataccttcctgctattgtgcgcgaagccatcaagcggaaactgagaacgctcattctggccccgacccgcgtcgtggcttccgagatggccgaagctctgaagggcatgcccatccggtatcaaacaaccgccgttaaatctgagcacacagggaaggagattgtggacctcatgtgccatgcgaccttcacgatgagacttctgagccctgtccgcgtgcccaactacaatatgatcatcatggatgaagcccactttacagacccttccagcattgctgcccggggctatatctctaccagagtgggaatgggcgaggctgccgccattttcatgaccgctacaccccctgggtccgtcgaagcgtttccgcagagcaacgccgttatccaggatgaggaacgggacattcccgagcgctcttggaatagcggatacgagtggatcaccgatttccctggcaaaacagtgtggtttgtgccctccatcaagtctgggaacgacattgctaattgtctgagaaagaacggaaaacgggtcatccagctcagccgcaagaccttcgatacggaatatcagaagaccaagaacaatgactgggactacgtggttaccacagatatttccgagatgggcgccaactttagagccgaccgggtgatcgatcctagacgctgcctgaaacccgtcattcttaaggacgggccggaacgggtgatcctggctggccctatgcccgttaccgtggcctctgcggctcagagacgcggacggattggcagaaatcataacaaggagggggatcagtacatctatatgggacagcccctcaataacgacgaggatcacgcccactggacggaagccaaaatgctgctggacaatatcaacacccctgagggcattatccccgctctcttcgaacctgagcgcgaaaagagcgccgcgattgatggggagtaccggcttagaggagaggcccgcaaaacattcgtcgaactgatgagacggggcgacctgccggtgtggctctcctataaggtcgctagcgaggggtttcaatactctgatcgcagatggtgcttcgacggcgaacggaataaccaggtgctggaggaaaatatggatgttgagatctggaccaaagagggagaacgcaagaaacttagaccccggtggctggacgccagaacatattccgaccctctcgctctgcgcgagtttaaggagttcgccgctggccggagaagcgtgtccggggatctgattctcgagatcggaaaacttccccagcatctgacccagcgcgcccaaaacgcgctggacaatctcgtgatgctgcacaactctgaacagggcgggcgggcctacagacatgctatggaggagcttcctgatacaatcgaaaccctgatgctcctggccctgattgctgtcctcacgggaggcgttacactctttttcctgagcggccgggggctgggaaaaacctccatcggcctcctgtgtgtgatggcctctagcgtgcttctgtggatggcctccgtcgagccccactggattgctgcgagcatcattctcgaatttttcctgatggtgctgctcatcccggagcctgaccgccagagaacaccccaggataatcaacttgcctatgttgtgatcgggctgctgtttatgattctcacagtcgctgccaacgagatgggactgcttgaaaccacaaagaaagacctgggcatcgggcacgtggccgtcgagaaccatcaccatgctacgatgctcgatgtggacctgcaccctgcctctgcgtggaccctgtacgccgttgctacaaccattatcacacccatgatgcggcataccattgaaaatacgaccgccaacatctccctcacagctattgccaatcaggcggccatccttatgggactggataagggctggcctatcagcaaaatggacattggcgtgcccctgctcgctctggggtgctactctcaggtcaacccgcttaccctgacagccgctgtgctcatgctggttgcccactatgctatcattggacctggcctgcaagccaaggcgacccgcgaggcccagaagagaacggctgccgggatcatgaaaaatcccacagtggatggaattgtcgctatcgacctcgatcccgtggtgtacgacgccaagttcgaaaaacagcttggccagatcatgctgctgattctctgtacctcccaaatcctgcttatgcggacaacctgggccctgtgcgagagcattaccctcgcgacagggcctctgacgaccctgtgggagggatctccgggcaagttttggaacacaaccatcgctgttagcatggccaatattttccgcggctcctatctcgctggggccggacttgccttttctctgatgaaaagcctgggcgggggaagacggggcacaggggctcagggagaaaccctcggcgagaagtggaagcgccagctgaaccagctttccaaaagcgagttcaatatctacaagagatccggcatcatggaggtcgaccggtctgaagccaaagaggggctgaagagaggagagacgacacgccacgcggtgagccggggcaccgccaaactcagatggttcgtggaacgcaacctggtcaagcccgaggggaaggttattgatctgggatgtggcagagggggatggtcctattactgcgctggcctcaaaaaggtgaccgaagtgaaaggctatacaaaagggggacctggccatgaggaacccatccctatggccacctacgggtggaatcttgtcaaactgcactctggaaaggacgtgtttttcacaccccctgagaaatgtgatacgctgctctgcgacattggcgagagctccccgaaccccaccatcgaagaggggagaacactgcgcgttcttaagatggtggaaccttggctgcggggaaatcaattttgtattaagatcctcaacccctacatgccttctgtcgtggagaccctggagcagatgcagagaaaacatggcggcatgctggttcgcaatcccctcagccggaactccacacacgaaatgtattgggtgagctgcgggaccggaaatattgtctctgctgtgaacatgacgtccagaatgctgcttaaccgcttcaccatggcccaccggaagccgacatacgagagagatgtggacctgggcgcggggacccgccatgtcgccgttgaacctgaggtggctaatctcgatatcatcggacagagaattgaaaacatcaaacacgagcataagagcacatggcactatgacgaggataatccctacaaaacctgggcctatcatggctcttacgaagtgaagccctccgggagcgcttcttccatggtcaacggagtggttaagctgcttacaaaaccttgggacgtgattcccatggtcacccaaatcgccatgacggatacaaccccttttggccagcagcgggtgttcaaggagaaagttgacacccgcacaccgaaggctaaaagaggcacggcccaaattatggaagtgaccgcgcggtggctgtgggggtttctcagcagaaataagaagccccggatctgtacacgcgaggagttcaccagaaaagtccggtccaacgccgctatcggagccgtgtttgttgacgagaatcagtggaacagcgctaaggaggccgtggaagatgagcgcttctgggacctggtccagaaagaaagagagctgcacaagcagggcaaatgcgccacatgcgtgtataatatgatggggaagcgggaaaagaaactcggagagtttggcaaggcgaaagggtctcgcgctatttggtacatgtggctgggcgccagattccttgagtttgaagccctgggattcatgaacgaggatcactggttcagccgggaaaattccctctctggcgtcgagggggagggactgcataaacttggctacatcctgcgcgacattagcaaaatccctgggggaaacatgtatgctgatgacaccgccggctgggatacaagaattaccgaagacgatctccaaaatgaggctaagatcacggacatcatggaacccgagcacgccctgctggcgacctccatttttaaactcacataccagaacaaggtggttcgggtgcagcgccctgccaagaatgggaccgtcatggatgtgatctctagacgggaccagcgcggcagcggacaagtgggcacatatgggctgaacaccttcacgaacatggaagctcagcttattagacagatggagtccgagggaatcttttctcccagcgaactggagattccgaatctcgccgaacgggttctggattggcttgagaaatacggcgtggaaagactgaagcgcatggctatctccggggacgactgtgtcgtgaaacctatcgatgaccggttcgccacagcgctcaccgccctgaacgatatgggaaaggttagaaaagacgtgccccagtgggagcctagcaagggctggaatgattggcaacaggtccccttttgctctcatcacttccaccagctgattatgaaggacgggcgcgagatcgtggtcccttgtcggaaccaggatgaactcgtgggcagagctcgcgtttcccaaggagccggctggagcctgcgggagacagcttgccttgggaaatcttatgcccagatgtggcagctgatgtactttcatagacgcgacctccggctggctgccaatgcgatttgttccgccgtgcccgtcgattgggtgccgaccagcagaacgacctggtccatccacgctcatcaccaatggatgacaaccgaagacatgctttctgtttggaaccgcgtgtggattgaggaaaatccttggatggaggataagacacatgtcagctcctggggagacgtgccctatctgggcaaacgggaggaccagtggtgcgggagcctcatcggactgaccgccagagccacatgggcttctaacattcaggtggccatcaatcaggttcggagactgatcggcaacgaaaattacctcgattacatgacctccatgaagcgcttcaaaaacgagggggaccccgaaggcgcgctgtggtga

SEQ ID NO: 19124 - RNA, 9879 nt, synthetic construct
  misc_feature 1..9879: note = derived and/or modified CDS sequence (opt5) from DENV-1__FJ898416__SS-prME
  source 1..9879: mol_type = other RNA
agcgtgaccatgctgctcatgctgatgcccaccgcccttgctttccacctgacgaccagaggcggggagcctcatatgatcgtgacaaagcaggaacggggaaaatccctcctgtttaagacctctgccggcgttaatatgtgcacccttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgctagcctgttccccctctgtctgtctaccacctcccagaagacaacctggcttcctgtgctgctggggagcctcggatgcaaaccgctgacaatgtttcttattacggagaccaagatctggggcagaaaatcttggcccctgaatgaaggcattatggccgtcggggtggtttccatcctcctgagctccctcctgaagaacgatgtgcctcttgcgggacccctgatcgccggcgggatgctgattgcttgttatgtcatcagcggatctagcgccgacctctccctggagaaagctgccgaggtgtcttgggaagaggaagccgagcacagcggcgcttcccataacattcttgttgtggtccaggatgacgggacaatgaagatcaaagatgaggaacgggacgataccctgacaattctcctgaaggcgaccctcctggccgtgtctggagtctaccctcttagcatccccgctacgctgttcgtgtggtatttttggcaaaagaaaaagcagcgctccggcgttctgtgggacaccccttctcccccggaggtggaaagagccgtcctcgatgacggcatctaccggattatgcagcgcgggctgcttggaagaagccaggtgggcgttggggtgttccaagagaatgtcttccacacaatgtggcacgtgacccggggagccgtgctgatgtatcagggcaaacgcctcgaaccttcctgggctagcgttaagaaagacctgatctcttacgggggaggctggagactccagggctcctggaacacaggggaggaggtccaggtgattgccgtggaacccggaaagaatcctaagaacgtccaaaccgcgcccggcacatttaaaacgccggagggggaagtgggagctatcgccctggatttcaagcctggcaccagcgggtctcccattgttaatcgggagggaaaaatcgtgggcctttacggcaacggggtcgtgacaacctccggaacctatgttagcgccattgctcaggccaagacatcccaggaaggccctctgcccgagatcgaggacgaagtgtttagaaaacgcaatctgacgatcatggatctccatcccgggtctggaaagacccggagatacctgcctgcgattgtccgcgaggctatcaagcggaaacttagaacactgattctcgccccgacccgcgtggttgccagcgaaatggctgaggccctgaagggcatgcccatccggtatcaaacaaccgctgtgaaatccgaacacacggggaaggagattgtcgacctgatgtgccatgccacattcaccatgagactccttagccctgtgcgcgtgcccaactacaatatgatcatcatggatgaggcgcactttaccgacccttcttccattgccgctcggggctatatcagcacaagagtcggaatgggcgaagccgctgccattttcatgaccgccacaccccctgggtctgttgaggcttttccgcagagcaacgcggtgatccaggatgaggaacgggacattcccgaacgctcctggaactctggatacgagtggatcaccgatttccctggcaaaacggtgtggtttgtccccagcatcaagtccgggaacgacattgccaattgtctgagaaagaacggaaaacgggtgatccagctgtctcgcaagacattcgataccgagtatcagaagaccaagaataacgactgggactacgttgtgaccacggatattagcgaaatgggcgctaactttagagccgaccgggtcatcgatcctagacgctgcctcaaacccgtgattctgaaggacgggccggagcgggttatccttgccggccctatgcccgtgaccgtcgcttccgccgcgcagagacgcggacggattggcagaaatcataacaaggaaggggatcagtacatctatatgggacagcccctgaataacgacgaggatcacgctcactggacagaggccaaaatgctcctggacaatatcaacacccctgaaggcattatccccgccctgttcgagcctgaacgcgaaaagagcgctgccattgatggggaataccggctcagaggagaggcgcgcaaaacattcgtggagcttatgagacggggcgacctgccggtctggctgtcttataaggtggcctccgaagggtttcaatacagcgatcgcagatggtgcttcgacggcgagcggaataaccaggttctcgaagagaatatggatgtggaaatctggaccaaagagggagagcgcaagaaactgagaccccggtggcttgacgctagaacatattccgaccctctggccctccgcgaatttaaggagttcgctgccggccggagatctgtgagcggggatctgattctggaaatcggaaagctcccccagcatcttacccagcgcgctcaaaacgccctggacaatctggtcatgctccacaactccgagcagggcgggcgggcgtacagacatgccatggaggaactgcctgatacgatcgagacacttatgctgctcgctctgattgccgttctgaccggaggcgtgaccctctttttcctttctggccgggggctgggaaaaacaagcatcggcctgctctgtgtgatggcttccagcgtcctgctttggatggcctctgtggaaccccactggattgccgcttccatcattctggagtttttcctcatggttctgctgatcccggaacctgaccgccagagaacaccccaggataatcaactcgcgtatgtggtcatcgggcttctgtttatgattctgacagtggccgctaacgagatgggactcctggagacgaccaagaaagaccttggcatcgggcacgtcgccgtggaaaatcatcaccatgccacaatgctggatgttgacctccaccctgctagcgcctggaccctgtacgcggtggccacaaccattatcacgcccatgatgcggcataccattgagaacacaaccgctaacatctctctgacagccattgctaatcaggccgcgatcctcatgggacttgataagggctggcctatctccaaaatggacattggcgtccccctgctggccctcgggtgctacagccaggtgaacccgctgacccttacggctgccgttctgatgctcgtggctcactatgccatcattggacctggcctgcaagctaaggccacacgcgaagcgcagaagagaaccgccgctgggatcatgaaaaatcccacagtcgatggaattgtggccatcgacctggatcccgtggtttacgacgctaagttcgagaaacagctcggccagatcatgcttctgattctgtgtacctctcaaatcctcctgatgcggaccacatgggccctttgcgaaagcattacgctggccaccgggcctctcacaaccctgtgggagggatccccgggcaagttttggaacacaaccatcgcggtctctatggctaatattttccgcggcagctatctggccggggctggactcgccttttcccttatgaaaagcctgggcgggggaagacggggcacgggggcccagggagagacactgggcgaaaagtggaagcgccagctcaaccagctgtccaaatctgagttcaatatctacaagagaagcggcatcatggaagtggaccggtccgaggctaaagaagggcttaagagaggagagaccacccgccacgccgtgtctcggggcacagcgaaactgagatggttcgtcgagcgcaacctcgttaagcccgaagggaaggtgattgatctgggatgtggcagagggggatggagctattactgcgccggcctgaaaaaggtgaccgaggtcaaaggctatacaaaagggggacctggccatgaggagcccatccctatggctacgtacgggtggaatctcgtgaaacttcactccggaaaggacgtctttttcacaccccctgaaaaatgtgatacactgctgtgcgacattggcgagtctagcccgaaccccaccatcgaggaagggagaacactccgcgtgctgaagatggtcgagccttggcttcggggaaatcaattttgtattaagatcctgaacccctacatgccttccgtggttgaaaccctcgagcagatgcagagaaaacatggcggcatgctggtgcgcaatcccctgagccggaactctacgcacgagatgtattgggtctcctgcgggaccggaaatattgtgagcgccgtgaacatgacatctagaatgctcctgaatcgcttcaccatggctcaccggaagccgacatacgaaagagatgtcgaccttggcgccgggacccgccatgttgcggtggagcctgaagtggccaacctggatatcatcggacagagaattgagaacatcaaacacgaacataagtccacatggcactatgacgaggataatccctacaaaacctgggcttatcatggcagctacgaggtcaagccctctgggtccgccagctccatggtgaacggagttgtgaagctcctgacgaaaccttgggacgtcattcccatggtgacacaaatcgctatgaccgataccacaccttttggccagcagcgggttttcaaggaaaaagtggacacgcgcaccccgaaggccaaaagaggcacagctcaaattatggaggtcaccgcccggtggctttgggggtttctgagcagaaataagaagccccggatctgtacacgcgaagagttcaccagaaaagtgcggtctaacgcggccatcggagctgtttttgtggacgaaaatcagtggaacagcgccaaggaggctgtcgaggatgaacgcttctgggacctcgtgcagaaagagagagaactgcacaagcagggcaaatgcgccacatgcgtctataatatgatggggaagcgggagaagaaactgggagaatttggcaaggccaaagggtcccgcgcgatttggtacatgtggctcggcgctagattcctggagtttgaggcccttggattcatgaacgaagatcactggttctctcgggagaatagcctgtccggcgtggaaggggagggactccataagctgggctacatccttcgcgacatttctaaaatccctgggggaaacatgtatgccgatgacaccgctggctgggatacgagaattaccgaggacgatctgcaaaatgaagccaagatcacagacatcatggagcccgaacacgctctcctggccaccagcatttttaaactgacataccagaacaaggttgtgcgggtccagcgccctgcgaagaatgggaccgtgatggatgtgatctccagacgggaccagcgcggctctggacaagttggcacgtatgggctcaacacattcaccaatatggaggcccagctgattagacagatggaaagcgagggaatctttcttccctccgagctggaaacaccgaacctcgctgagcgggtgctggattggcttgaaaaatacggcgtcgagagactgaagcgcatggccattagcggggacgactgtgtggttaaacctatcgatgaccggttcgctaccgccctcacggcgctgaacgatatgggaaaggtgagaaaagacatcccccagtgggaaccttctaagggctggaatgattggcaacaggtccccttttgctcccatcacttccaccagctgattatgaaggacgggcgcgagatcgtggtcccttgtcggaaccaggatgagctcgtgggcagagcccgcgttagccaaggagctggctggtctctgcgggaaaccgcctgccttgggaaatcctatgctcagatgtggcagctgatgtactttcatagacgcgacctccggctggccgctaatgccatttgtagcgcggtgcccgtcgattgggtgccgacatccagaaccacatggtctatccacgcccatcaccaatggatgaccacagaggacatgcttagcgtttggaaccgcgtgtggattgaagagaatccttggatggaagataagacccatgtctccagctggggagacgtgccctatctgggcaaacgggaggaccagtggtgcgggtctctcatcggactgacggctagagccacatgggcctccaacattcaggtggctatcaatcaggttcggagactgatcggcaacgagaattacctcgattacatgaccagcatgaagcgcttcaaaaacgaaggggaccccgagggcgtcctgtggtga

SEQ ID NO: 19125 - RNA, 9879 nt, synthetic construct
  misc_feature 1..9879: note = derived and/or modified CDS sequence (opt5) from DENV-1__FJ898417__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccgccctgctcaaaaacgatgttcctctggctggacccctcatcgccggcgggatgctgattgcttgttacgtgatcagcggatctagcgccgacctttccctggagaaggccgctgaggtctcttgggaagaggaagcggagcatagcggcgcctcccacaatattctggtggaagttcaggatgacgggacaatgaaaatcaaggatgaggagcgggacgatacgctcaccatcctgcttaaggctacactgctcgccgtgtctggagtctatcctctgagcattcccgccaccctcttcgtgtggtacttttggcagaaaaagaaacaacgctccggcgtcctgtgggacacaccttctcccccggaagtggagagagctgttcttgatgacggcatctatcggattatgcagcgcgggctgctgggaagaagccaggtgggcgtcggggtgttccaggaaaacgtttttcataccatgtggcacgtgacgcggggagccgtcctcatgtaccaaggcaagcgcctggagccttcctgggcgagcgtgaaaaaggaccttatctcttacgggggaggctggagactgcagggctcctggaataccggggaggaagtgcaggttattgctgtcgagcccggaaagaaccctaaaaatgtgcagacagcccccggcaccttcaagacaagcgaaggggaggtgggagccatcgctctcgattttaaaccgggcacctctgggtcccctattgtcaaccgggaaggaaagatcgtgggcctgtatggcaatggggttgtgacaacgagcggaacctacgtctccgccatcgcgcaagctaaagcctctcaggagggccccctccctgagattgaagacgaggtgttcagaaagcgcaacctgacaatcatggatcttcaccccgggagcggaaagacccggagatatctgcccgccattgttcgcgaagctatcaaacggaagctgagaaccctcattctggcccctacacgcgtggtcgcttccgagatggccgaagcgcttaaaggcatgccgatccggtaccagacgaccgccgtgaagtccgagcatacagggaaagagatcgttgacctgatgtgccacgctacctttacaatgagactcctgtctcccgtgcgcgtccctaattataacatgattatcatggatgaagcccatttcaccgacccctccagcattgctgcccggggctacatctctacgagagtgggaatgggcgaggccgctgcgatttttatgacagccacccctcccgggagcgtggaggctttccctcaatccaatgccgtcatccaggatgaagaacgggacatcccggagcgctcttggaacagcggatatgagtggattaccgattttcccggcaagacagtttggttcgtgccttccatcaagtctgggaatgacattgccaactgtctgcgcaagaatggaaagcgggtgatccagctcagccgcaaaaccttcgatacagaataccagaagaccaaaaacaacgactgggactacgtcgtgacgacagatatttccgagatgggcgctaattttagagccgaccgggttatcgatcccagacgctgccttaagcctgtgattctgaaggacgggcccgaacgggtcatcctggcgggcccgatgcctgtgaccgttgctagcgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatctgccgctattgatggggagtatcggctcagaggagaggcccgcaagacgtttgtggaactgatgagacggggcgacctgcctgtctggctctcctacaaagtggctagcgaggggttccagtattccgatcgcagatggtgctttgacggcgaacggaacaatcaagtccttgaggaaaacatggatgtggagatctggaccaaggagggagaacgcaaaaagctgagaccgcggtggctggacgccagaacatactctgaccccctcgctctgcgcgagttcaaggaatttgccgcgggccggagaagcgtttccggggatcttatcctggagattggaaaactccctcagcacctgacccagcgcgcccagaatgctctggacaacctcgtgatgcttcataattctgaacaaggcgggcgggcctatagacacgctatggaggagctgcccgatacaatcgaaaccctgatgctcctggcccttattgccgtgctgacaggaggcgtcaccctcttctttctgagcggccgggggctgggaaagacgtccatcggcctcctttgtgttatggctagctctgtgctgctgtggatggcgtccgtggagcctcattggattgccgctagcatcatcctcgagttctttctgatggtccttctgattcccgagccggaccgccagagaacacctcaggataaccagctcgcctacgtggttatcgggctgctgttcatgattctcaccgtggccgctaatgagatgggacttctggaaaccaccaagaaggacctgggcatcgggcacgtcgccgtggagaaccaccatcacgcggccatgctcgatgtcgacctgcatcccgcttctgcctggaccctttacgctgtggccacaacgattatcacccctatgatgcggcacacaattgaaaacaccacagcgaatatctccctgaccgccatcgctaaccaagccgctattctcatgggactggataaaggctggcccatcagcaagatggacattggcgttcctctgctcgcccttgggtgctattctcaggtgaatcccctgacgctgaccgctgccgtcctcatgctggtggcgcattacgccatcattggaccgggccttcaggctaaggccacacgcgaggctcagaagagaaccgccgccgggatcatgaagaaccctacagttgatggaatcgtggcgattgacctggatcccgtcgtgtatgacgctaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggttgaccggtctgaagctaaggaggggctgaaaagaggagagacaaccaagcacgccgtcagccgcggcacggctaagctccggtggtttgtggaaagaaatctggtgaaaccggaggggaaggtcatcgatcttggatgtggccgcgggggatggtcctactattgcgccggcctgaaaaaggttacagaagtgaaaggctacaccaaagggggacccggccacgaggaacctattcccatggcgacctacgggtggaacctcgtgaaactgcattctggaaaggacgtcttctttatccctcccgagaagtgtgatacactgctctgcgacattggcgagagctcccctaatccgaccatcgaagaggggcggacacttagagtgctgaaaatggttgaaccctggctgcgcggaaaccagttctgtattaagatcctcaatccttatatgcccagcgtggtcgagacgctggagcaaatgcagcggaaacacggcggcatgcttgtgagaaaccctctgtctcgcaattccacccatgaaatgtactgggttagctgcgggacaggaaacatcgtgtctgccgtcaatatgacctcccggatgctcctgaacagatttacaatggctcaccgcaagcccacctatgagcgggatgtggacctgggcgccgggacgagacacgtggctgtcgaaccggaggttgccaacctcgatattatcggacagcgcattgaaaatatcaaacatgagcacaagagcacctggcattacgacgaggataacccttataagacatgggcttaccacggctcttatgaagtgaaaccctccgggagcgcctccagcatggtgaatggagtcgtgaagctgcttaccaaaccctgggacgttattcctatggtgacacagatcgcgatgaccgatacaacccccttcggccaacagagagtctttaaggagaaagtggacacgcggacacctaaggccaagcgcggcaccgctcagatcatggaagttaccgccaaatggctgtgggggttcctctctagaaacaagaaaccgcggatttgtacaagagaggaatttacgcggaaggtgcgcagcaatgctgccatcggagccgtcttcgtggacgagaaccaatggaactccgcgaaagaggctgttgaagatgagagattttgggacctggtgcatcgggaacgcgagcttcacaagcagggcaagtgcgccacatgcgtctacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtggagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtcgtgagagttcaacggcccgctaaaaacgggaccgtgatggatgtcatctctcgcagagaccagcggggcagcggacaggtgggcacgtacgggctcaatacctttacaaacatggaagcccagctgattcgccaaatggagtccgagggaatcttcagcccttctgaactggagacccccaacctcgcgggcagagtgctggattggcttgaaaagcatggggttgagcggctgaaaagaatggccatctccggagacgactgtgtggtcaagccgattgatgaccgctttgctacagccctcaccgctctgaatgatatgggcaaggtgcggaaagacatccctcagtgggaacccagcaaggggtggaacgattggcagcaggttcctttctgctctcaccactttcatcaacttattatgaaagacggcagagagatcgtggtcccctgtcgcaatcaggatgagctggtgggacgggccagagtctcccagggcgctgggtggagcctccgcgaaacggcctgcctgggaaagtcctatgcgcagatgtggcaactgatgtacttccaccggagagacctccgcctggccgctaacgccatttgttctgccgatcctgtggactgggttcccacaagccggaccacatggtccatccatgctcaccatcagtggatgaccacggaggatatgcttagcgtgtggaatagagtctggattgaagagaacccgtggatggaagacaaaacccacatctcttcctggggcgacgtgccttatctggggaagcgcgaggatcagtggtgcggaagcctcatcggcctgacagcccgggcgacctgggctacaaatattcaagttgccatcaaccaggtgagacggcttattgggaatgagaactacctggactacatgacctctatgaagagatttaaaaatgaaagcgatcccgagggcgccctctggtga

SEQ ID NO: 19126 - RNA, 9879 nt, synthetic construct
  misc_feature 1..9879: note = derived and/or modified CDS sequence (opt5) from DENV-1__GQ868612__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaagtctctcctgtttaagaccagcgccggcgttaacatgtgcacccttattgcgatggacctgggggaactctgtgaagatacaatgacctacaaatgcccccgcatcacagaagctgaacccgacgatgtggactgttggtgcaatgccaccgatacgtgggtgacctatggaacatgttcccaaaccggcgaacacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggctatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagctcacagtggttgtgggagatgtcgccggcattctggggcagggcaagaagatgatccggccgcaacccatggagtacaaatattcttggaaaagctggggcaaggccaagattatcggggctgacgcgcagaataccaccttcatcattgatggacctaacacacccgaatgtcctgacgatcagagagcctggaatatctgggaggtggaggactacggctttggcattttcaccacgaacatctggctgaaacttcgcgattcctatacacaggtgtgcgaccaccggctcatgagcgctgccattaaagattctaaggccgtccacgctgacatggggtactggatcgaatccgagaaaaatgaaacctggaagctggccagagcgagcctgatcgaggttaagacatgtatttggcccaaatctcataccctctggtccaacggagtgctggaaagcgagatgatcattccgaagatctatggcgggcctatttctcaacacaattaccgccccggatactttacacagaccgctggcccttggcatcttgggaaactggagctcgatttcgacctgtgcgaaggaacgaccgtggtcgtggatgagcactgcggcaaccggggccccagcctgagaacaaccacagttaccgggaagatcatccacgaatggtgttgccggtcctgtacgcttcctcccctccgcttcagaggagaggacggctgctggtatgggatggagattcggccggtgaaagaaaaggaggaaaatctggtcaagagcatggtgtctgccggatccggcgaggttgacagcttttccctggggctcctgtgtatctctattatgatcgaagaggtgatgagaagccgctggtcccggaaaatgcttatgacaggaaccctggccgtcttctttctcctgattatgggccagctgacatggaacgatcttatcagactgtgcattatggtgggcgctaatgcctctgaccgcatggggatgggaaccacctacctcgcgctgatggctacattcaagatgagacctatgtttgccgttggcctcctgttccggcgccttacgagcagagaggtgctgctcctgaccatcgggctgtcccttgtcgcctctgtggaactgcccaacagcctcgaggaactgggagatggcctcgctatggggatcatgattctgaaacttctgacagactttcaatcccatcagctctgggccaccctgctgagccttacattcatcaagaccacgttttctctgcactatgcttggaaaacaatggccatggtgctctccattgtcagcctgttccccctctgtctgtctaccacctcccagaagacaacctggcttcctgttctgctgggaagcctcggctgcaagccgctgacaatgtttcttatcgcggagaataaaatttggggccggaagtcttggcccctgaacgaagggatcatggccgtgggaatcgtgtccattctcctgagctccctcctgaaaaacgatgtccctcttgctggccccctgatcgccgggggaatgctgattgcttgttacgtgatcagcggctctagcgccgacctctccctggagaaggccgctgaggtttcttgggaagaggaagcggagcatagcggggcctcccacaatattcttgtggaagtccaggatgacggaacgatgaaaatcaaggatgaggagcgcgacgataccctgacaatcctcctgaaagctaccctcctggccgtgtctggcgtttatcctcttagcattcccgccacactgttcgtgtggtacttttggcaaaagaagaaacagagatccggcgtcctgtgggacaccccttctcccccggaagtggagcgggctgtcctcgatgacgggatctatcgcattatgcagagaggactgcttggccggagccaggtgggggttggagtgttccaagaaaacgtcttccatacgatgtggcacgtgacccgcggcgccgttctgatgtaccaggggaagagactcgagccttcctgggcgagcgtgaaaaaggacctgatctcttacggaggcggctggcggctcagagggtcctggaatacaggagaggaagtccaggtgattgctgtggagcccggcaaaaaccctaagaatgttcagaccgcccccgggacatttaagaccccggaaggagaggtcggcgccatcgctctggatttcaaacctgggacaagcggatctcccattgtgaaccgcgaaggcaagatcgtgggcctttatgggaatggagtcgtgacgacctccggcacatacgttagcgccatcgcgcaagctaaagcctcccaggaggggcctctgcccgagattgaagacgaggtgtttcggaagagaaacctgaccatcatggatctccaccccggatctggcaaaacccgccggtatctgcctgccattgtcagagaagctatcaagcgcaaacttcggacactgattctcgccccgacgagagtggttgctagcgagatggccgaagcgctgaaagggatgcccatccgctaccagaccacagccgtgaagtccgagcataccggcaaagagatcgtcgacctgatgtgccacgctacattcaccatgcggctccttagccctgtgagagttcccaattataacatgattatcatggatgaagcccattttacggacccttcttccattgctgcccggggatacatcagcacacgcgtgggcatgggggaggccgctgcgattttcatgaccgccacaccccctggatctgtcgaggcttttccgcaaagcaatgccgtgatccaggatgaggaaagagacatccccgagcggtcctggaactctggctatgagtggattacagatttccctgggaagaccgtgtggtttgtccccagcatcaaatccggaaatgacattgccaactgtctgcgcaagaatggcaagagagttatccagctgtctcggaaaacattcgataccgaataccagaagacgaaaaacaacgactgggactacgtggtgacaaccgatattagcgagatgggggctaattttagagccgaccgcgtcatcgatcctcggagatgcctcaagcccgtgattctgaaagacggcccggaacgcgttatccttgcgggacctatgcccgtgacagtcgcttccgccgcccaacggagaggccgcatcgggcggaaccacaataaggagggagatcagtatatttacatgggccagcccctgaacaatgacgaggatcatgctcactggaccgaagccaagatgctcctggacaacatcaatacgcctgaggggattatccccgcgctgttcgaacctgagagagaaaagagcgccgctgtggatggagagtatcgcctcagaggcgaggcccggaagaccttcgttgagcttatgcgcagaggggacctgccggtgtggctgtcttacaaagtcgcttccgagggctttcagtatagcgatcggcgctggtgcttcgacggagaaagaaacaatcaagtgctcgaggaaaacatggatgtcgagatttggacaaaggagggcgaacggaaaaagctgagaccccgctggcttgacgcccggacctactccgaccctctggctctcagagagtttaaagagttcgccgcggggcgccggtctgtgagcggagatctgatcctggagatcggcaagctcccccagcaccttacacagagagcccagaatgctctggacaacctggttatgctccataattccgaacaagggggacgggcctatcgccacgctatggaggagctgcctgataccattgaaacacttatgctgctcgccctgatcgccgtgctgaccggcggcgtgacgctctttttcctttctgggagaggactgggcaagacaagcattgggctgctctgtgtcatggcttccagcgttctgctttggatggcgtctgtggagccccattggatcgccgcttccattatcctggaatttttcctcatggtgctgctgatcccggagcctgaccggcagcgcacaccccaggataaccagctcgcctacgtcgtgattggacttctgtttatgatcctgaccgttgccgctaatgagatgggcctcctggaaacaaccaaaaaggaccttgggattggacacgtggccgtcgagaaccaccatcacgcggccatgctggatgtggacctccatcctgctagcgcctggacactgtacgctgtcgccacgaccatcattacacccatgatgagacacaccatcgaaaacacaaccgcgaatatttctctgacggccatcgctaaccaagccgctatcctcatgggccttgataaaggctggcctatttccaagatggacatcggggtgcccctgctggccctcggatgctatagccaggttaatccgctgacccttacagctgccgtgctgatgctcgtcgcgcattacgccattatcggccctgggctgcaggctaaagccacccgggaggctcaaaagcgcacagccgccggaattatgaagaaccccaccgtggatggcatcgttgcgatcgacctggatcccgtggtctatgacgctaaattcgaaaagcagctcgggcagattatgcttctgatcctgtgtacgtctcagattctcctgatgagaacaacctgggccctttgcgagagcatcacactggctaccggacctctcaccacactgtgggagggctccccgggcaaattttggaatacgaccattgccgtgtctatggccaacatcttccgggggagctacctggctggagccggcctcgcgttttcccttatgaaaagcctcgggggaggccgcagagggacaggagcccaaggcgaaaccctgggcgagaaatggaagcggcagctcaatcagctgtccaagtctgagttcaacacatataaaagaagcgggatcatggaggtggaccgctccgaagctaaggagggacttaaacggggcgagaccacgaagcacgccgtttctagagggacagctaaactgcgctggttcgtcgaacggaatctcgtgaagcccgagggaaaggtgattgatctgggctgtgggagaggaggctggagctactattgcgccggcctgaaaaaggtcaccgaagttaaagggtacaccaagggaggccctgggcacgaggaacccatccctatggcgacatacggatggaacctcgtgaaacttcattccggcaaggacgtgtttttcattccccctgagaaatgtgataccctgctgtgcgacatcggggagtctagcccgaatcccacaattgaagagggacgcacgctccgggtcctgaagatggtggaaccttggcttagaggcaaccagttttgtatcaagattctgaatccctatatgccttccgttgtggagaccctcgagcaaatgcagcgcaaacacggcgggatgctggtccggaaccccctgagcagaaattctacacatgaaatgtactgggtgtcctgcggaaccggcaacatcgttagcgccgtgaatatgacatctcgcatgctcctgaaccggttcaccatggctcacagaaagccgacgtatgagcgcgatgtcgaccttgggaccggaacaagacacgtggccgtggaacctgaggtcgctaacctggatatcattggccagcggatcgaaaatattaaacatgagcacaagtccacctggcattacgacgaggataacccctataaaacatgggcctaccacgggagctatgaagttaagccctctggatccgctagctccatggtgaatggcgtggtcaagctcctgaccaaaccttgggacgtgatccccatggttacacagattgccatgaccgatacgacaccttttggccaacagcgcgtgttcaaggagaaagtcgacaccagaaccccgaaggcgaaacgggggacagcccagatcatggaagtgacggctagatggctttggggatttctgagccggaacaagaagccccgcatctgtaccagagaggagttcacacggaaagttcgctctaatgccgctattggcgccgtgtttgtcgacgagaaccaatggaatagcgccaaggaggcggtggaagatgagagattctgggacctcgttcatcgggaacgcgagctgcacaaacaggggaagtgcgctacctgcgtgtacaacatgatgggaaaaagagaaaagaagctgggcgagtttgggaaagccaagggctcccgggccatctggtacatgtggctcggagctcgcttcctggagtttgaagcccttggcttcatgaatgaggatcactggttctctagagaaaacagcctgtccggggtcgagggagagggcctccataaactggggtatattcttcgggacatctctaagattcctggaggcaatatgtacgctgatgacacagccgggtgggatacccgcatcacagaagacgatctgcagaacgaggcgaaaatcaccgacattatggaacccgagcacgccctcctggctaaggccatctttaaactgacgtatcagaataaggtggtcagagtgcaacggcctgctaagaacggcaccgttatggatgtgattagccgcagagaccagcggggatccggccaggtcgggacatacggactcaataccttcacaaacatggaagcccagctgatcagacaaatggagtctgagggcatttttagcccctccgaacttgagaccccgaacctggcggaacgcgccctcgattggctggagaaatatggggtggaacggcttaagagaatggctatcagcggagacgactgtgtggttaaacctatcgatgaccgcttcgccacggctctgacagccctcaatgatatgggcaaggtgcggaaagacattccccagtgggagccttctaaggggtggaacgattggcagcaggtccccttttgctcccatcacttccaccaactgatcatgaaggacggcagagagattgtggttccttgtcgcaatcaggatgaactggtgggacgggctagagtcagccagggcgccgggtggtctctccgcgagaccgcgtgcctgggaaaatcctacgcccagatgtggcaacttatgtattttcatcggagagacctgcgcctcgctgccaacgccatctgtagcgctgtgcccgtcgattgggtgccgacatcccggaccacgtggtctattcacgcccatcaccagtggatgaccacagaagacatgctgagcgtttggaatagagtgtggatcgaggaaaacccttggatggaggataagacccatatttccagctgggaggacgtcccctaccttggcaaacgggaagaccagtggtgcgggtctctgatcggactcacagcgagagctacctgggccacaaatatccaagtggccattaaccaggttcgccggctgatcggcaatgagaactacctggattatatgacctccatgaagagattcaaaaatgaaagcgaccccgagggggctctctggtga

SEQ ID NO: 19127 - RNA, 9879 nt, synthetic construct
  misc_feature 1..9879: note = derived and/or modified CDS sequence (opt5) from DENV-1__FJ898419__SS-prME
  source 1..9879: mol_type = other RNA
agcgtgaccatgctgctgatgctgatgcccacagcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgcaaagaccttctggtgacatttaagaccgcgcacgccaagaaacaggaagtcgtggttctcggatcccaggagggcgctatgcacaccgccctgacaggggccacggaaattcaaaccagcggaacaaccacaatcttcgctggccatctgaagtgcagactcaaaatggataagctgacccttaaagggatgtcttatgtgatgtgtacgggctccttcaagctggagaaggaagtcgccgagacacagcacggaaccgtgctcgttcagattaaatacgagggcaccgacgcgccgtgcaagatcccttttagcacacaggatgaaaaaggggtgacccaaaacggacggctgatcacagctaatcccattgtcacggacaaggagaaacctgtgaacatcgaagccgagccgcccttcggcgagtcttatattgtgatcggggccggagaaaaggctctgaaacttagctggtttaaaaagggctcctctattgggaaaatgttcgaggccaccgctagaggcgcccgccggatggcgatcctcggagatacagcctgggactttggcagcatcgggggagttttcacctccgtcggcaagctggtgcatcagatttttgggacagcttacggagtgctgttcagcggcgtctcttggaccatgaaaatcgggattggcgtgctcctgacgtggcttggactcaattccagaagcacctctctctccatgacatgtatcgccgttggcctggtgaccctgtaccttggggtcatggtgcaggctgatagcggatgcgttattaactggaagggccgcgaactcaagtgtgggtccggaatctttgtgacaaatgaggtccacacctggacagaacagtataaattccaagccgactctcctaagcggctgagcgcggccattggcaaggcttgggaggagggggtgtgcggcatcagatccgccacccgcctggaaaacatcatgtggaagcagatttctaacgagctcaatcatatcctgcttgaaaacgacatgaaatttacggttgtggtcggagatgtggctggcattctggcccaggggaagaaaatgatccggccgcagcccatggagtacaagtatagctggaagtcctggggaaaagccaagattatcggcgctgacgtgcaaaatacaaccttcatcattgatgggcctaacacccccgaatgtcctgacgatcagagagcgtggaatatctgggaggtcgaggactacggatttggcattttcacaaccaacatctggctcaaactgcgcgatagctatacgcaggtttgcgaccaccggctgatgtctgccgctattaaggattccaaagccgtgcacgccgacatgggctactggatcgaaagcgagaagaatgaaacatggaaacttgctagagcctctttcatcgaggtgaaaacctgtatttggcccaagtcccatacactctggagcaacggggtcctggaatctgagatgatcattccgaaaatctatggaggccctattagccagcacaattaccgccccgggtactttacccaaacagcgggaccttggcatctgggcaagctcgagctggatttcgacctttgcgaagggaccacggtggttgtggatgagcactgcggaaaccggggcccctccctgagaaccacaaccgtcacaggcaaaatcatccacgaatggtgttgccggagctgtaccctccctcccctgcgctttaagggggaggacggatgctggtatggcatggagattagaccggtgaaggaaaaagaggaaaatctggttaagtctatggtgtccgctgggagcggagaggtcgactccttctctcttggcctcctgtgtatcagcattatgatcgaagaggtgatgcggtccagatggtctcgcaaaatgctgatgacggggacactcgccgtctttttcctgcttattatgggacagctgacctggaacgatctcatccggctgtgcattatggtgggcgccaatgctagcgacagaatgggcatggggacaacctacctggcccttatggcgacctttaagatgcgccctatgttcgctgtcggactgctctttagacggctgacatcccgcgaggtgctcctgcttacgatcggcctgtctctcgtggccagcgtcgaactgcccaactccctggaggaacttggggatggactggccatgggcatcatgattctcaaactgctcaccgacttccagagccatcaactgtgggctacacttctgtctctcacctttatcaagacaaccttctccctgcactatgcctggaagacgatggctatggttctgagcattgtgtctctttttcccctgtgtctctccacaaccagccagaaaaccacatggctgcctgtgctcctggggtctcttggatgcaagccgctgaccatgttcctgatcgccgagaataaaatttggggcagaaagtcctggcccctcaacgaaggcatcatggcggtcgggatcgtgagcattctgctttccgccctgctcaaaaacgatgttcctctggctggacccctcatcgccggcgggatgctgattgcttgttacgtgatcagcggatctagcgccgacctttccctggagaaggccgctgaggtctcttgggaagaggaagcggagcatagcggcgcctcccacaatattctggtggaagttcaggatgacgggacaatgaaaatcaaggatgaggagcgggacgatacgctcaccatcctgcttaaggctacactgctcgccgtgtctggagtctatcctctgagcattcccgccaccctcttcgtgtggtacttttggcagaaaaagaaacaacgctccggcgtcctgtgggacacaccttctcccccggaagtggagagagctgttcttgatgacggcatctatcggattatgcagcgcgggctgctgggaagaagccaggtgggcgtcggggtgttccaggaaaacgtttttcataccatgtggcacgtgacgcggggagccgtcctcatgtaccaaggcaagcgcctggagccttcctgggcgagcgtgaaaaaggaccttatctcttacgggggaggctggagactgcagggctcctggaataccggggaggaagtgcaggttattgctgtcgagcccggaaagaaccctaaaaatgtgcagacagcccccggcaccttcaagacaagcgaaggggaggtgggagccatcgctctcgattttaaaccgggcacctctgggtcccctattgtcaaccgggaaggaaagatcgtgggcctgtatggcaatggggttgtgacaacgagcggaacctacgtctccgccatcgcgcaagctaaagcctctcaggagggccccctccctgagattgaagacgaggtgttcagaaagcgcaacctgacaatcatggatcttcaccccgggagcggaaagacccggagatatctgcccgccattgttcgcgaagctatcaaacggaagctgagaaccctcattctggcccctacacgcgtggtcgcttccgagatggccgaagcgcttaaaggcatgccgatccggtaccagacgaccgccgtgaagtccgagcatacagggaaagagatcgttgacctgatgtgccacgctacctttacaatgagactcctgtctcccgtgcgcgtccctaattataacatgattatcatggatgaagcccatttcaccgacccctccagcattgctgcccggggctacatctctacgagagtgggaatgggcgaggccgctgcgatttttatgacagccacccctcccgggagcgtggaggctttccctcaatccaatgccgtcatccaggatgaagaacgggacatcccggagcgctcttggaacagcggatatgagtggattaccgattttcccggcaagacagtttggttcgtgccttccatcaagtctgggaatgacattgccaactgtctgcgcaagaatggaaagcgggtgatccagctcagccgcaaaaccttcgatacagaataccagaagaccaaaaacaacgactgggactacgtcgtgacgacagatatttccgagatgggcgctaattttagagccgaccgggttatcgatcccagacgctgccttaagcctgtgattctgaaggacgggcccgaacgggtcatcctggcgggcccgatgcctgtgaccgttgctagcgccgcccaaagacgcggacggatcggcagaaaccacaataaagagggggatcagtatatttacatgggacagcccctcaacaatgacgaggatcatgctcactggacagaagccaagatgctgcttgacaacatcaatacccccgagggcattatccctgcgctgttcgaacccgagcgcgaaaaatctgccgctattgatggggagtatcggctcagaggagaggcccgcaagacgtttgtggaactgatgagacggggcgacctgcctgtctggctctcctacaaagtggctagcgaggggttccagtattccgatcgcagatggtgctttgacggcgaacggaacaatcaagtccttgaggaaaacatggatgtggagatctggaccaaggagggagaacgcaaaaagctgagaccgcggtggctggacgccagaacatactctgaccccctcgctctgcgcgagttcaaggaatttgccgcgggccggagaagcgtttccggggatcttatcctggagattggaaaactccctcagcacctgacccagcgcgcccagaatgctctggacaacctcgtgatgcttcataattctgaacaaggcgggcgggcctatagacacgctatggaggagctgcccgatacaatcgaaaccctgatgctcctggcccttattgccgtgctgacaggaggctggaccctcttctttctgagcggccgggggctgggaaagacgtccatcggcctcctttgtgtcatggctagctctgttctgctgtggatggcgtccgtggagcctcattggattgccgctagcatcatcctcgagttctttctgatggtgcttctgattcccgagccggaccgccagagaacacctcaggataaccagctcgcctacgtcgtgatcgggctgctgttcatgattctcaccgttgccgctaatgagatgggacttctggaaaccaccaagaaggacctgggcatcgggcacgtggccgtcgagaaccaccatcacgcggccatgctcgatgtggacctgcatcccgcttctgcctggaccctttacgctgtcgccacaacgattatcacccctatgatgcggcacacaattgaaaacaccacagcgaatatctccctgaccgccatcgctaaccaagccgctattctcatgggactggataaaggctggcccatcagcaagatggacattggcgtgcctctgctcgcccttgggtgctattctcaggttaatcccctgacgctgaccgctgccgtgctcatgctggtcgcgcattacgccatcattggaccgggccttcaggctaaggccacacgcgaggctcagaagagaaccgccgccgggatcatgaagaaccctacagtggatggaatcgttgcgattgacctggatcccgtggtctatgacgctaaatttgaaaagcagctcggccagatcatgctgctgattctctgtaccagccagatccttctgatgcggacgacatgggccctgtgcgagtccattaccctcgctacagggcccctgaccaccctttgggagggatctcctggcaaattctggaatacaacgatcgccgtgagcatggccaacatcttccgcggctcctacctggctggggccggactcgcgtttagcctgatgaagtccctgggcgggggaagacggggcaccggggcccaaggagaaacactcggcgagaagtggaaacgccagcttaatcagctgtctaagagcgagttcaacacctataaaagatccggcattatggaggtggaccggtctgaagctaaggaggggctgaaaagaggagagacaaccaagcacgccgttagccgcggcacggctaagctccggtggtttgtcgaaagaaatctggtgaaaccggaggggaaggtgatcgatcttggatgtggccgcgggggatggtcctactattgcgccggcctgaaaaaggtcacagaagttaaaggctacaccaaagggggacccggccacgaggaacctattcccatggcgacctacgggtggaacctcgtgaaactgcattctggaaaggacgtgttctttatccctcccgagaagtgtgatacactgctctgcgacattggcgagagctcccctaatccgaccatcgaagaggggcggacacttagagtcctgaaaatggtggaaccctggctgcgcggaaaccagttctgtattaagatcctcaatccttatatgcccagcgttgtggagacgctggagcaaatgcagcggaaacacggcggcatgcttgtcagaaaccctctgtctcgcaattccacccatgaaatgtactgggtgagctgcgggacaggaaacatcgtttctgccgtgaatatgacctcccggatgctcctgaacagatttacaatggctcaccgcaagcccacctatgagcgggatgtcgacctgggcgccgggacgagacacgtggctgtggaaccggaggtcgccaacctcgatattatcggacagcgcattgaaaatatcaaacatgagcacaagagcacctggcattacgacgaggataacccttataagacatgggcttaccacggctcttatgaagttaaaccctccgggagcgcctccagcatggtgaatggagtggtcaagctgcttaccaaaccctgggacgtgattcctatggttacacagatcgcgatgaccgatacaacccccttcggccaacagagagtgtttaaggagaaagtcgacacgcggacacctaaggccaagcgcggcaccgctcagatcatggaagtgaccgccaaatggctgtgggggttcctctctagaaacaagaaaccgcggatttgtacaagagaggaatttacgcggaaggttcgcagcaatgctgccatcggagccgtgttcgtcgacgagaaccaatggaactccgcgaaagaggctgtggaagatgagagattttgggacctggttcatcgggaacgcgagcttcacaagcagggcaagtgcgccacatgcgtgtacaacatgatggggaaaagagaaaagaaactgggagagttcggcaaggccaaagggtctcgggctatttggtacatgtggctcggcgcccgcttcctggagtttgaagctctgggattcatgaatgaggatcactggtttagcagagaaaactccctctctggcgtcgagggggagggactgcataaacttggctatatcctgcgggacattagcaaaatccccgggggaaatatgtacgccgatgacacagcgggctgggatacccgcatcacagaagacgatctccagaacgaggccaagattaccgacatcatggaacctgagcacgctctgcttgccaagtccattttcaaactgacatatcagaataaggtggtcagagtgcaacggcccgctaaaaacgggaccgttatggatgtgatctctcgcagagaccagcggggcagcggacaggtcggcacgtacgggctcaatacctttacaaacatggaagcccagctgattcgccaaatggagtccgagggaatcttcagcccttctgaactggagacccccaacctcgcgggcagagtgctggattggcttgaaaagcatggggtggagcggctgaaaagaatggccatctccggagacgactgtgttgtgaagccgattgatgaccgctttgctacagccctcaccgctctgaatgatatgggcaaggtccggaaagacatccctcagtgggaacccagcaaggggtggaacgattggcaacaggtgcctttctgctctcaccactttcatcaacttattatgaaagacggcagagagatcgttgtgccctgtcgcaatcaggatgagctggtcggacgggccagagtgtcccagggcgctgggtggagcctccgcgaaacggcctgcctgggaaagtcctatgcgcagatgtggcaactgatgtacttccaccggagagacctccgcctggccgctaacgccatttgttctgccgtccctgtggattgggttcccacaagccggaccacatggtccatccatgctcaccatcagtggatgaccacggaggacatgcttagcgtgtggaatagagtctggattgaagagaacccgtggatggaagataaaacccacatctcttcctggggcgacgtgccttatctggggaagcgcgaggaccagtggtgcggaagcctcatcggcctgacagcccgggcgacctgggctacaaatattcaagttgccatcaaccaggtgagacggcttattgggaatgagaactacctggattacatgacctctatgaagagatttaaaaatgaaagcgaccccgagggcgccctctggtga

SEQ ID NO: 19128 - RNA, 9879 nt, synthetic construct
  misc_feature 1..9879: note = derived and/or modified CDS sequence (opt5) from DENV-1__FJ898420__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagaccagcgccggagttaacatgtgcacccttattgcgatggacctgggggaactctgtgaagatacaatgacctacaaatgccccagaatcacagaagctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggctatggtccaggccgattccggatgcgtgattaactggaaaggccgcgaactgaagtgtgggagcggaatcttcgttaccaatgaggtgcacacatggaccgaacaatataagtttcaggcggactcccctaaacggctgtctgccgctattggcaaggcctgggaggagggggtctgcggcatcagaagcgctacgcgcctcgaaaacatcatgtggaaacagatttccaacgagctgaatcatatccttctggaaaacgacatgaagctcacagtggttgtgggagatgtcgccggcattctggggcagggcaagaagatgatccggccgcaacccatggagtacaaatattcttggaaaagctggggcaaggccaagattatcggggctgacgcgcagaataccaccttcatcattgatggacctaacacacccgaatgtcctgacgatcagagagcctggaatatctgggaggtggaggactacggctttggcattttcaccacgaacatctggctgaaacttcgcgattcctatacacaggtgtgcgaccaccggctcatgagcgctgccattaaagattctaaggccgtccacgctgacatggggtactggatcgaatccgagaaaaatgaaacctggaagctggccagagcgagctttatcgaggttaagacatgtatttggcccaaatctcataccctgtggtccaacggagtgctcgaaagcgagatgatcattccgaagatctatggcgggcctatttctcaacacaattaccgccccggatacttcacacagaccgctggcccttggcatctggggcggcttgagctggatttcgacctctgcgaaggaacgaccgtggtcgtggatgagcactgcggcaacagaggccccagcctgcggacaaccacagttaccgggaaaatcatccacgaatggtgttgccgctcctgtacgctgcctccccttagatttcggggagaggacggctgctggtatgggatggagattagaccggtgaaggaaaaagaggaaaatctcgtcaagagcatggtgtctgccggatccggcgaggttgacagcttctccctggggctgctctgtatctctattatgatcgaagaggtgatgcgcagccggtggtccagaaagatgctgatgacaggaacccttgccgtctttttcctgctcattatgggccagctgacatggaacgatctgatccgcctttgcattatggtgggcgctaatgcctctgacagaatggggatgggaaccacctacctggcgctcatggctacatttaaaatgcggcctatgttcgccgttggcctgctctttcgcagactgacgagccgggaggtgcttctgctcaccatcgggctgtccctggtcgcctctgtggaacttcccaacagcctggaggaactcggagatggcctggctatggggatcatgattctcaagctgcttacagacttccaatcccatcagctgtgggccaccctcctgagcctgacatttatcaaaaccacgttctctcttcactatgcttggaagacaatggccatggtgctgtccattgtcagcctctttcccctgtgtctctctaccacctcccagaaaacaacctggctgcctgttcttctgggaagcctgggctgcaagccgctcacaatgttcctgatcgcggagaataagatttggggccgcaaatcttggccccttaacgaagggatcatggccgtgggaatcgtgtccattctgctcagctccctgctcaagaacgatgtccctctggctggcccccttatcgccgggggaatgctgattgcttgttacgtgatcagcggctctagcgccgacctgtccctcgagaaagccgctgaggtttcttgggaagaggaagcggagcatagcggggcctcccacaatattctggtggaagtccaggatgacggaacgatgaagatcaaagatgaggagagagacgatacccttacaatcctgctcaaggctaccctgctcgccgtgtctggcgtttatcctctgagcattcccgccacactttttgtgtggtacttctggcagaagaagaagcagcggtccggcgtcctgtgggacaccccttctcccccggaagtggagcgcgctgtcctggatgacgggatctatagaattatgcagcggggactcctgggccgcagccaggtgggggttggagtgttccaagaaaacgtctttcatacgatgtggcacgtgaccagaggcgccgttcttatgtaccaggggaaacggctggagccttcctgggcgagcgtgaagaaagacctcatctcttacggaggcggctggagactgcgcgggtcctggaatacaggagaggaagtccaggtgattgctgtggagcccggcaagaaccctaaaaatgttcagaccgcccccgggacattcaagaccccggaaggagaggtcggcgccatcgctctcgattttaagcctgggacaagcggatctcccattgtgaaccgggaaggcaaaatcgtgggcctgtatgggaatggagtcgtgacgacctccggcacatacgttagcgccatcgcgcaagctaaggcctcccaggaggggcctcttcccgagattgaagacgaggtgttcagaaaacgcaacctgaccatcatggatctgcaccccggatctggcaagacccggagatatctccctgccattgtccgcgaagctatcaaacggaagctgagaacacttattctggccccgacgcgcgtggttgctagcgagatggccgaagcgctcaaggggatgcccatccggtaccagaccacagccgtgaaatccgagcataccggcaaggagatcgtcgacctgatgtgccacgctacatttaccatgagactgctcagccctgtgcgggttcccaattataacatgattatcatggatgaagcccatttcacggacccttcttccattgctgcccgcggatacatcagcacaagagtgggcatgggggaggccgctgcgatttttatgaccgccacaccccctggatctgtcgaggctttcccgcaaagcaatgccgtgatccaggatgaggaacgggacatccccgagcgctcctggaactctggctatgagtggattacagattttcctgggaaaaccgtgtggttcgtccccagcatcaagtccggaaatgacattgccaactgtcttcgcaaaaatggcaagcgggttatccagctgtctagaaagacatttgataccgaataccagaaaacgaagaacaacgactgggactacgtggtgacaaccgatattagcgagatgggggctaatttccgcgccgaccgggtcatcgatcctagacgctgcctgaaacccgtgattctcaaggacggcccggaacgggttatcctggcgggacctatgcccgtgacagtcgcttccgccgcccaaagacgcggccggatcgggagaaaccacaataaagagggagatcagtatatttacatgggccagccccttaacaatgacgaggatcatgctcactggaccgaagccaagatgctgctcgacaacatcaatacgcctgaggggattatccccgcgctgttcgaacctgagcgcgaaaagagcgccgctgtggatggagagtatagactgcggggcgaggcccgcaaaacctttgttgaactcatgagaagaggggaccttccggtgtggctgtcttacaaggtcgcttccgagggcttccagtatagcgatcgcagatggtgctttgacggagaacggaacaatcaagtgctggaggaaaacatggatgtcgagatttggacaaaagagggcgaaagaaagaaactccgcccccggtggctggacgccagaacctactccgaccctcttgctctgcgcgagttcaaggaatttgccgcggggcggagatctgtgagcggagatctcatcctggagatcggcaaactgccccagcacctcacacagcgggcccagaatgctcttgacaacctggttatgctgcataattccgaacaagggggacgcgcctatagacacgctatggaggagctccctgataccattgaaacactgatgcttctggccctcatcgccgtgctgaccggcggcgtgacgctgttctttctctctgggcggggacttggcaagacaagcattgggctgctgtgtgtcatggcttccagcgttctcctgtggatggcgtctgtggagccccattggatcgccgcttccattatccttgagttctttctgatggtgctcctgatcccggagcctgaccgccagagaacaccccaagataaccagctggcctacgtcgtgattggactccttttcatgatcctgaccgttgccgctaatgagatgggcctgctcgaaaccaccaagaaagacctggggattggacacgtggccgtcgagaaccaccatcacgcggccatgcttgatgtggacctgcatcctgctagcgcctggacactctacgctgtcgccacgaccatcattacacccatgatgcggcacaccatcgaaaacacaaccgcgaatatttctctgacggccatcgctaaccaagccgctatcctgatgggcctcgataagggctggcctatttccaaaatggacatcggggtgccccttctggccctgggatgctatagccaggttaatccgctcaccctgacagctgccgtgcttatgctggtcgcgcattacgccattatcggccctgggctccaggctaaggccacccgcgaggctcagaaacggacagccgccggaattatgaagaaccccaccgtggatggcatcgttgcgatcgacctggatcccgtggtctatgacgctaagtttgaaaaacagctggggcagattatgctccttatcctgtgtacgtctcagattctgctcatgcggacaacctgggccctgtgcgagagcatcacacttgctaccggacctctgaccacactctgggagggctccccgggcaagttctggaatacgaccattgccgtgtctatggccaacatctttcgcgggagctacctggctggagccggcctggcgttctccctcatgaaaagccttgggggaggcagacgggggacaggagcccaaggcgaaaccctgggcgagaagtggaaaagacagctgaatcagctctccaagtctgagttcaacacatataagcgcagcgggatcatggaggtggaccggtccgaagctaaagagggactgaagagaggcgagaccacgaaacacgccgtttctcgcgggacagctaaacttcggtggtttgtcgaaagaaatctggtgaaacccgagggaaaggtgattgatctcggctgtgggcgcggaggctggagctactattgcgccggcctgaagaaagtcaccgaagttaaggggtacaccaaaggaggccctgggcacgaggaacccatccctatggcgacatacggatggaacctggtgaagctccattccggcaaagacgtgttctttattccccctgagaagtgtgatacccttctgtgcgacatcggggagtctagcccgaatcccacaattgaagagggacggacgctgagagtcctcaaaatggtggaaccttggctgcgcggcaaccagttctgtatcaagattcttaatccctatatgccttccgttgtggagaccctggagcaaatgcagcggaagcacggcgggatgctcgtcagaaaccccctgagccgcaattctacacatgaaatgtactgggtgtcctgcggaaccggcaacatcgttagcgccgtgaatatgacatctcggatgctgctcaacagatttaccatggctcaccgcaaaccgacgtatgagagagatgtcgacctggggaccggaacacggcacgtggccgtggaacctgaggtcgctaaccttgatatcattggccagcgcatcgaaaatattaagcatgagcacaaatccacctggcattacgacgaggataacccctataagacatgggcctaccacgggagctatgaagttaaaccctctggatccgctagctccatggtgaatggcgtggtcaagctgctcaccaagccttgggacgtgatccccatggttacacagattgccatgaccgatacgacacctttcggccaacagagagtgtttaaagagaaggtcgacacccggaccccgaaagcgaagagagggacagcccagatcatggaagtgacggctcggtggctgtggggattccttagccgcaacaaaaagcccagaatctgtacccgggaggaatttacacgcaaggttagatctaatgccgctattggcgccgtgttcgtcgacgagaaccaatggaatagcgccaaagaggcggtggaagatgagcggttttgggacctggttcatcgcgaaagagagctccacaagcaggggaaatgcgctacctgcgtgtacaacatgatgggaaagcgggagaaaaagctgggcgagttcgggaaggccaaaggctcccgcgccatctggtacatgtggctgggagctagatttctcgagttcgaagccctgggcttcatgaatgaggatcactggttttctcgggaaaacagcctttccggggtcgagggagagggcctgcataagctcgggtatattctgcgcgacatctctaaaattcctggaggcaatatgtacgctgatgacacagccgggtgggataccagaatcacagaagacgatcttcagaacgaggcgaagatcaccgacattatggaacccgagcacgccctgctcgctaaagccatcttcaagctgacgtatcagaataaagtggtccgggtgcaacgccctgctaagaacggcaccgttatggatgtgattagcagacgggaccagagaggatccggccaggtcgggacatacggactgaatacctttacaaacatggaagcccagctcatccgccaaatggagtctgagggcattttcagcccctccgaactggagaccccgaaccttgcggaacgggccctggattggctcgagaagtatggggtggaaagactgaaacgcatggctatcagcggagacgactgtgtggttaagcctatcgatgaccggtttgccacggctcttacagccctgaatgatatgggcaaagtgagaaaggacattccccagtgggagccttctaaagggtggaacgattggcagcaggtccccttctgctcccatcactttcaccaactcatcatgaaggacggccgcgagattgtggttccttgtcggaatcaggatgaactggtgggcagagctcgcgtcagccagggcgccgggtggtctctgcgggagaccgcgtgcctcggaaagtcctacgcccagatgtggcaactgatgtatttccataaaagagaccttcgcctggctgccaacgccatctgtagcgctgtgcccgtcgattgggtgccgacatcccggaccacgtggtctattcacgcccatcaccagtggatgaccacagaagacatgctcagcgtttggaatagagtgtggatcgaggaaaacccttggatggaggataagacccatatttccagctgggaggacgtcccctacctgggcaaacgggaagaccagtggtgcgggtctcttatcggactgacagcgagagctacctgggccacaaatatccaagtggccattaaccaggttcgccggctcatcggcaatgagaactacctggattatatgacctccatgaagagatttaaaaatgaaagcgaccccgagggggctctgtggtga

SEQ ID NO: 19129 - RNA, 9879 nt, synthetic construct
  misc_feature 1..9879: note = derived and/or modified CDS sequence (opt5) from DENV-1__FJ898421__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtggccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaagtcgccgagacccagcacggaaccgtgctggttcagattaagtacgagggcacagacgcgccgtgcaaaatccctttctccacccaagatgaaaagggggtgacacagaacggacggctgatcacggctaatcccattgtcaccgacaaagagaagcctgtgaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtttttacaagcgtcggcaaactggtgcatcagattttcgggaccgcttacggagtgctcttttccggcgtcagctggacgatgaagatcgggattggcgtgctgcttacctggctgggactcaattctagatccacaagcctgtctatgacctgtatcgccgttggcctggtgacactttacctcggggtcatggtgcaggctgattccggatgcgttattaactggaaaggccgcgaactgaagtgtgggagcggaatcttcgtgaccaatgaggtccacacatggaccgaacaatataagtttcaggccgactcccctaaacggctgtctgcggccattggcaaggcttgggaggagggggtgtgcggcatcagaagcgccacgcgcctcgaaaacatcatgtggaaacagatttccaacgagctgaatcatatccttctggaaaacgacatgaagctcacagttgtggtcggagatgtggctggcattctggggcagggcaagaaaatgatccggccgcaacccatggagtacaaatattcttggaaaagctggggcaaggccaagattatcggggccgacgctcagaataccaccttcatcattgatggacctaacacacccgaatgtcctgacgatcagagagcgtggaatatctgggaggtggaggactacggctttggcattttcaccacgaacatctggctgaaacttcgcgattcctatacacaggtctgcgaccaccggctcatgagcgccgctattaaagattctaaggccgttcacgccgacatggggtactggatcgaatccgagaaaaatgaaacctggaagctggctagagccagctttatcgaggtgaagacatgtatttggcccaaatctcataccctgtggtccaacggagtgctcgaaagcgagatgatcattccgaagatctatggcgggcctatttctcaacacaattaccgccccggatacttcacacagaccgcgggcccttggcatctggggaaacttgagctggatttcgacctctgcgaaggaacgaccgtcgtggttgatgagcactgcggcaaccggggccccagcctgagaacaaccacagtgaccgggaagatcatccacgaatggtgttgccggtcctgtacgctgcctccccttcgctttagaggagaggacggctgctggtatgggatggagattcggccggtcaaagaaaaggaggaaaatctcgtcaagagcatggtttctgctggatccggcgaggtggacagcttctccctggggctgctctctatcagcattatgatcgaagaggtcatgagatcccgctggtctcggaaaatgctgatgacaggaacccttgccgtgtttttcctgctcattatgggccagctgacatggaacgatctgatcagactttgtattatggttggcgccaatgctagcgaccgcatggggatgggaaccacctacctggccctcatggcgacatttaagatgagacctatgttcgctgtgggcctgctctttcggcgcctgacgtccagagaggtccttctgctcaccatcgggctgtctctggtggccagcgtggaacttcccaactccctggaggaactcggagatggcctggccatggggatcatgattctcaaactgcttacagacttccaaagccatcagctgtgggctaccctcctgtctctgacatttatcaagaccacgttctcccttcactatgcctggaaaacaatggctatggtcctgagcattgtttctctctttcccctgtgcctctccaccaccagccagaagacaacctggctgcctgtgcttctgggatctctgggctgtaagccgctcacaatgttcctgatcgccgagaataaaatttggggccggaagtcctggccccttaacgaagggatcatggcggtgggaatcgtcagcattctgctctccagcctgctcaaaaacgatgtgcctctggccggcccccttatcgctgggggaatgctgattgcctgctacgttatctctggcagctccgctgacctgtctctcgagaaggccgccgaggtgagctgggaagaggaagctgagcattccggggcgtctcacaatattctggtcgaagtgcaggatgacggaacgatgaaaatcaaggatgaggagcgcgacgatacccttacaatcctgctcaaagccaccctgctcgctgttagcggcgtgtatcctctgtccattcccgccacactttttgtctggtacttctggcaaaagaagaaacagagatctggcgtgctgtgggacacccctagccctcccgaagtcgagcgggccgtgctggatgacgggatctatcgcattatgcagagaggactcctgggccggtcccaggttggggtgggagtcttccaagaaaacgtgtttcatacgatgtggcacgttacccgcggcgctgtgcttatgtaccaggggaagagactggagcccagctgggcctctgtcaaaaaggacctcatctcctacggaggcggctggcggctgagagggagctggaatacaggagaggaagtccaggtgattgcggttgagcccggcaaaaaccctaagaatgtccagaccgctcccgggacattcaagaccccggaaggagaggtgggcgccatcgccctcgattttaaacctgggacatctggatcccccattgtgaaccgcgaaggcaagatcgtcggcctgtatgggaatggagtggttacgaccagcggcacatacgtgtccgctatcgcccaagcgaaggcttctcaggaggggcctcttcccgagattgaagacgaggtcttccggaagagaaacctgaccatcatggatctgcaccccggaagcggcaaaacccgccggtatctccctgccattgtgagagaagccatcaagcgcaagctgcggacacttattctggctccgacgagagttgtggcctccgagatggctgaagccctcaaagggatgcccatccgctaccagaccacagcggtcaagagcgagcataccggcaaagagatcgtggacctgatgtgtcacgccacatttaccatgcggctgctctctcctgttagagtgcccaattataacatgattatcatggatgaagctcatttcacggacccttccagcattgccgctcggggatacatctctacacgcgtcggcatgggggaggccgccgctatttttatgaccgcgacaccccctggaagcgtggaagccttcccgcaatccaatgctgtgatccaggatgaggaaagagacatccccgagcggtcttggaacagcggctatgagtggattacagattttcctgggaagaccgtctggttcgttccctccatcaaatctggaaatgacattgccaactgccttcgcaagaatggcaagagagtgatccagctgagccggaaaacatttgataccgaataccagaagacgaaaaacaacgactgggactacgtggtcacaaccgatatttccgagatgggggccaatttcagagctgaccgcgtgatcgatcctcggagatgtctgaagcccgttattctcaaagacggcccggaacgcgtgatcctggccggacctatgcccgtcacagtggcgagcgctgcccaacggagaggccgcatcgggcggaaccacaataaggagggagatcagtatatttacatgggccagccccttaacaatgacgaggatcatgcccactggaccgaagctaagatgctgctcgacaacatcaatacgcctgaggggattatccccgccctgttcgaacctgagagagaaaaatctgcggccgttgatggagagtatcgcctgagaggcgaggctcggaagacctttgtggaactcatgcgcagaggggaccttccggtctggctgtcctacaaagtggccagcgagggcttccagtattccgatcggcgctggtgctttgacggagaaagaaacaatcaagtcctggaggaaaacatggatgtggagatttggacaaaggagggcgaacggaaaaagctcagaccccgctggctggacgctcggacctactctgaccctcttgccctgagagagttcaaagaatttgctgccgggcgccggagcgtttccggagatctcatcctggagatcggcaagctgccccagcacctcacacagagagcgcagaatgcccttgacaacctggtgatgctgcataattctgaacaagggggacgggcttatcgccacgccatggaggagctccctgataccattgaaacactgatgcttctggctctcatcgccgtgctgaccggcggcgtcacgctgttctttctcagcgggagaggacttggcaagacatccattgggctgctgtgcgttatggccagctctgtgctcctgtggatggcttccgtggagccccattggatcgcggccagcattatccttgagttctttctgatggtcctcctgatcccggagcctgaccggcagcgcacaccccaggataaccagctggcttacgtggttattggactccttttcatgatcctgaccgtggccgccaatgagatgggcctgctcgaaacaaccaaaaaggacctggggattggacacgtcgctgtggagaaccaccatcacgccgcgatgcttgatgtcgacctgcatcctgcctctgcttggacactctacgccgtggctacgaccatcattacacccatgatgagacacaccatcgaaaacacaaccgccaatatttccctgacggcgatcgccaaccaagctgccatcctgatgggcctcgataaaggctggcctattagcaagatggacatcggggttccccttctggctctgggatgttattctcaggtgaatccgctcaccctgacagccgctgtccttatgctggtggcccattacgcgattatcggccctgggctccaggccaaagctacccgggaggcccaaaagcgcacagctgccggaattatgaagaaccccaccgttgatggcatcgtggccatcgacctggatcccgtcgtgtatgacgcgaaatttgaaaagcagctggggcagattatgctccttatcctgtgcacgagccagattctgctcatgagaacaacctgggctctgtgtgagtccatcacacttgccaccggacctctgaccacactctgggagggctctccgggcaaattctggaatacgaccattgctgtgagcatggccaacatctttcgggggtcctacctggccggagctggcctggccttcagcctcatgaagtcccttgggggaggccgcagagggacaggagcgcaaggcgaaaccctgggcgagaaatggaagcggcagctgaatcagctctctaagagcgagttcaacacatataaaagatccgggatcatggaggttgaccgctctgaagccaaggagggactgaaacggggcgagaccacgaagcacgctgtcagcagagggacagccaaacttcgctggtttgtggaacggaatctggtgaagcccgagggaaaggtcattgatctcggctgcgggagaggaggctggtcctactattgtgctggcctgaaaaaggttaccgaagtgaaagggtacaccaagggaggccctgggcacgaggaacccatccctatggccacatacggatggaacctggtgaaactccattctggcaaggacgtcttctttattccccctgagaaatgcgatacccttctgtgtgacatcggggagagctccccgaatcccacaattgaagagggacgcacgctgcgggtgctcaagatggttgaaccttggctgagaggcaaccagttctgcatcaagattcttaatccctatatgcctagcgtggtcgagaccctggagcaaatgcagcgcaaacacggcgggatgctcgtgcggaaccccctgtctagaaattccacacatgaaatgtactgggttagctgtggaaccggcaacatcgtgtctgcggtcaatatgacatcccgcatgctgctcaaccggtttaccatggcccacagaaagccgacgtatgagcgcgatgtggacctggggaccggaacaagacacgtggctgtcgaacctgaggttgccaaccttgatatcattggccagcggatcgaaaatattaaacatgagcacaagagcacctggcattacgacgaggataacccctataaaacatgggcttaccacgggtcttatgaagtgaagccctccggaagcgcctccagcatggtgaatggcgtcgtgaagctgctcaccaaaccttgggacgttatccccatggtgacacagattgctatgaccgatacgacacctttcggccaacagcgcgtctttaaggagaaagtggacaccagaaccccgaaggccaaacgggggacagcgcagatcatggaagttacggccagatggctgtggggattcctttctcggaacaagaagccccgcatctgcaccagagaggaatttacacggaaagtgcgcagcaatgctgccattggcgctgtcttcgtggacgagaaccaatggaactccgccaaggaggccgttgaagatgagagattttgggacctggtgcatcgggaacgcgagctccacaaacaggggaagtgtgcgacctgcgtctacaacatgatgggaaaaagagaaaagaagctgggcgagttcgggaaagctaagggctctcgggccatctggtacatgtggctgggagcccgctttctcgagttcgaagctctgggcttcatgaatgaggatcactggtttagcagagaaaactccctttctggggtggagggagagggcctgcataaactcgggtatattctgcgggacatcagcaagattcctggaggcaatatgtacgccgatgacacagctgggtgggatacccgcatcacagaagacgatcttcagaacgaggccaaaatcaccgacattatggaacccgagcacgcgctgctcgccaaggctatcttcaaactgacgtatcagaataaggtcgtgagagttcaacggcctgccaagaacggcaccgtgatggatgtcatttcccgcagagaccagcggggatctggccaggtggggacatacggactgaatacctttacaaacatggaagctcagctcatcagacaaatggagagcgagggcattttctcccccagcgaactggagaccccgaaccttgccgaacgcgcgctggattggctcgagaaatatggggtggaacggctgaagagaatggccatctctggagacgactgcgttgtgaaacctatcgatgaccgctttgctacggcccttacagctctgaatgatatgggcaaggtccggaaagacattccccagtgggagccttccaaggggtggaacgattggcaacaggtgcccttctgtagccatcactttcaccaactcatcatgaaggacggcagagagattgttgtgccttgccgcaatcaggatgaactggtcggacgggccagagtgtctcagggcgctgggtggtccctgcgcgagaccgcctgtctcggaaaaagctacgcgcagatgtggcaactgatgtatttccatcggagagaccttcgcctggccgctaacgccatctgctccgccgtccccgtggattgggttccgacatctcggaccacgtggagcattcacgctcatcaccagtggatgaccacagaagacatgctctccgtgtggaatagagtctggatcgaggaaaacccttggatggaggataagacccatattagctcttgggaggacgtgccctacctgggcaaacgggaagaccagtggtgtgggtcccttatcggactgacagccagagcgacctgggctacaaatatccaagttgccattaaccaggtgcgccggctcatcggcaatgagaactacctggattatatgaccagcatgaagagatttaaaaatgaatctgggcccgagggcgccctgtggtga

SEQ ID NO: 19130 - RNA, 9879 nt, synthetic construct
  misc_feature 1..9879: note = derived and/or modified CDS sequence (opt5) from DENV-1__FJ898423__SS-prME
  source 1..9879: mol_type = other RNA
agcgtgaccatgctgctcatgctgatgcccacggcccttgctttccacctgacgaccagaggcggggaacctcatatgatcgtctccaagcaggaacggggaaagtctctcctgtttaagaccagcgccggcgttaatatgtgcacccttatcgcgatggacctgggggaactctgtgaagatacaatgacctacaaatgcccgagaatcacagaggtggaacccgacgatgtggactgttggtgcaataccacggatacctgggtcacatatggaacctgttcccaaacaggcgagcacagacgggacaagcgctctgtggctctggcccctcatgttgggctgggactcgagaccagagccgaaacgtggatgagctccgagggcgcttggaaacagattcagaaggtggaaacatgggccctgcggcaccccggcttcaccgtcatcgctctttttctggcccatgcgattgggacatctatcacccagaagggaatcattttcatcctcctgatgcttgtgacccctagcatggccatgcgctgcgttggcattgggtccagagattttgtggagggactgagcggcgctacatgggtcgacgtggtgctcgagcacgggtcttgtgtcacgaccatggccaaagataagcccacactggacatcgaactgctcaaaaccgaggttacaaaccctgctgtgctgcggaaactttgcattgaagccaaaatctccaataccacgacagatagccgctgtccgacccaaggagaggcgaccctggtggaagaacaggacgccaacttcgtctgcagacggacatttgtggatcgcggctggggcaatgggtgtggactcttcggcaaggggtctctgattacctgcgctaagtttaaatgcgttacaaaacttgagggaaaaatcatccagtacgaaaacctgaagtattccgtgattgtcacggtgcacaccggcgaccagcatcaagttgggaatgagagcacagaacacggaaccatcgccacaattacaccccaggctcctacgtctgagatccagctcaccgactacggcgccctgacactggattgttcccccagaaccggcctcgacttcaacgaaatggtgctgcttacaatgaaagaaaagagctggctggtccataaacagtggtttctcgatctgcctcttccctggacctccggggcctctacgagccaagagacatggaatcggcaggacctgctcgtgaccttcaagacagctcacgcgaagaaacaggaagtcgtggttctgggatcccaagagggcgccatgcacaccgctctgaccggggccacagaaattcagacgaccggaacaaccacaatctttgccggccatctcaagtgccgcctgaaaatggataaacttaccctgaaagggatgagctatgtgatgtgtacgggctctttcaagctcgagaaggaagtcgctgagacacagcacggaaccgtgctggttcagatcaaatacgagggcaccgacgccccgtgcaagattcctttctccacacaagatgaaaaaggggtgacccagaacggaagactgatcacagcgaatcccattgtcacggacaaggagaaacctgtgaacatcgaagctgagccgccctttggcgagagctatattgtgatcggggccggagaaaaggcccttaagctctcttggttcaaaaagggcagctccatcgggaaaatgtttgaggctaccgcccggggcgctagacgcatggccattctgggagatacagcgtgggacttcggctctatcgggggagtttttaccagcgtcggcaagctggtgcatcagattttcgggacagcctacggagtgctcttttccggcgtcagctggaccatgaaaatcgggattggcgtgctgcttacgtggctgggactcaattctcggtccaccagcctgtctatgacatgtatcgctgttggcctgattaccctttacctcggggtgatggtccaggccgattccggatgcgtgatcaactggaagggcagagaactgaagtgtgggagcggaatcttcgttacaaatgaggtgcacacctggacagaacaatataaatttcaggctgactcccctaagcgcctgtctgccgcgattggcaaagcctgggaggagggggtctgcggcatccggagcgctaccagactcgaaaacattatgtggcgccagatctccaacgagctgaatcatattcttctggaaaacgacatgaagttcacggtggttgtgggagatgtcgtgggcatcctcgcccaggggaaaaagatggtgcggccgcaacccatggagcacaaatactcttggaaaagctggggaaaggctaagatcattggcgccgacgtccagaatacaacctttatcattgatgggcctaacacccccgaatgtcctgacgatcagagagcctggaatatctgggaggttgaggactatggattcggcatttttacaaccaacatctggctgaagctgcgcgattcctacacacaggtgtgcgaccaccggcttatgagcgctgcgatcaaagattctaaggccgtgcatgctgacatgggctattggattgaatccgagaaaaatgaaacatggaagctcgccagagccagcttcatcgaggtcaagacctgtatttggcccaaatctcacacactgtggtccaacggggtgctggaaagcgagatgatcattccgaagatctacggaggccctatctctcaacataattatcgccccgggtacttcacccagacagctggaccttggcacctcggcaaactggagcttgattttgacctgtgcgaagggaccacggttgtggtcgatgagcactgcggaaaccggggccccagcctcagaaccacaaccgtgacaggcaagattatccatgaatggtgttgccggtcctgtaccctgcctcccctgcgcttcaaaggggaggacggatgctggtacggcatggagattagaccggttaaggaaaaggaggaaaatcttgtgaaaagcatggtctctgccgggtccggagaggtggacagcttttccctcggcctgctgtgtatctctattatgatcgaagaggttatgcggagcagatggtcccgcaagatgctcatgacggggacactggcggtgttctttcttctgattatgggacagctcacctggaacgatctgatccggtcttgcatcatggtcggcgctaatgccagcgacagaatgggcatggggacaacctatctggcccttatggctaccttcaaaatgcgccctatgtttgccgtgggactcctgttcagacggctgacatcccgcgaggtgctcctgcttacgattggcctgtctctcgtcgcgagcgttgaactgcccaactccctggaggaacttggggatggactggctatgggcatcatgattctcaagctgctcaccgactttcaaagctaccagctgtgggccacacttctgtctctcaccttcatcaaaacaaccttttccctgcactatgcctggaagacgatggctatggtgctgagcattgtgtctcttctgcccctctgtctgtccacaaccagccagaagaccacatggctccctgtcctgcttgggtctctgggatgcaaaccgctgaccatgttcctcatcgccgagaataagatctggggcagaaaatcctggcccctgaacgaaggcattatggctgtggggatcgttagcattcttctgtccagcctcctgaagaacgatgtgcctctcgccggacccctgatcgcgggcgggatgcttattgcctgttacgtcatctctggaagctccgctgacctgtctctggagaaagccgctgaggtgagctgggaagaggaagccgagcattccggcgcctctcacaatatcctcgttgaagtgcaggatgacgggacaatgaagattaaagatgaggagcgggacgatacgctgaccatccttctgaaggctacactcctggcggtcagcggagtgtatcctctctccattcccgccaccctgtttgtctggtacttctggcaaaagaaaaagcagcgctctggcgtgctttgggacacacctagccctcccgaagttgagagagctgtgctggatgacggcatctatcggattatgcagcgcgggctgctcggaagatcccaggtcggcgtgggggttttccaagaaaacgtgtttcataccatgtggcacgtcacgcggggagccgtgctgatgtaccagggcaaacgccttgagcccagctgggcctctgtgaagaaagacctgatctcctacgggggaggctggagactccagggcagctggaataccggggaggaagttcaggtcattgctgtggagcccggaaagaaccctaagaatgtgcaaacagcccccggcaccttcaaaacaccggaaggggaggtcggagcgatcgctctggattttaagcctggcacctctgggtcccccatcgtgaaccgggaaggaaaaattgttggcctctatggcaatggggtggtcacaacgagcggaacctacgtgtccgccatcgcccaggctaaggcctctcaggagggccctctgcccgagattgaagacgaggttttcagaaaacgcaaccttacaatcatggatctgcaccccgggagcggaaagacccggagatatctgcctgcgattgtgcgcgaagctatcaagcggaaactcagaaccctgatccttgccccgacacgcgtcgtggcctccgagatggctgaagccctgaagggcatgcccattcggtaccaaacgaccgctgttaaaagcgagcatacagggagagagatcgtggacctcatgtgccacgccacctttacaatgcgcctgctgtctcctgtccgggtgcccaattataacatgattatcatggatgaagcgcatttcaccgacccttccagcattgccgctagaggctacatctctacgcgggtgggaatgggcgaggccgctgccatctttatgacagccacaccccctgggagcgtcgaggctttcccgcagtccaatgcggttattcaggatgaggaacgcgacatccccgagagatcttggaacagcggatatgagtggattaccgattttcctggcaagacagtgtggttcgtgccctccatcaaatctgggaatgacattgccaactgtctccggaagaatggaaagcgcgtcatccagcttagcagaaaaacctttgatacagaataccaaaagaccaaaaacaacgactgggactacgtggttacgacagatatttccgagatgggcgctaatttccgggccgacagagtgatcgatcctcgccggtgcctgaagcccgtcatcctgaaagacgggccggaaagagtgattctcgccggccctatgcccgttaccgtggctagcgccgcgcagcgccggggaagaatcggccgcaaccacaataaggagggggatcagtatatttacatgggacagcccctgaacaatgacgaggatcatgctcactggacagaagccaagatgcttctggacaacatcaatacccctgagggcattatccccgccctcttcgaacctgagcgggaaaaatctgctgccatcgatggggagtatagactgcgcggagaggcgagaaagacgtttgtcgaactgatgcggcgcggcgacctcccggtgtggctttcctacaaagtcgccagcgaggggttccaatattccgatagacggtggtgctttgacggcgaacgcaacaatcaggtgctggaggaaaacatggatgttgagatttggaccaaggagggagaacgcaagaagctgcggcccagatggctcgacgctcgcacatactctgaccctctggcccttcgggagttcaaagaatttgctgccggcagacgcagcgtgtccggggatctgatcctcgagattggaaagctgccccagcacctgacccagcgggctcaaaatgccctcgacaaccttgtgatgctgcataattctgaacagggcgggagagcgtatcggcacgccatggaggagctgcctgatacaatcgaaaccctcatgctgcttgctctgattgccgtcctcacaggaggcgttaccctgttctttctgagcggccgcgggctcggaaagacgtccatcggccttctgtgtgtgatggctagctctgccctgctctggatggcctccgtggagccccattggatcgctgcgagcattatcctggagttctttcttatggtcctgctcattccggagcctgacagacagcggacaccccaggataaccaactggcctacgtggttatcgggctcctgttcatgattcttaccgtggctgccaatgagatgggactgctggaaaccaccaagaaggacctcggcatcgggcacgtcgccgtggagaaccaccatcacgctaccatgctggatgtcgaccttcatcctgcctctgcgtggacactgtacgccgtggctacgaccattatcacacccatgatgcgccacaccatcgaaaacacaaccgccaatatttccctcacggctatcgccaaccaggcggccattctgatgggactggataaaggctggcctatcagcaagatggacattggcgttcccctccttgctctggggtgctattctcaggtgaatccgctgaccctcacagccgctgtcctgatgcttgtggcccattacgctatcatcggacctggcctgcaagccaaagcgaccagagaggcccagaagcggacagctgccgggattatgaagaaccccaccgttgatggaatcgtggctattgacctcgatcccgtcgtgtatgacgccaaatttgaaaagcagctgggccagatcatgctgctcattctttgtacgagccaaatcctgctgatgcgcacaacctgggccctctgcgagtccatcacactggcgaccgggcctcttaccacactgtgggagggatctccgggcaaattctggaatacgaccattgctgtgagcatggccaacatctttagaggctcctacctcgctggggccggactggccttcagcctgatgaagtccctcggcgggggacggcgcggcacaggggctcagggagaaacccttggcgagaaatggaagagacagctgaatcagctgtctaagagcgagttcaacacatataaacggtccggcattatggaggttgacagatctgaagccaaggaggggctccgccggggagagaccacgaaacacgcggtcagcagaggcacagccaagctgcgctggtttgtggaacggaatcttgtgaaacccgaggggaaggtcatcgatctgggatgtggcagagggggatggtcctactattgcgctggcctcaagaaagttaccgaagtgaagggctacaccaaagggggacctggccacgaggaacccattcctatggccacatacgggtggaacctggtgaagctgcattctggaaaagacgtcttctttattccccctgagaagtgtgataccctcctttgcgacattggcgagagctccccgaatcccacaatcgaagaggggcgcacgctgcgggtgctgaaaatggttgaaccttggctcagaggaaaccaattctgtatcaagattctgaatccctatatgcctagcgtggtcgagacccttgagcacatgcagcgcaagcatggcggcatgctggtgcggaaccccctctctagaaattccacacacgaaatgtactgggttagctgcgggaccggaaacatcgtgtctgctgtcaatatgacatcccgcatgctgctgaaccggtttaccatggcccacagaaaaccgacgtatgagcgcgatgtggacctcggcgcggggaccagacatgtggccgtcgaacctgaggttgctaacctggatattatcggacagcggattgaaaatatcaagcacgagcataaaagcacatggcactacgacgaggataacccctataagacctgggcctaccatggctcttatgaagtgaaaccctccgggagcgcttccagcatggtgaatggagtcgtgaaacttctgacaaagccttgggacgttatccccatggtgacccagattgccatgacagataccacgcctttcggccaacagcgcgtctttaaagagaaggtggacacaagaaccccgaaagctaagcggggcaccgcccagatcatggaagttacagcgagatggctctgggggttcctgtctcggaacaaaaagccccgcatttgtacgagagaggaatttacccggaaggtgcgcagcaatgccgctatcggagccgtcttcgtggacgagaaccaatggaactccgctaaagaggccgttgaagatgagagattttgggaccttgtgcaccgggaacgcgagctgcacaagcagggcaaatgcgccacatgcgtctacaacatgatggggaagagagagaagaagctcggagagttcggcaaggcgaaagggtctcgggctatttggtacatgtggctgggcgcccgctttctggagttcgaagccctcggattcatgaatgaggatcattggtttagcagagaaaactccctgtctggcgtggagggggagggacttcacaagctgggctatatcctccgggacatcagcaaaattcctgggggaaatatgtacgctgatgacaccgccggctgggatacacgcatcaccgaagacgatctgcagaacgaggctaagattacagacatcatggaacccgagcatgcccttctggcgacctccattttcaaactcacgtatcagaataaggtcgtgagagttcaacggcctgccaaaaacgggaccgtgatggatgtcatctctcgcagagaccagcggggcagcggacaggtgggcacatacgggctgaatacctttacaaacatggaagctcagctgatcagacaaatggagtccgagggaattttcagcccctctgaactcgagaccccgaacctggccgaacgcgtgcttgattggctggagaagtatggcgttgaacggctcaagagaatggctatctccggggacgactgtgtggtcaaacctattgatgaccgctttgccacggcgctgacagcccttaatgatatgggaaaggtgcggaaagacatcccccagtgggagcctagcaagggctggaacgattggcagcaggttcccttctgctctcaccactttcatcaactgattatgaaagacgggagagagatcgtggtcccttgtcgcaatcaggatgaactcgtgggccgggctagagtctcccagggagccggctggagcctgcgcgagaccgcttgcctggggaagtcctacgcccagatgtggcaactcatgtatttccaccggagagacctgcgccttgctgccaacgcgatttgttctgccgtgcccgttgattgggtgccgacaagccggaccacgtggtccatccatgctcaccatcagtggatgaccacagaagacatgctgagcgtctggaatagagtgtggatcgaggaaaacccttggatggaggataagacccacatttcttcctggggagacgttccctacctcggcaaacgggaggaccagtggtgcgggagcctgatcggacttacagccagagccacctgggctacaaatattcaagtggccatcaaccaggtccgccggctgattggcaatgaaaactacctcgattatatgacctctatgaagagatttaaaaatgagagcgaccccgaaggggcgctgtggtga

SEQ ID NO: 19131 - RNA, 9879 nt, synthetic construct
  misc_feature 1..9879: note = derived and/or modified CDS sequence (opt5) from DENV-1__FJ898424__SS-prME
  source 1..9879: mol_type = other RNA
agcgtgaccatgctgctcatgctgatgcccaccgctcttgctttccacctgacgaccagaggcggggaacctcatatgatcgtctccaagcaggaacggggaaagtctctcctgtttaagaccagcaccggcgttaatatgtgcacccttatcgccatggacctgggggagctctgtgaagataccatgacatacaagtgcccgagaatcaccgaggtggaacccgacgatgtggactgttggtgcaatacgaccgatacatgggtcacctatggaacatgttcccaaaccggcgagcacagacgggacaagcgctctgtggcgctggctcctcatgttgggctgggactcgagacgagagccgaaacatggatgagctccgagggcgcctggaaacagattcagaaggtggaaacctgggctctgcggcaccccggcttcacagtcatcgccctttttctggctcatgccattgggacctctatcacccagaagggaatcattttcatcctcctgatgcttgtgacacctagcatggcgatgcgctgcgttggcattgggtccagagattttgtggagggactgagcggcgccacgtgggtcgacgtggtgctcgagcacgggtcttgtgtcaccacaatggctaaagataagcccaccctggacatcgaactgctcaaaacagaggttaccaaccctgccgtgctgcggaaactttgcattgaagctaaaatctccaatacgacaaccgatagccgctgtccgacccaaggagaggccacactggtggaagaacaggacgcgaacttcgtctgcagacggacctttgtggatcgcggctggggcaatgggtgtggactcttcggcaaggggtctctgattacatgcgccaagtttaaatgcgttacgaaacttgagggaaaaatcgtgcagtacgaaaacctgaagtattccgtcatcgtgaccgttcacacaggcgaccagcatcaagtggggaatgagagcaccgaacacggaacaaccgctacgattacaccccaggcccctacatctgagatccagctcaccgactacggcgctctgacactggattgttcccccagaaccggcctcgacttcaacgaaatggtcctgcttacgatgaaagaaaagtcctggctggtgcataaacagtggtttctcgatctgcctcttccctggacatccggggcctctaccagccaagagacatggaatcggcaggacctgctcgtcaccttcaagaccgcccacgctaagaaacaggaagtggttgtgctgggatcccaagagggcgcgatgcacacagccctgacgggggctaccgaaattcagacaagcggaaccacaaccatctttgccggccatctcaagtgccgcctgaaaatggataaacttacgctgaaagggatgtcttatgtcatgtgtacaggctccttcaagctcgagaaggaagtggccgagacccagcacggaaccgttctggtgcagattaaatacgagggcacagacgctccgtgcaagatccctttcagcacccaagatgaaaaaggggtcacacagaacggaagactgatcacggccaatcccattgtgaccgacaaggagaaacctgtgaacatcgaagcggagccgccctttggcgagtcttatattgttatcggggctggagaaaaggcccttaagctcagctggttcaaaaagggctcctctattgggaaaatgtttgaggccacagctcggggcgccagacgcatggctatcctgggagataccgcctgggacttcggcagcatcgggggagtctttacatccgtgggcaagctggtgcatcagattttcgggaccgcgtacggagtcctctttagcggcgtgtcttggacgatgaaaatcgggattggcgttctgcttacctggctgggactcaattcccggagcacatctctgtccatgacctgtatcgccgtgggcctggtcacactttacctcggggtgatggttcaggctgatagcggatgcgtgattaactggaagggcagagaactgaagtgtgggtccggaatcttcgtcaccaatgaggtgcacacatggaccgaacaatataaatttcaggccgactctcctaagcgcctgagcgctgccattggcaaagcgtgggaggagggggtttgcggcatccggtccgccacgagactcgaaaacatcatgtggcgccagatttctaacgagctgaatcatatccttctggaaaacgacatgaagttcacagtggtcgtgggagatgtggtcggcattctcgctcaggggaaaaagatgatccggccgcaacccatggagcacaaatacagctggaagtcctggggaaaggccaaaattatcggcgctgacgttcagaataccacctttatcattgatgggcctaacacacccgaatgtcctgacgatcagagagcctggaatatctgggaggtggaggactatggattcggcatttttaccacgaacatctggctgaagctgcgcgatagctacacacaggtgtgcgaccaccggcttatgtctgccgctattaaagattccaaggcggtccatgccgacatgggctattggatcgaaagcgagaaaaatgaaacctggaagctcgctagagcctctttcatcgaggtgaagacatgtatttggcccaaatcccacaccctgtggagcaacggggttctggaatctgagatgatcattccgaagatctacggaggccctattagccaacataattatcgccccgggtacttcacacagaccgccggaccttggcacctcggcaaactggagcttgattttgacctgtgcgaagggacgaccgtggtcgtggatgagcactgcggaaaccggggcccctccctcagaacaaccacagttaccggcaagatcatccatgaatggtgttgccggagctgtacgctgcctcccctgcgcttcaaaggggaggacggatgctggtacggcatggagattagaccggtgaaggaaaaggaggaaaatcttgtcaaatctatggtgtccgctgggagcggagaggttgactccttttctctcggcctgctgtgtatcagcattatgatcgaagaggtgatgcggtccagatggtctcgcaagatgctcatgacagggaccctggccgtcttctttcttctgattatgggacagctcacatggaacgatctgatccggagctgcattatggtgggcgcgaatgcttccgacagaatgggcatggggaccacctatctggcccttatggccacattcaaaatgcgccctatgtttgctgtgggactcctgttcagacggctgacgtctcgcgaggtcctcctgcttaccatcggcctgagcctcgttgcctccgtggaactgcccaacagcctggaggaacttggggatggactggcgatgggcatcatgattctcaagctgctcacagactttcaatcttaccagctgtgggctacccttctgtccctcacattcatcaaaaccacgtttagcctgcactatgcctggaagacaatggccatggtgctgtctattgtctcccttctgcccctctgtctgagcaccacctctcagaagacaacctggctccctgtgctgcttgggtccctgggatgcaaaccgctgacaatgttcctcatcgctgagaataagatttggggcagaaaaagctggcccctgaacgaaggcatcatggccgttgggatcgtgtccattcttctgagctctctcctgaagaacgatgtccctctcgctggacccctgatcgccggcgggatgcttattgcgtgttacgtgatcagcggatcctctgccgacctgagcctggagaaagctgccgaggtttcctgggaagaggaagctgagcattctggcgccagccacaatattctcgtggaagtccaggatgacgggacgatgaagatcaaagatgaggagcgggacgataccctgacaatccttctgaaggccaccctcctggctgtgtccggagtctatcctctctctattcccgcgacactgtttgtgtggtacttctggcaaaagaaaaagcagcgcagcggcgttctttgggacacccctagccctcccgaagtggagagagccgtcctggatgacggcatctatcggattatgcagcgcgggctgctcggaagaagccaggtgggcgttggggtgttccaagaaaacgtctttcatacgatgtggcacgtgacccggggagctgtgctgatgtaccagggcaaacgccttgagccctcttgggcctccgttaagaaagacctgatcagctacgggggaggctggagactccagggctcttggaatacaggggaggaagtccaggtgattgccgtggagcccggaaagaaccctaagaatgtccaaaccgctcccggcacattcaaaaccccggaaggggaggtgggagccatcgcgctggattttaagcctggcacatccgggagccccattgttaaccgggaaggaaaaatcgtgggcctctatggcaatggggtcgtgacgacctccggaacatacgtttctgctatcgcccaggccaaggctagccaggagggccctctgcccgagattgaagacgaggtgttcagaaaacgcaaccttaccatcatggatctgcaccccgggtccggaaagacccggagatatctgcctgccattgtccgcgaagcgatcaagcggaaactcagaacactgattcttgctccgacgcgcgtggttgccagcgagatggccgaagctctgaagggcatgcccatccggtaccaaaccacagccgtgaaatctgagcataccgggagagagatcgtcgacctcatgtgccacgctacatttaccatgcgcctgctgtcccctgtgcgggtgcccaattataacatgattatcatggatgaagcccatttcacggaccctagctctattgcggccagaggctacatcagcacacgggtcggaatgggcgaggctgccgctatttttatgaccgccacaccccctgggtccgttgaagccttcccgcagtctaatgctgtgatccaggatgaggaacgcgacatccccgagagaagctggaactccggatatgagtggattacagattttcctggcaagaccgtgtggttcgtcccctctatcaaaagcgggaatgacattgcgaactgtctccggaagaatggaaagcgcgtgatccagctttccagaaaaacatttgataccgaataccaaaagacgaaaaacaacgactgggactacgttgtgacaaccgatattagcgagatgggcgccaatttccgggctgacagagtcatcgatcctcgccggtgcctgaagcccgtgattctgaaagacgggccggaaagagttatcctcgccggccctatgcccgtgacagtcgcctctgctgcccagcgccggggaagaatcggccgcaaccacaataaggagggggatcagtatatttacatgggacagcccctgaacaatgacgaggatcatgcgcactggaccgaagctaagatgcttctggacaacatcaatacgcctgagggcattatccccgccctcttcgaacctgagcgggaaaaatccgccgctattgatggggagtatagactgcgcggagaggccagaaagacctttgtggaactgatgcggcgcggcgacctcccggtctggcttagctacaaagtggcgtccgaggggttccaatattctgatagacggtggtgctttgacggcgaacgcaacaatcaggttctggaggaaaacatggatgtggagatctggacaaaggagggagaacgcaagaagctgcggcccagatggctcgacgcccgcacctacagcgaccctctggcccttcgggagttcaaagaatttgccgctggcagacgctccgtgtctggggatctgatcctcgagattggaaagctgccccagcacctgacacagcgggcccaaaatgctctcgacaaccttgtcatgctgcataatagcgaacagggcgggagagcctatcggcacgcgatggaggagctgcctgataccatcgaaacactcatgctgcttgccctgattgctgttctcaccggaggcgtgacgctgttctttctgtccggccgcgggctcggaaagacaagcatcggccttctgtgtgtgatggcctcttccgctctgctctggatggccagcgtcgagccccattggattgccgcttctatcatcctggagttctttcttatggtgctgctcattccggagcctgacagacagcggacaccccaggataaccaactggcgtacgttgtgatcgggctcctgttcatgattcttaccgtcgccgctaatgagatgggactgctggaaacaaccaaaaaggacctcggcatcgggcacgtggccgtcgagaaccaccatcacgccacaatgctggatgtggaccttcatcctgcttccgcctggacgctgtacgcggttgccaccacaattatcacccccatgatgcgccacacaattgaaaacaccacggctaatatcagcctcaccgccatcgctaaccaggccgcgattctgatgggactggataaaggctggcctatctctaagatggacattggcgtgcccctccttgccctggggtgctatagccaggtcaatccgctgacactcaccgctgccgtgctgatgcttgttgctcattacgccatcattggacctggcctgcaagctaaagccacaagagaggcgcagaagcggaccgccgctgggatcatgaagaaccccacggtggatggaatcgtcgccattgacctcgatcccgtggtgtatgacgctaaatttgaaaagcagctgggccagatcatgctgctcattctttgtacatcccaaatcctgctgatgcgcaccacatgggccctctgcgagtctattaccctggccaccgggcctcttacaacgctgtgggagggaagcccgggcaaattctggaataccacaatcgcggtttccatggctaacatctttagaggcagctacctcgccggggctggactggccttctccctgatgaagtctctcggcgggggacggcgcggcaccggggcccagggagaaacacttggcgagaaatggaagagacagctgaatcagctgagcaagtccgagttcaacacctataaacggtctggcattatggaggtcgacagaagcgaagctaaggaggggctccgccggggagagacgacaaaacacgccgtgtccagaggcaccgcgaagctgcgctggtttgtggaacggaatcttgtcaaacccgaggggaaggttatcgatctgggatgtggcagagggggatggtcttactattgcgccggcctcaagaaagtgaccgaagtgaagggctacacaaaagggggacctggccacgaggaacccattcctatggctacctacgggtggaacctggtcaagctgcatagcggaaaagacgtgttctttattccccctgagaagtgtgatacactcctttgcgacattggcgagtccagcccgaatcccacgatcgaagaggggcgcaccctgcgggttctgaaaatggtggaaccttggctcagaggaaaccaattctgtattaagatcctgaatccctatatgccttctgtcgtggagacacttgagcagatgcagcgcaagcacggcggcatgctggttcggaaccccctctccagaaatagcacccatgaaatgtactgggtgtcttgcgggacaggaaacatcgtctccgccgtgaatatgaccagccgcatgctgctgaaccggtttacgatggctcacagaaaaccgacctatgagcgcgatgtggacctcggcgccgggacaagacacgtcgcggttgaacctgaggtggccaacctggatattatcggacagcggattgaaaatatcaagcatgagcacaaatctacctggcattacgacgaggataacccctataagacatgggcttaccacggctcctatgaagtgaaacccagcgggtccgccagctctatggtcaatggagtggttaaacttctgaccaagccttgggacgtgattcccatggtcacacaaatcgctatgaccgatacgacacctttcggccagcagcgcgtgtttaaagagaaggttgacaccagaaccccgaaagccaagcggggcacagctcaaatcatggaagtgacggccagatggctctgggggttcctgagccggaacaaaaagccccgcatttgtaccagagaggaatttacacggaaggtccgctccaatgcggccatcggagctgtgttcgttgacgagaaccagtggaactctgccaaagaggctgtggaagatgagagattttgggaccttgtccatcgggaacgcgagctgcacaagcagggcaaatgcgctacctgcgtgtacaacatgatggggaagagagagaagaagctcggagagttcggcaaggccaaagggagccgggcgatttggtacatgtggctgggcgctcgctttctggagttcgaagccctcggattcatgaatgaggatcactggttttccagagaaaactctctgagcggcgtcgagggggagggacttcataagctgggctatatcctccgggacatttccaaaatccctgggggaaatatgtacgccgatgacacagctggctgggatacccgcatcacagaagacgatctgcagaacgaggccaagattaccgacatcatggaacccgagcacgcccttctggccacgtctattttcaaactcacctatcaaaataaggtggttagagtgcagcggcctgcgcgcaacgggacagtcatggatgtgatcagcagacgggaccagagaggctccggacaggtgggcacctacgggctgaatacatttaccaacatggaagcccaactgattcgccagatggagagcgagggaatcttctctccctccgaactcgagacgccgaacctggctgaacgggttcttgattggctggagaaacatggcgtggaaagactcaagcgcatggccatcagcggggacgactgtgtcgtgaagcctattgatgaccggtttgctacagccctgtctgcgcttaatgatatgggaaaagttagaaaggacatcccccagtgggagccttccaaaggctggaacgattggcagcaagtgcccttctgcagccaccactttcatcagctgattatgaaggacgggcgcgagatcgtcgtgccttgtcggaatcaggatgaactcgtcggcagagcccgcgtgtcccagggagctggctggtctctgcgggagaccgcctgcctggggaaaagctatgctcaaatgtggcagctcatgtacttccacagacgcgacctgcggcttgccgctaacgccatttgttccgcggttcccgtggattgggtcccgacaagcagaaccacgtggtctatccatgcccaccatcagtggatgaccacagaagacatgctgtccgtgtggaatcgggtttggattgaggaaaacccttggatggaggataagacccacatcagctcttggggagacgtgccctatctcggcaagagagaggaccaatggtgcgggagcctgatcggacttacagctcgcgccacctgggccacaaatattcaggtcgctatcaaccaggtgcggagactgattggcaatgaaaactacctcgattacatgacctccatgaaacgctttaagaatgagtctgaccccgaaggggccctgtggtga

SEQ ID NO: 19132 - RNA, 9879 nt, synthetic construct
  misc_feature 1..9879: note = derived and/or modified CDS sequence (opt5) from DENV-1__FJ898425__SS-prME
  source 1..9879: mol_type = other RNA
agcgtgaccatgctgctcatgctgatgcccaccgcccttgctttccacctgacgacccggggcggggaacctcatatgatcgtcaccaagcaggaacggggaaaatccctcctgtttaagacctctgccggcgttaacatgtgcacccttattgccatggacctgggggagctctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcattggcaaactggttcatcagatcttcgggaccgcttacggagtcctcttttccggcgtgagctggacgatgaagattgggatcggcgtgctgcttacctggctgggactcaattctagatccacaagcctgtctatgacctgtattgccgtcggcctggtgacactttacctcggggttatggtgcaggctgattccggatgcgtcatcaactggaaaggccgcgaactgaagtgtgggagcggaattttcgtgaccaatgaggttcacacatggaccgaacaatataagtttcaggccgactcccctaaacggctgtctgcggccatcggcaaggcttgggaggagggggtgtgcggcatcagaagcgccacgcgcctcgaaaacattatgtggaaacagatctccaacgagctgaatcatattcttctggaaaacgacatgaagttcacagtcgtggttggagatgtggtcggcatcctcgctcaggggaaaaagatgattcggccgcaacccatggagcacaaatactcttggaaaagctggggaaaggccaagatcatcggcgccgacgtgcagaataccacctttattatcgatgggcctaacacacccgaatgtcctgacgatcagagagcttggaatatttgggaggtggaggactatggattcggcatctttaccacgaacatttggctgaagatgcgcgattcctacacacaggtctgcgaccaccggctgatgagcgcggccatcaaagattctaaggctgttcatgccgacatgggctattggatcgaatccgagaaaaatgaaacctggaaacttgccagagctagcttcattgaggtgaagacatgtatctggcccaaatctcacaccctctggtccaacggggtgctggaaagcgagatgattatcccgaagatttacggaggccctatctctcaacataattatcgccccgggtacttcacacagaccgccggaccttggcacctgggcaaactcgagctggattttgacctttgcgaagggacgaccgtcgtggttgatgagcactgcggaaaccggggccccagcctgagaacaaccacagtgaccggcaagatcattcatgaatggtgttgccggtcctgtacgctccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgacagggaccctcgctgtgttcctgcttctgatcatgggacagctcacatggaacgatctgattcggctgtgcatcatggttggcgccaatgcctctgacagaatgggcatggggaccacctatcttgctctgatggccacatttaaaatgcgccctatgttcgcggtgggactcctgtttagacggctcacgagccgcgaggtcctgcttctgaccatcggcctctccctggtggcttctgtggaactgcccaacagccttgaggaactgggggatggactcgccatgggcattatgatcctgaagctcctgacagacttccaatcccaccagctttgggccaccctgctcagcctgacatttattaaaaccacgctgtctcttcattacgcttggaagacaatggccatggtcctgtccatcgttagcctcattcccctgtgtctctctaccacctcccagaagacaacctggctgcctgtgcttctggggagcctgggatgcaaaccgctcacaatgttcctgatcgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgattagcggatctagcgccgacctgtccctcgagaaagctgccgaggtctcttgggaagaggaagccgagcacagcggcgcttcccataatatcctggtggaagttcaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacgatgtggcacgtgacccggggagccgtccttatgtatcagggcaaacgcctggagccttcctgggctagcgtgaagaaagacctcatttcttacgggggaggctggagactgcagggctcctggaatacaggggaggaagtgcaggttatcgccgtcgagcccggaaagaaccctaagaatgtgcaaaccgcgcccggcacattcaaaaccccggaaggggaggtgggagctattgccctcgattttaagcctggcacaagcgggtctcccatcgtcaaccgggaaggaaaaatcgtgggcctgtacggcaatggggttgtgacgacctccggaacatatgtcagcgccattgctcaggccaaggcgtcccaggagggccctcttcccgagatcgaagacgaggtgttcagaaaacgcaacctgaccattatggatctgcatcccgggtctggaaagacccggagatacctccctgctatcgttcgcgaagccattaagcggaaactgagaacacttatcctggccccgacgcgcgtggtcgctagcgagatggccgaagctctcaagggcatgcccatccggtatcaaaccacagccgtgaaatccgagcacaccgggaaggagattgttgacctgatgtgccatgcgacatttaccatgagactgctcagccctgtgcgcgtccccaattacaacatgatcattatggatgaagcccacttcacggacccttcttccatcgctgcccggggctatattagcacaagagtgggaatgggcgaggctgccgccatctttatgaccgctacaccccctgggtctgtggaagcgttcccgcagagcaatgccgtcatccaggatgaggaacgggacattcccgagcgctcctggaactctggatacgagtggatcacagattttcctggcaaaaccgtttggttcgtgcccagcattaagtccgggaatgacatcgctaactgtcttagaaagaatggaaaacgggtgattcagctgtctcgcaagacatttgataccgaatatcagaagacgaagaacaacgactgggactacgtcgtgacaaccgatatcagcgagatgggcgccaatttcagagccgaccgggttattgatcctagacgctgcctgaaacccgtgatcctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacgcctgagggcatcattcccgctctgtttgaacctgagcgcgaaaagagcgccgcgatcgatggggagtaccggctgagaggagaggcccgcaaaaccttcgtggaactcatgagacggggcgaccttccggtctggctgtcttataaggtggcttccgaggggttccaatacagcgatcgcagatggtgctttgacggcgaacggaacaatcaggtcctggaggaaaacatggatgtggagatctggacaaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacgctgttctttctctctggccgggggcttggaaaaacaagcattggcctgctgtgtgttatggcctccagcgtgctcctgtggatggcctctgtggagccccactggatcgctgcgtccatcattcttgagttctttctgatggtcctcctgatcccggagcctgaccgccagagaacaccccaggataaccaactggcctatgtggttattgggctccttttcatgatcctgaccgtggctgccaatgagatgggactgctcgaaacaaccaagaaagacctgggcattgggcacgtcgccgtggagaaccatcaccatgctacaatgcttgatgtcgacctgcaccctgccagcgcgtggacgctctacgccgtggctaccacaatcattacccccatgatgcggcatacaatcgaaaacaccacggccaatatctctctgaccgctattgccaaccaggcggccatcctgatgggactcgataagggctggcctatttccaaaatggacatcggcgttccccttctggctctggggtgctacagccaggtgaatccgctcacactgaccgccgctgtccttatgctggtggcccactatgctattatcggacctggcctccaagccaaggcgacacgcgaggcccagaagagaaccgctgccgggatcatgaaaaaccccacggttgatggaattgtggctatcgacctggatcccgtcgtgtacgacgccaagtttgaaaaacagctgggccagattatgctccttatcctgtgtacatctcaaattctgctcatgcggaccacatgggccctgtgcgagagcatcacccttgcgaccgggcctctgacaacgctctgggagggatccccgggcaagttctggaataccacaatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatctacaagagaagcggcattatggaggttgaccggtccgaagccaaagaggggctgaagagaggagagaccacgcgccacgcggtctctcggggcacagccaaacttagatggttcgtggaacgcaatctggtgaagcccgaggggaaggtcatcgatctcggatgtggcagagggggatggagctattactgcgctggcctgaaaaaggttaccgaagtgaaaggctataccaaagggggacctggccatgaggaacccattcctatggccacatacgggtggaacctggtgaaactccactccggaaaggacgtcttctttacaccccctgagaaatgtgatacacttctgtgcgacatcggcgagtctagcccgaatcccacgattgaagaggggagaaccctgcgcgtgctcaagatggttgaaccttggctgcggggaaaccaattctgtatcaagatccttaatccctacatgccttccgtggtcgagacactggagcagatgcagagaaaacatggcggcatgctcgtgcgcaaccccctgagcagaaattctacccacgaaatgtattgggtttcctgcgggacaggaaacattgtgagcgctgtcaatatgacctctagaatgctgctcaaccgctttacgatggcccaccggaagccgacctacgagaaagatgtggacctgggcgcggggacaagacatgtggccgtcgaacctgaggttgctaaccttgatatcattggacagcgcatcgaaaatattaagcacgagcataaatccacctggcactatgacgaggataacccctacaagacatgggcctatcatggcagctacgaagtgaagccctctgggtccgctagctccatggtgaatggagtcgtgaaactgctcaccaagccttgggacgttatccccatggtgacacaaatcgccatgaccgatacgacacctttcggccagcagagagtctttaaagagaaggtggacacccggaccccgaaagctaagcgcggcacagttcaaattatggaagtgacggccagatggctgtgggggttccttagccggaacaagaaacccagaatctgtacccgggaggaatttacacgcaaggtcagatctaatgcggccattggagctgtgttcgttgacgagaaccagtggaatagcgccaaagaggctgtggaagatgagcggttttgggacctggtccagaaggaacgcgagctccacaaacagggcaagtgcgcgacctgcgtgtataacatgatggggaagagagagaagaagctgggagagttcggcaaagccaaggggtcccgggcgatctggtacatgtggctgggcgctcgctttctcgagttcgaagccctgggatttatgaatgaggatcactggttctctagagaaaacagcctttccggcgtcgagggggagggactgcataaactcggctacattctgcgggacatctctaagatccctgggggaaatatgtatgccgatgacacagctggctgggatacccgcattacagaagacgatcttcaaaacgaggccaaaatcaccgacattatggaacccgagcacgctctgctcgccacgagcatcttcaagctgacctaccagaataaggtggttagagtgcagcggcctgcgaaaaacgggacagtcatggatgtgatttcccgcagagaccagcggggctctggacaagtgggcacctatgggctgaatacatttaccaacatggaagcccagctcatccgccagatggagagcgagggaatcttcctgccctccgaacttgagacgccgaacctggctgaaagagttctcgattggctggagaagtacggcgtggaacggcttaaaagaatggccattagcggggacgactgtgtcgtgaagcctatcgatgaccgctttgctacagccctgaccgcgctcaatgatatgggaaaagttcggaaggacattccccagtgggagccttctaagggctggaacgattggcaacaggtgcccttctgctcccatcactttcaccagctgatcatgaaagacgggagagagattgtcgtgccttgtcgcaatcaggatgaactggtcggccgggccagagtgagccaaggagctggctggtctctccgcgagacagcctgcctggggaagtcctatgctcagatgtggcagcttatgtacttccatcggagagacctgcgcctcgccgctaacgccatctgtagcgcggttcccgtggattgggtcccgacctcccggacgacctggtctattcacgcccatcaccaatggatgacaaccgaagacatgctgagcgtgtggaatagagtttggatcgaggaaaacccttggatggaggataaaacacatgtgtccagctggggagacgtcccctatcttggcaagcgcgaggaccagtggtgcgggtctctgatcggactcaccgctcgggccacatgggcctccaatattcaggtggctatcaaccaggtgagacggctgattggcaatgaaaactacctggattacatgaccagcatgaaaagatttaagaatgagggggaccccgaaggcgccctctggtga

SEQ ID NO: 19133 - RNA, 9879 nt, synthetic construct
  misc_feature 1..9879: note = derived and/or modified CDS sequence (opt5) from DENV-1__FJ898426__SS-prME
  source 1..9879: mol_type = other RNA
agcgtgaccatgctgctgatgctgatgcccacagcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgagaatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcgccaaccctgcggttctccgcaaactgtgcattgaagccaagatctccaatacaaccacggatagcagatgtccgacacaaggagaggctacccttgtggaagaacaagacgccaactttgtgtgccggcgcaccttcgtcgatagaggctggggcaatgggtgtggactgtttggcaaagggtctctcattacatgcgctaagttcaagtgcgtgaccaaactggagggaaagatcgttcagtacgaaaaccttaaatattccgtgatcgtcacagtgcacacgggcgaccagcatcaagttgggaatgagagcaccgaacacggaacaaccgccacaattacaccccaggccccttctacggagatccagctgaccgactacggcgctctcacactggattgtagcccccggaccggcctggactttaacgaaatggtgctcctgacaatgaaggagaaaagctggcttgtccataagcagtggttcctggatctccctctgccctggacctccggggcgtctacgagccaagagacatggaatcgcaaagaccttctggtgacctttaagacagcccacgctaagaaacaggaagtcgtggttctcggatcccaggagggcgccatgcacaccgccctgaccggggctacagaaattcaaacgagcggaaccacaaccatcttcgccggccatctgaagtgcagactcaaaatggataagctgacacttaaagggatgtcttatgtgatgtgtaccggctccttcaagctggagaaggaagtcgcggagacgcagcacggaacagtgctcgttcagattaaatacgagggcaccgacgctccgtgcaagatcccttttagcacccaggatgaaaaaggggtgacacaaaacggacggctgatcaccgccaatcccattgtcacagacaaggagaaacctgtgaacatcgaagccgagccgcccttcggcgagtcttatattgtgatcggggctggagaaaaggccctgaaacttagctggtttaaaaagggctcctctattgggaaaatgttcgaggctacggccagaggcgcgcgccggatggccatcctcggagataccgcttgggactttggcagcatcgggggagttttcacatccgtcggcaagctggtgcatcagatttttgggaccgcctacggagtgctgttcagcggcgtctcttggacaatgaaaatcgggattggcgtgctcctgacctggcttggactcaattccagaagcacgtctctctccatgacctgtatcgctgttggcctggtgacactgtaccttggggtcatggtgcaggccgatagcggatgcgttattaactggaagggccgcgaactcaagtgtgggtccggaatctttgtgaccaatgaggtccacacatggaccgaacagtataaattccaagcggactctcctaagcggctgagcgccgctattggcaaagcctgggaggagggggtgtgcggcatcagatccgctacacgcctggaaaacatcatgtggaagcagatttctaacgagctcaatcatatcctgcttgaaaacgacatgaaatttaccgttgtggtcggagatgtggccggcattctggcccaggggaagaaaatgatccggccgcagcccatggagtacaagtatagctggaagtcctggggaaaagctaagattatcggcgcggacgtgcaaaatacgacattcatcattgatgggcctaacacccccgaatgtcctgacgatcagagagcctggaatatctgggaggtcgaggactacggatttggcattttcaccacaaacatctggctcaaactgcgcgatagctatacccaggtttgcgaccaccggctgatgtctgctgccattaaggattccaaagccgtgcacgctgacatgggctactggatcgaaagcgagaagaatgaaacgtggaaacttgccagagcgtctttcatcgaggtgaaaacatgtatttggcccaagtcccataccctctggagcaacggggtcctggaatctgagatgatcattccgaaaatctatggaggccctattagccagcacaattaccgccccgggtactttacacaaaccgctggaccttggcatctgggcaagctcgagctggatttcgacctttgcgaagggacaaccgtggttgtggatgagcactgcggaaaccggggcccctccctgagaacgaccacagtcaccggcaaaatcatccacgaatggtgttgccggagctgtacactccctcccctgcgctttaagggggaggacggatgctggtatggcatggagattagaccggtgaaggaaaaagaggaaaatctggttaagtctatggtgtccgccgggagcggagaggtcgactccttctctcttggcctcctgtgtatcagcattatgatcgaagaggtgatgcggtccagatggtctcgcaaaatgctgatgaccgggacgctcgccgtctttttcctgcttattatgggacagctgacatggaacgatctcatccggctgtgcattatggtgggcgctaatgccagcgacagaatgggcatggggaccacatacctggcgcttatggctacctttaagatgcgccctatgttcgccgtcggactgctctttagacggctgacctcccgcgaggtgctcctgcttacaatcggcctgtctctcgtggccagcgtcgaactgcccaactccctggaggaacttggggatggactggctatgggcatcatgattctcaaactgctcacggacttccagagccatcaactgtgggccacccttctgtctctcacatttatcaagaccacattctccctgcactatgcttggaagaccatggccatggttctgagcattgtgtctctttttcccctgtgtctctccacgacaagccagaaaaccacctggctgcctgtgctcctggggtctcttggatgcaagccgctgacaatgttcctgatcgcggagaataaaatttggggcagaaagtcctggcccctcaacgaaggcatcatggccgtcgggatcgtgagcattctgctttccagcctgctcaaaaacgatgttcctctggctggacccctcatcgccggcgggatgctgattgcttgttacgtgatctctggaagctccgccgacctttctctggagaaggccgctgaggtcagctgggaagaggaagcggagcattccggcgcctctcacaatattctggtggaagttcaggatgacgggaccatgaaaatcaaggatgaggagcgggacgatacactcacgatcctgcttaaggctaccctgctcgccgtgagcggagtctatcctctgtccattcccgccacactcttcgtgtggtacttttggcagaaaaagaaacaacgctctggcgtcctgtgggacaccccttcccctcccgaagtggagagagctgttcttgatgacggcatctatcggattatgcagcgcgggctgctgggaagatcccaggtgggcgtcggggtgttccaggaaaacgtttttcatacaatgtggcacgtgacccggggagccgtcctcatgtaccaaggcaagcgcctggagcccagctgggcgtctgtgaaaaaggaccttatctcctacgggggaggctggagactgcagggcagctggaatacgggggaggaagtgcaggttattgctgtcgagcccggaaagaaccctaaaaatgtgcagaccgcccccggcacattcaagacctctgaaggggaggtgggagccatcgctctcgattttaaaccgggcacatccgggagccctattgtcaaccgggaaggaaagatcgtgggcctgtatggcaatggggttgtgaccacatccggaacgtacgtctctgccatcgcgcaagctaaagccagccaggagggccccctccctgagattgaagacgaggtgttcagaaagcgcaacctgaccatcatggatcttcaccccgggtccggaaagacacggagatatctgcccgccattgttcgcgaagctatcaaacggaagctgagaaccctcattctggcccctacccgcgtggtcgctagcgagatggccgaagcgcttaaaggcatgccgatccggtaccagacaacggccgtgaagtctgagcataccgggaaagagatcgttgacctgatgtgccacgctacatttaccatgagactcctgtcccccgtgcgcgtccctaattataacatgattatcatggatgaagcccatttcacagaccccagctctattgctgcccggggctacatcagcaccagagtgggaatgggcgaggccgctgcgatttttatgacggccacacctcccgggtccgtggaggctttccctcaatctaatgccgtcatccaggatgaagaacgggacatcccggagcgcagctggaactccggatatgagtggattaccgattttcccggcaagaccgtttggttcgtgccttctatcaagagcgggaatgacattgccaactgtctgcgcaagaatggaaagcgggtgatccagctctcccgcaaaacattcgataccgaataccagaagaccaagaataacgactgggactacgtcgtgaccacggatattagcgagatgggcgctaattttagagccgaccgggttatcgatcccagacgctgccttaagcctgtgattctgaaggacgggcccgaacgggtcatcctggcgggcccgatgcctgtgacagttgcttctgccgcccaaagacgcggacggatcggcagaaaccacaataaagagggggatcagtatatttacatgggacagcccctcaacaatgacgaggatcatgctcactggaccgaagccaagatgctgcttgacaacatcaatacacccgagggcattatccctgcgctgttcgaacccgagcgcgaaaaatccgccgctattgatggggagtatcggctcagaggagaggcccgcaagacctttgtggaactgatgagacggggcgacctgcctgtctggctcagctacaaagtggcttccgaggggttccagtattctgatcgcagatggtgctttgacggcgaacggaacaatcaagtccttgaggaaaacatggatgtggagatctggacgaaggagggagaacgcaaaaagctgagaccgcggtggctggacgccagaacctacagcgaccccctcgctctgcgcgagttcaaggaatttgccgcgggccggagatccgtttctggggatcttatcctggagattggaaaactccctcagcacctgacacagcgcgcccagaatgctctggacaacctcgtgatgcttcataatagcgaacaaggcgggcgggcctatagacacgctatggaggagctgcccgataccatcgaaacactgatgctcctggcccttattgccgtgctgaccggaggcgtcacactcttctttctgtccggccgggggctgggaaagaccagcatcggcctcctttgtgttatggcttcttccgtgctgctgtggatggcgagcgtggagcctcattggattgccgcttctatcatcctcgagttctttctgatggtccttctgattcccgagccggaccgccagagaacgcctcaggataaccagctcgcctacgtggttatcgggctgctgttcatgattctcacagtggccgctaatgagatgggacttctggaaaccaccaaaaaggacctgggcatcgggcacgtcgccgtggagaaccaccatcacgcggccatgctcgatgtcgacctgcatcccgcttccgcctggacactttacgctgtggccaccacaattatcacgcctatgatgcggcacaccattgaaaacacaaccgcgaatatcagcctgacagccatcgctaaccaagccgctattctcatgggactggataaaggctggcccatctctaagatggacattggcgttcctctgctcgcccttgggtgctatagccaggtgaatcccctgaccctgacggctgccgtcctcatgctggtggcgcattacgccatcattggaccgggccttcaggctaaggccacccgcgaggctcagaagagaacagccgccgggatcatgaagaaccctaccgttgatggaatcgtggcgattgacctggatcccgtcgtgtatgacgctaaatttgaaaagcagctcggccagatcatgctgctgattctctgtacatcccagatccttctgatgcggaccacgtgggccctgtgcgagtctattacactcgctaccgggcccctgacaaccctttgggagggaagccctggcaaattctggaataccacaatcgccgtgtccatggccaacatcttccgcggcagctacctggctggggccggactcgcgttttccctgatgaagtctctgggcgggggaagacggggcacgggggcccaaggagaaaccctcggcgagaagtggaaacgccagcttaatcagctgagcaagtccgagttcaacacatataaaagatctggcattatggaggttgaccggagcgaagctaaggaggggctgaaaagaggagagaccacaaagcacgccgtctcccgcggcaccgctaagctccggtggtttgtggaaagaaatctggtgaaaccggaggggaaggtcatcgatcttggatgtggccgcgggggatggtcttactattgcgccggcctgaaaaaggttacggaagtgaaaggctacacaaaagggggacccggccacgaggaacctattcccatggcgacctacgggtggaacctcgtgaaactgcatagcggaaaggacgtcttctttatccctcccgagaagtgtgataccctgctctgcgacattggcgagtccagccctaatccgacaatcgaagaggggcggacccttagagtgctgaaaatggttgaaccctggctgcgcggaaaccagttctgtattaagatcctcaatccttatatgccctctgtggtcgagacactggagcaaatgcagcggagacacggcggcatgcttgtgcgcaaccctctgtcccggaatagcacgcatgaaatgtactgggtttcttgcgggaccggaaacatcgtgtccgccgtcaatatgacaagcagaatgctcctgaaccgctttaccatggctcaccggaaacccacatatgagagagatgtggacctgggcgccgggacccgccacgtggctgtcgaaccggaggttgccaacctcgatattatcggacagagaattgaaaatatcaagcatgagcacaaatctacgtggcattacgacgaggataacccttataagacctgggcttaccacggctcctatgaagtgaagcccagcgggtccgccagctctatggtgaatggagtcgtgaaactgcttacaaagccctgggacgttattcctatggtgacccagatcgcgatgacagataccacacccttcggccaacagcgggtctttaaagagaaggtggacacccgcacgcctaaagccaagagaggcacagctcagatcatggaagttaccgccaagtggctgtgggggttcctcagccggaacaaaaagccgagaatttgtacccgggaggaatttacacgcaaagtgagatccaatgctgccatcggagccgtcttcgtggacgagaaccaatggaactctgcgaaggaggctgttgaagatgagcggttttgggacctggtgcatcgcgaaagagagcttcacaaacagggcaagtgcgccacgtgcgtctacaacatgatggggaagcgggagaaaaagctgggagagttcggcaaagccaaggggagccgcgctatttggtacatgtggctcggcgccagattcctggagtttgaagctctgggattcatgaatgaggatcactggttttcccgggaaaactctctcagcggcgtggagggggagggactgcataaacttggctatatcctgcgcgacatttccaagatccccgggggaaatatgtacgccgatgacaccgcgggctgggatacaagaatcaccgaagacgatctccagaacgaggccaaaattacagacatcatggaacctgagcacgctctgcttgccaagtctattttcaagctgacctatcagaataaagtcgtgcgggttcaacgccccgctaagaacgggacagtgatggatgtcatcagcagacgggaccagcgcggctccggacaggtgggcacctacgggctcaatacgtttaccaacatggaagcccagctgattagacaaatggagagcgagggaatcttctctccttccgaactggagacacccaacctcgcgggccgggtgctggattggcttgaaaaacatggggttgagagactgaagcgcatggccatcagcggagacgactgtgtggtcaaaccgattgatgaccggtttgctaccgccctcacagctctgaatgatatgggcaaggtgagaaaggacatccctcagtgggaaccctctaaagggtggaacgattggcagcaggttcctttctgctcccaccactttcatcaacttattatgaaggacggccgcgagatcgtggtcccctgtcggaatcaggatgagctggtgggcagagcccgcgtcagccagggcgctgggtggtccctccgggaaaccgcctgcctgggaaaatcttatgcgcagatgtggcaactgatgtacttccacagacgcgacctccggctggccgctaacgccatttgtagcgccgtgcctgttgattgggtgcccacgtccagaacaacctggagcatccatgctcaccatcagtggatgacaaccgaggacatgctttctgtctggaatcgcgtgtggattgaagagaacccgtggatggaagataagacgcacatctccagctggggcgacgttccttatctggggaaacgggaggaccagtggtgcggatctctcatcggcctgaccgccagagcgacatgggctaccaatattcaagtggccatcaaccaggtccggagacttattgggaatgagaactacctggattacatgacaagcatgaagcgctttaagaatgaatccgaccccgagggcgccctctggtga

SEQ ID NO: 19134 - RNA, 9879 nt, synthetic construct
  misc_feature 1..9879: note = derived and/or modified CDS sequence (opt5) from DENV-1__GQ199856__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaaatctctcctgtttaagacaagcgccggcgttaatatgtgcacccttgtggcgatggacctgggggagttctgtgaagatacaatgacctacaaatgcccgcgcatcacagaagctgaacccgacgatgtggactgttggtgcaatgccaccgatacgtgggtcacctatggaacatgttcccagaccggcgaacaccggcgggacaagcgctctgtggccctcgctcctcatgttgggctgggactggagacaagaaccgaaacgtggatgagctccgagggcgcctggaaacagatccagcgggtggaaacatgggctctccgccaccccggctttaccgtcattgccctgttccttgcgcatgccatcgggacatctattacccagaagggaatcatctttattctgctcatgctggtgacccctagcatggctatgagatgcgttggcatcgggtcccgggatttcgtggagggacttagcggcgccacatgggtcgacgtggtgctggagcacgggtcttgtgtcacgaccatggctaaggataaacccacactcgacattgaactgctgaagaccgaggttacaaaccctgccgtgctccgcaaactgtgcatcgaagcgaagatttccaataccacgacagatagcagatgtccgacccaaggagaggccacccttgtggaagaacaggacgctaactttgtctgccggcgcacattcgtggatagaggctggggcaatgggtgtggactgtttggcaaagggtctctcattacctgcgccaagttcaagtgcgttacaaaactggagggaaagacggtgcagtacgaaaaccttaaatattccgtcattgtgaccgttcacacaggcgaccagcatcaagtggggaatgagagcaccgaacacggaacaaccgctacgatcacaccccaggccccttctacagagatccagctgaccgactacggcgccctcacactggattgtagcccccggaccggcctggactttaacgaaatggtcctcctgacgatgaaggagaaaagctggcttgtgcataagcagtggttcctggatctccctctgccctggacatccggggcttctaccagccaagagacatggaatcgcaaagaccttctggtcacctttaagaccgcgcacgccaagaaacaggaagtggttgtgctcggatcccaggagggcgctatgcacacagccctgacgggggccaccgaaattcaaacaagcggaaccacaaccatcttcgctggccatctgaagtgcagactcaaaatggataagctgacgcttaaagggatgtcttatgtcatgtgtacaggctccttcaagctggagaaggaagtggccgagacccagcacggaaccgttctcgtgcagattaaatacgagggcacagacgcgccgtgcaagatcccttttagcacccaggatgaaaaaggggtcacacaaaacggacggctgattacggctaatcccatcgtgaccgacaaggagaaacctgtgaacatcgaagccgagccgcccttcggcgagtcttatattgttatcggggccggagaaaaggctctgaaacttagctggtttaaaaagggctcctctattgggaaaatgttcgaggccacagctagaggcgcccgccggatggcgatcctcggagataccgcctgggactttggcagcattgggggagtcttcacatccgtgggcaagctggtgcatcagatctttgggaccgcttacggagtcctgttcagcggcgtgtcttggacgatgaaaatcgggattggcgttctcctgacctggcttggactcaattccagaagcacatctctctccatgacctgtatcgccgtgggcctggtcacactgtaccttggggtgatggttcaggctgatagcggatgcgtgattaactggaagggccgcgaactcaagtgtgggtccggaatctttgtcaccaatgaggtgcacacatggaccgaacagtataaattccaagccgactctcctaagcggctgagcgcggccattggcaaggcttgggaggagggggtttgcggcatcagatccgccacgcgcctggaaaacattatgtggaagcagatctctaacgagctcaatcatatcctgcttgaaaacgacatgaaatttacagtggtcgtgggagatgtggctggcattctggcccaggggaagaaaatgatccggccgcagcccatggagtacaagtatagctggaagtcctggggaaaagccaagattatcggcgctgacgtccaaaataccaccttcattatcgatgggcctaacacacccgaatgtcctgacgatcagagagcgtggaatatctgggaggttgaggactacggatttggcattttcaccacgaacatctggctcaaactgcgcgatagctatacacaggtgtgcgaccaccggctgatgtctgccgctattaaggattccaaagccgtgcacgccgacatgggctactggatcgaaagcgagaagaatgaaacctggaaacttgctagagcctctttcattgaggtcaagacatgtatctggcccaagtcccataccctctggagcaacggggtgctggaatctgagatgatcattccgaaaatctatggaggccctattagccagcacaattaccgccccgggtactttacacaaaccgcgggaccttggcatctgggcaagctcgagctggatttcgacctttgcgaagggacgaccgttgtggtcgatgagcactgcggaaaccggggcccctccctgagaacaaccacagtgaccggcaaaatcattcacgaatggtgttgccggagctgtacgctccctcccctgcgctttaagggggaggacggatgctggtatggcatggagatcagaccggttaaggaaaaagaggaaaatctggtgaagtctatggtctccgctgggagcggagaggtggactccttctctcttggcctcctgtgtatcagcattatgatcgaagaggttatgcggtccagatggtctcgcaaaatgctgatgacagggaccctcgccgtgtttttcctgcttattatcggacagctgacatggaacgatctcattcggctgtgcatcatggtcggcgccaatgctagcgacagaatgggcatggggaccacctacctggcccttatggcgacatttaagatgcgccctatgttcgctgtgggactgctctttagacggctgacgtcccgcgaggtgctcctgcttaccattggcctgtctctcgtcgccagcgttgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggtgctgagcatcgtgtctctttttcccctgtgtctctccaccaccagccagaaaacaacctggctgcctgtcctcctggggtctcttggatgcaagccgctgacaatgttcctgattgccgagaataaaatctggggcagacggtcctggcccctcaacgaaggcattatggcggtggggatcgttagcatcctgctttccagcctgctcaagaacgatgtgcctctggccggacccctcattgctggcgggatgctgatcgcctgttacgtcatttctggaagctccgctgacctttctctggagaaagccgccgaggtgagctgggaagaggaagctgagcattccggcgcgtctcacaatatcctggttgaagtgcaggatgacgggacgatgaagattaaagatgaggagcgcgacgataccctcacaatcctgcttaaggccaccctgctcgctgtcagcggagtgtatcctctgtccatccccgccacactcttcgtctggtacttttggcagaagaaaaagcaaagatctggcgtgctgtgggacaccccttcccctcccgaagttgagcgggccgtgcttgatgacggcatttatcgcatcatgcagagagggctgctgggacggtcccaggtcggcgtgggggttttccaggaaaacgtgtttcatacgatgtggcacgtcacccgcggagctgtgctcatgtaccaaggcaaaagactggagcccagctgggcctctgtgaagaaagaccttatttcctacgggggaggctggcggctgcagggcagctggaatacaggggaggaagttcaggtcatcgcggtggagcccggaaagaaccctaagaatgtgcagaccgctcccggcacattcaaaacctctgaaggggaggtcggagccattgccctcgattttaagccgggcacatccgggagccctatcgtgaacagagaaggaaaaattgttggcctgtatggcaatggggtggtcacgacctccggaacatacgtgtctgctatcgcccaagcgaaggctagccaggagggccccctccctgagatcgaagacgaggttttccgcaaacggaacctgaccattatggatcttcaccccgggtccggaaagaccagacgctatctgcccgccatcgtgcgggaagccattaagagaaaactgcgcacactcatcctggctcctacgcgggtcgtggccagcgagatggctgaagcccttaagggcatgccgattagataccagaccacagcggttaaatctgagcataccgggaaggagatcgtggacctgatgtgccacgccacatttaccatgcgcctcctgtcccccgtccgggtgcctaattataacatgatcattatggatgaagctcatttcacggaccccagctctatcgccgctagaggctacattagcacacgggtgggaatgggcgaggccgccgctatctttatgaccgcgacccctcccgggtccgtcgaagccttccctcaatctaatgctgttattcaggatgaggaacgcgacatcccggagagaagctggaactccggatatgagtggatcacagattttcccggcaaaaccgtgtggttcgtgccttctattaagagcgggaatgacatcgccaactgtctgcggaagaatggaaaacgcgtcattcagctctccagaaagacattcgataccgaataccagaaaacgaagaacaacgactgggactacgtggttacaaccgatatcagcgagatgggcgccaattttcgggctgacagagtgattgatccccgccggtgccttaaacctgtcatcctgaaggacgggcccgaaagagtgattctggccggcccgatgcctgttacagtggcgtctgctgcccaacgccggggaagaatcggccgcaaccacaataaggagggggatcagtatatctacatgggacagcccctcaacaatgacgaggatcatgcccactggaccgaagctaaaatgctgcttgacaacattaatacgcccgagggcatcattcctgccctgttcgaacccgagcgggaaaagtccgcggccatcgatggggagtatagactccgcggagaggctagaaaaacctttgtcgaactgatgcggcgcggcgacctgcctgtgtggctcagctacaaggtcgcctccgaggggttccagtattctgatagacggtggtgctttgacggcgaacgcaacaatcaagtgcttgaggaaaacatggatgttgagatttggacaaaagagggagaaagaaagaaactgcggccgagatggctggacgctcgcacctacagcgaccccctcgccctgcgggagttcaaggaatttgctgccggcagacgctccgtgtctggggatcttatcctggagatcggaaagctccctcagcacctgacacagcgggcgcagaatgccctggacaacctcgtgatgcttcataatagcgaacaaggcgggagagcttatcggcacgccatggaggagctgcccgataccattgaaacactgatgctcctggctcttatcgccgtcctgaccggaggcgttacgctgttctttctgtccggccgcgggctgggaaaaacaagcattggcctcctttgtgtgatggcctcttccgtgctgctgtggatggctagcgtcgagcctcattggatcgcggcctctattatcctcgagttctttctgatggtgcttctgatccccgagccggacagacagcggacccctcaggataaccagctcgcttacgttgtgattgggctgctgttcatgatcctcaccgtcgccgccaatgagatgggacttctggaaacaaccaagaaagacctgggcattgggcacgtggctgtcgagaaccaccatcacgccgcgatgctcgatgtggacctgcatcccgcctccgcttggacactttacgccgttgctacgaccatcattacacctatgatgcgccacaccatcgaaaacacaaccgccaatattagcctgacggcgatcgccaaccaagctgccatcctcatgggactggataagggctggcccatttctaaaatggacatcggcgtgcctctgctcgctcttgggtgctatagccaggtcaatcccctgaccctgacagccgctgtgctcatgctggttgcccattacgcgattatcggaccgggccttcaggccaaggctaccagagaggcccaaaagcggacagctgccgggattatgaaaaaccctaccgtggatggaatcgtcgccatcgacctggatcccgtggtgtatgacgcgaagtttgaaaaacagctcggccagattatgctgctgatcctctgtacgtcccagattcttctgatgcgcacaacctgggctctgtgcgagtctatcacactcgccaccgggcccctgaccacactttgggagggaagccctggcaagttctggaatacgaccattgctgtttccatggccaacatcttcagaggcagctacctggccggggctggactcgccttttccctgatgaaatctctgggcgggggacggcgcggcacaggggcgcaaggagaaaccctcggcgagaagtggaagagacagcttaatcagctgagcaaatccgagttcaacacatataagcggtctggcatcatggaggtcgacagaagcgaagccaaagaggggctgaagcgcggagagaccacgaaacacgctgtgtcccggggcacagccaagctcagatggtttgtggaacgcaatttcgtcaagccggaggggaaagttattgatctgggatgtggcagagggggatggtcttactattgcgctggccttaagaaagtgaccgaagtgaagggctacaccaaagggggacccggccacgaggaacctatccccatggccacatacgggtggaacctggtcaagctccatagcggaaaagacgtgtttttcattcctcccgagaagtgtgataccctgctgtgcgacatcggcgagtccagccctaatccgacaattgaagaggggagaacgctccgcgttcttaagatggtggaaccctggctgcggggaaaccagttttgtatcaaaattctgaatccttatatgccctctgtcgtggagaccctcgagagaatgcaacgcaagcacggcggcatgctggttcggaaccctctttccagaaatagcacacatgaaatgtactgggtgtcttgcgggaccggaaacatcgtctccgcggtgaatatgacaagccgcatgctgctcaaccggttcaccatggcccacagaaaacccacgtatgagcgcgatgtggacctgggcgctgggaccagacacgtcgccgttgaaccggaggtggctaacctggatatcattggacagcggatcgaaaatattaagcatgagcacaaactcacatggcattacgacgaggataacccttataagacctgggcctaccacggctcttatgaagtgaagccctccgggagcgcttccagcatggtcaatggagtggttaaactgcttacaaagccctgggacgtgatccctatggtcacccagattgccatgacagataccacgccctttggccagcaacgcgtgttcaaagagaaggttgacacaagaacccctaaagcgaagcggggcaccgcccagatcatggaagtgacagctaagtggctgtgggggtttctctctagaaacaaaaagccgcggatctgtacgcgcgaggagttcaccagaaaagtccggagcaatgccgctattggagccgtgtttgttgacgagaaccagtggaactccgccaaggaggcggtggaagatgagcgcttctgggacctggtccatagagaacgggagcttcacaaacaaggcaagtgcgctacatgcgtgtacaacatgatggggaagcgcgagaaaaagctgggagagttcggcaaagccaaggggtctagagccatctggtacatgtggctcggcgctcggtttctggagttcgaagccctgggatttatgaatgaggatcactggttcagccgcgaaaactccctctctggcgtcgagggggagggactgcataaacttggctatattctgagagacatcagcaagattcccgggggaaatatgtacgctgatgacaccgccggctgggatacacggatcaccgaagacgatctccagaacgaggcgaaaatcacagacattatggaacctgagcacgccctgcttgctaagtccatctttaagctgacctatcagaataaagtggttcgcgtgcagagacccgccaagaacgggacggtcatggatgtgatttctcggcgcgaccaaagaggcagcggacaggtgggcacctacgggctcaatacattcaccaacatggaagctcagctgatccggcagatggagtccgagggaatttttagcccttctgaactggagacacccaacctcgccggcagagttctggattggcttgaaaaacatggggtggagcgcctgaagcggatggcgatctccggagacgactgtgtcgtgaaaccgatcgatgacagattcgccaccgctctcacggccctgaatgatatgggcaaggttcgcaaggacattcctcaatgggaacccagcaaagggtggaacgattggcaacaggtgcctttttgctctcaccacttccatcagcttatcatgaaggacggccgggagattgtcgtgccctgtagaaatcaagatgagctggtcggacgcgctcgggtgtcccagggcgccgggtggagcctcagagaaacagcttgcctgggaaaatcctatgcccagatgtggcagctgatgtactttcaccgccgggacctcagactggcggccaacgctatctgttctgccgttcctgtggattgggtccccaccagccgcacaacctggtccattcatgcccaccatcaatggatgacgaccgaggacatgcttagcgtgtggaatcgggtttggatcgaagagaacccgtggatggaagataagacacacatttcttcctggggcgacgtgccttatctggggaaaagagaggaccagtggtgcggaagcctcatcggcctgaccgctcgggccacatgggcgaccaatatccaggtcgctattaaccaagtgagacgccttatcgggaatgagaactacctggattacatgacatctatgaagcggttcaagaatgaaagcgaccccgagggcgccctctggtga

SEQ ID NO: 19135 - RNA, 9879 nt, synthetic construct
  misc_feature 1..9879: note = derived and/or modified CDS sequence (opt5) from DENV-1__FJ898427__SS-prME
  source 1..9879: mol_type = other RNA
agcgtgaccatgctgctcatgctgatgcccaccgcccttgctttccacctgacgaccagaggcggggagcctcatatgatcgtgacaaagcaggaacggggaaaatccctcctgtttaagacctctgccggcgttaatatgtgcacccttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattgtgcttggaagacaatggccatggtgctctccatcgctagcctgttccccctctgcctgtctaccacctcccagaagacaacctggcttcctgtgctgctggggagcctcggatgtaaaccgctgacaatgtttcttattacggagaccaagatctggggcagaaaatcttggcccctgaatgaaggcattatggccgtcggggtggtttccatcctcctgagctccctcctgaagaacgatgtgcctcttgcgggacccctgatcgccggcgggatgctgattgcttgctacgtcatcagcggatctagcgccgacctctccctggagaaagctgccgaggtgtcttgggaagaggaagccgagcacagcggcgcttcccataacattcttgttgtggtccaggatgacgggacaatgaagatcaaagatgaggaacgggacgataccctgacaattctcctgaaggcgaccctcctggccgtgtctggagtctatcctcttagcatccccgctacgctgttcgtgtggtacttttggcaaaagaaaaagcagcgctccggcgttctgtgggacaccccttctcccccggaggtggaaagagccgtcctcgatgacggcatctatcggattatgcagcgcgggctgcttggaagaagccaggtgggcgttggggtgttccaagagaatgtcttccacacaatgtggcacgtgacccggggagccgtgctgatgtaccagggcaaacgcctcgaaccttcctgggctagcgttaagaaagacctgatctcttatgggggaggctggagactccagggctcctggaacacaggggaggaggtccaggtgattgccgtggaacccggaaagaatcctaagaacgtccaaaccgcgcccggcacatttaaaacgccggagggggaagtgggagctatcgccctggatttcaagcctggcaccagcgggtctcccattgttaatcgggagggaaaaatcgtgggcctttacggcaacggggtcgtgacaacctccggaacctacgttagcgccattgctcaggccaaggcgtcccaggaaggccctctgcccgagatcgaggacgaagtgtttagaaaacgcaatctgacaatcatggatctccatcccgggtctggaaagacgcggagatatctgcctgctattgtccgcgaggccatcaagcggaaacttagaaccctgattctcgccccgacacgcgtggttgctagcgaaatggccgaggctctgaagggcatgcccatccggtaccaaaccacagccgtgaaatccgaacacaccgggaaggagattgtcgacctgatgtgtcatgcgacgttcacaatgagactccttagccctgtgcgcgtgcccaactataatatgatcatcatggatgaggcccactttaccgacccttcttccattgctgcccggggctacatcagcaccagagtcggaatgggcgaagctgccgccattttcatgacagctacaccccctgggtctgttgaggcgtttccgcagagcaacgccgtgatccaggatgaggaacgggacattcccgaacgctcctggaactctggatatgagtggatcacagatttccctggcaaaaccgtgtggtttgtccccagcatcaagtccgggaacgacattgctaattgcctgagaaagaacggaaaacgggtgatccagctgtctcgcaagacgttcgatacagagtaccagaagaccaagaataacgactgggactatgttgtgacaaccgatattagcgaaatgggcgccaactttagagccgaccgggtcatcgatcctagacgctgcctcaaacccgtgattctgaaggacgggccggagcgggttatccttgctggccctatgcccgtgacggtcgcctccgcggctcagagacgcggacggattggcagaaatcataacaaggaaggggatcagtacatctacatgggacagcccctgaataacgacgaggatcacgcccactggaccgaggccaaaatgctcctggacaatatcaacacacctgaaggcattatccccgctctgttcgagcctgaacgcgaaaagagcgccgcgattgatggggaatatcggctcagaggagaggcccgcaaaaccttcgtggagcttatgagacggggcgacctgccggtctggctgtcttacaaggtggcttccgaagggtttcaatatagcgatcgcagatggtgtttcgacggcgagcggaataaccaggttctcgaagagaatatggatgtggaaatctggacaaaagagggagagcgcaagaaactgagaccccggtggcttgacgccagaacctactccgaccctctggctctccgcgaatttaaggagttcgccgctggccggagatctgtgagcggggatctgattctggaaatcggaaagctcccccagcatcttacacagcgcgcccaaaacgcgctggacaatctggtcatgctccacaactccgagcagggcgggcgggcctatagacatgctatggaggaactgcctgataccatcgagacgcttatgctgctcgccctgattgctgttctgacaggaggcgtgaccctctttttcctttctggccgggggctgggaaaaaccagcatcggcctgctctgcgtgatggcctccagcgtcctgctttggatggcctctgtggaaccccactggattgctgcgtccatcattctggagtttttcctcatggttctgctgatcccggaacctgaccgccagagaacaccccaggataatcaactcgcctacgtggtcatcgggcttctgtttatgattctgaccgtggctgccaacgagatgggactcctggagacaacgaagaaagaccttggcatcgggcacgtcgccgtggaaaatcatcaccatgctaccatgctggatgttgacctccaccctgccagcgcgtggacactgtatgccgtggctaccacaattatcacccccatgatgcggcatacgattgagaacaccacagccaacatctctctgaccgctattgccaatcaggcggccatcctcatgggacttgataagggctggcctatctccaaaatggacattggcgtccccctgctggctctcgggtgttacagccaggtgaacccgctgacacttaccgccgctgttctgatgctcgtggcccactacgctatcattggacctggcctgcaagccaaggcgacgcgcgaagcccagaagagaacagctgccgggatcatgaaaaatcccaccgtcgatggaattgtggctatcgacctggatcccgtggtttatgacgccaagttcgagaaacagctcggccagatcatgcttctgattctgtgcacatctcaaatcctcctgatgcggaccacctgggccctttgtgaaagcattacactggcgacggggcctctcaccacactgtgggagggatccccgggcaagttttggaacaccacaatcgctgtctctatggccaatattttccgcggcagctacctggctggggccggactcgccttttcccttatgaaaagcctgggcgggggaagacggggcaccggggctcagggagagacgctgggcgaaaagtggaagcgccagctcaaccagctgtccaaatctgagttcaatatctataagagaagcggcatcatggaagtggaccggtccgaggccaaagaagggcttaagagaggagagacaacccgccacgcggtgtctcggggcaccgccaaactgagatggttcgtcgagcgcaacctcgttaagcccgaagggaaggtgattgatctgggatgcggcagagggggatggagctactattgtgctggcctgaaaaaggtgacagaggtcaaaggctacaccaaagggggacctggccatgaggagcccatccctatggccacatatgggtggaatctcgtgaaacttcactccggaaaggacgtctttttcacgccccctgaaaaatgcgataccctgctgtgtgacattggcgagtctagcccgaaccccacaatcgaggaagggagaaccctccgcgtgctgaagatggtcgagccttggcttcggggaaatcaattttgcattaagatcctgaacccctacatgccttccgtggttgaaacactcgagcagatgcagagaaaacatggcggcatgctggtgcgcaatcccctgagccggaactctacccacgagatgtactgggtctcctgtgggacgggaaatattgtgagcgctgtgaacatgacctctagaatgctcctgaatcgcttcacaatggcccaccggaagccgacctatgaaagagatgtcgaccttggcgcggggacacgccatgttgccgtggagcctgaagtggctaacctggatatcatcggacagagaattgagaacatcaaacacgaacataagtccacctggcactacgacgaggataatccctataaaacatgggcctaccatggcagctatgaggtcaagccctctgggtccgctagctccatggtgaacggagttgtgaagctcctgaccaaaccttgggacgtcattcccatggtgacgcaaatcgccatgacagataccaccccttttggccagcagcgggttttcaaggaaaaagtggacacacgcacgccgaaggctaaaagaggcaccgcccaaattatggaggtcacagcgcggtggctttgggggtttctgagcagaaataagaagccccggatctgcacccgcgaagagttcacaagaaaagtgcggtctaacgccgctatcggagccgtttttgtggacgaaaatcagtggaacagcgctaaggaggccgtcgaggatgaacgcttctgggacctcgtgcagaaagagagagaactgcacaagcagggcaaatgcgccacctgtgtctacaatatgatggggaagcgggagaagaaactgggagaatttggcaaggcgaaagggtcccgcgctatttggtatatgtggctcggcgccagattcctggagtttgaggcccttggattcatgaacgaagatcactggttctctcgggagaatagcctgtccggcgtggaaggggagggactccataagctgggctacatccttcgcgacatttctaaaatccctgggggaaacatgtacgctgatgacacagccggctgggataccagaattacggaggacgatctgcaaaatgaagctaagatcaccgacatcatggagcccgaacacgccctcctggcgacaagcatttttaaactgacctatcagaacaaggttgtgcgggtccagcgccctgccaagaatgggacagtgatggatgtgatctccagacgggaccagcgcggctctggacaagttggcacctacgggctcaacacgttcacaaatatggaggctcagctgattagacagatggaaagcgagggaatctttcttccctccgagctggaaaccccgaacctcgccgagcgggtgctggattggcttgaaaaatatggcgtcgagagactgaagcgcatggctattagcggggacgactgcgtggttaaacctatcgatgaccggttcgccacagcgctcaccgccctgaacgatatgggaaaggtgagaaaagacatcccccagtgggaaccttctaagggctggaatgattggcaacaggtccccttttgttcccatcacttccaccagctgattatgaaggacgggcgcgagatcgtggtcccttgccggaaccaggatgagctcgtgggcagagctcgcgttagccaaggagccggctggtctctgcgggaaacggcttgtcttgggaaatcctacgcccagatgtggcagctgatgtattttcatagacgcgacctccggctggctgccaatgcgatttgcagcgccgtgcccgtcgattgggtgccgacctccagaacaacctggtctatccacgctcatcaccaatggatgacaaccgaggacatgcttagcgtttggaaccgcgtgtggattgaagagaatccttggatggaagataagacacatgtctccagctggggagacgtgccctacctgggcaaacgggaggaccagtggtgtgggtctctcatcggactgaccgccagagccacgtgggcttccaacattcaggtggccatcaatcaggttcggagactgatcggcaacgagaattatctcgattacatgacaagcatgaagcgcttcaaaaacgaaggggaccccgagggcgcgctgtggtga

SEQ ID NO: 19136 - RNA, 9879 nt, synthetic construct
  misc_feature 1..9879: note = derived and/or modified CDS sequence (opt5) from DENV-1__JF937599__SS-prME
  source 1..9879: mol_type = other RNA
agcgtgaccatgctgctgatgctgatgcccacagctcttgctttccacctgacggccagaggaggggaacctcatatgatcgtctccaagcaggaacggggaaaatctctcctgtttaagaccagcgcgggcgttaacatgtgcacacttattgctatggacctgggggagttctgtgaagataccatgacatacaaatgcccgcgcatcaccgaggccgaacccgacgatgtggactgttggtgcaatgccacagatacctgggtgacgtatggaacctgttcccaaacaggcgagcacagacgggacaagcgctctgtcgctctcgcccctcatgtggggctgggactggagaccagaacagaaacctggatgagctccgagggcgcttggaaacagattcagcgggttgaaacgtgggccctccgccaccccggctttacagtgatcgcgctgttccttgcccatgctattgggacctctatcacacagaagggaatcatttttatcctgctcatgctggtcacccctagcatggccatgagatgcgtgggcattgggtcccgggatttcgttgagggacttagcggcgctacctgggtggacgtcgtgctggagcacgggtcttgtgtgacaacgatggccaaggataaacccaccctcgacatcgaactgctgaagacagaggtcaccaaccctgcggttctccgcaaactgtgcattgaagccaagatctccaatacaaccacggatagcagatgtccgacacaaggagaggctacccttgtggaagaacaagacgccaactttgtgtgccggcgcaccttcgtcgatagaggctggggcaatgggtgtggactgtttggcaaagggtctctcattacatgcgctaagttcaagtgcgtgaccaaactggagggaaagatcgttcagtacgaaaaccttaaatattccgtgatcgtcacagtgcacacgggcgaccagcatcaagttgggaatgagagcaccgaacacggaacaaccgccacaattacaccccaggccccttctacggagatccagctgaccgactacggcgctctcacactggattgtagcccccggaccggcctggactttaacgaaatggtgctcctgacaatgaaggagaaaagctggcttgtccataagcagtggttcctggatctccctctgccctggacctccggggcgtctacgagccaagagacatggaatcgccaggaccttctggtgacctttaaaacagcccacgctaagaagcaggaagtcgtggttctcggatcccaagagggcgccatgcacaccgccctgaccggggctacagaagtgcagacgagcggaaccacaaccattttcgccggccatctgaaatgcagactcaagatggataaactgacacttaaggggatgtcttatgtcatgtgtaccggctccttcaaactggagaaggaagtggcggagacgcagcacggaacagttctcgtgcagatcaagtacgagggcaccgacgctccgtgcaaaattccttttagcacccaagatgaaaagggggtcacacagaacggacggctgatcaccgccaatcccatcgtgacagacaaagagaagcctgtgaacattgaagccgagccgcccttcggcgagtcttatatcgttattggggctggagaaaaagccctgaaacttagctggtttaagaaaggctcctctatcgggaagatgttcgaggctacggccagaggcgcgcgccggatggccattctcggagataccgcttgggactttggcagcatcgggggagtcttcacatccgtgggcaaactggtgcatcagatctttgggaccgcctacggagtcctgttcagcggcgtgtcttggacaatgaagattgggatcggcgttctcctgacctggcttggactcaattccagaagcacgtctctctccatgacctgtattgctgtgggcctggtcacactgtaccttggggtgatggttcaggccgatagcggatgcgtgatcaactggaaaggccgcgaactcaagtgtgggtccggaatttttgtcaccaatgaggtgcacacatggaccgaacaatataagttccaggcggactctcctaaacggctgagcgccgctatcggcaaggcctgggaggagggggtttgcggcattagatccgctacacgcctggaaaacatcatgtggaaacagatctctaacgagctcaatcatattctgcttgaaaacgacatgaagctgaccgtggtcgtgggagatgtggccggcatcctcgcccaggggaaaaagatgattcggccgcaacccatggagtacaaatatagctggaagtcctggggaaaggctaaaatcattggcgcggacgtccagaatacgacatttatcatcgatgggcctaacacccccgaatgtcctgacgatcagagagcctggaatatttgggaggttgaggactacggattcggcatctttaccacaaacatttggctgaagctgcgcgatagctatacccaggtgtgcgaccaccggcttatgtctgctgccatcaaagattccaaggccgtgcacgctgacatgggctactggattgaaagcgagaaaaatgaaacgtggaagctcgccagagcgtctttcatcgaggtcaagacatgtatctggcccaaatcccataccctgtggagcaacggggtgctggaatctgagatgattatcccgaagatttatggaggccctatcagccaacacaattaccgccccgggtacttcacacagaccgctggaccttggcatctcggcaaactggagcttgattttgacctgtgcgaagggacaaccgttgtggtcgatgagcactgcggaaaccggggcccctccctcagaacgaccacagtgaccggcaagattatccacgaatggtgttgccggagctgtacactgcctcccctgcgcttcaaaggggaggacggatgctggtatggcatggagatcagaccggttaaggaaaaggaggaaaatcttgtgaaatctatggtctccgccgggagcggagaggtggactccttttctctcggcctgctgtgtattagcatcatgattgaagaggttatgcggtccagatggtctcgcaagatgctcatgaccgggacgctggccgtgttctttcttctgatcatgggacagctcacatggaacgatctgattcggctgtgcatcatggtcggcgctaatgccagcgacagaatgggcatggggaccacataccttgcgctgatggctaccttcaaaatgcgccctatgtttgccgtgggactcctgttcagacggctcacctcccgcgaggtgctgcttctgacaattggcctctctctggtcgccagcgttgaactgcccaactcccttgaggaactgggggatggactcgctatgggcatcatgatcctgaagctcctgacggactttcaaagccatcagctttgggccaccctgctctctctgacattcattagaaccacattttccctgcactatgcttggaaaaccatggccatggtgcttagcatcgtgtctctgttccccctctgtctgtccacgacaagccagaagaccacctggctccctgtcctgcttgggtctctgggatgcaagccgctgacaatgtttctcattgcggagaataaaatctggggccggaagtcctggcccctgaacgaaggcattatggccgtggggatcgttagcatccttctgtccagcctcctgaaaaacgatgtgcctctcgctggacccctgattgccggcgggatgcttatcgcttgttacgtcatttctggaagctccgccgacctgtctctggagaaggccgctgaggtgagctgggaagaggaagcggagcattccggcgcctctcacaatatcctcgttgaagtgcaggatgacgggaccatgaaaattaaggatgaggagcgcgacgatacactgacgatccttctgaaagctaccctcctggccgtcagcggagtgtatcctctctccatccccgccacactgttcgtctggtacttctggcaaaagaagaaacagagatctggcgtgctttgggacaccccttcccctcccgaagttgagcgggctgtgctggatgacggcatttatcgcatcatgcagagagggctgctcggacggtcccaggtcggcgtgggggtttttcaagaaaacgtgttccatacaatgtggcacgtcacccgcggagccgtgctgatgtaccagggcaagagacttgagcccagctgggcgtctgtgaaaaaggacctgatttcctacgggggaggctggcggctccagggcagctggaatacgggggaggaagttcaggtcatcgctgtggagcccggcaagaatcctaagaatgtgcaaaccgcccccggcacatttaagacctctgaaggggaggtcggagccattgctctggatttcaaaccgggcacatccgggagccctatcgtgaacagagaaggaaagattgttggcctctatggcaatggggtggtcaccacatccggaacgtacgtgtctgccatcgcgcaggctaaagccagccaggagggccccctgcctgagatcgaagacgaggtttttcgcaagcggaaccttaccattatggatctgcaccccgggtccggaaaaacaagacgctatctgcccgccatcgtgcgggaagctattaagagacgcctccggaccctgatccttgcccctaccagagtcgtggctagcgagatggccgaagcgctgaagggcatgccgattcgctaccaaacaacggccgttaaatctgagcataccgggaaggagatcgtggacctcatgtgccacgctacattcaccatgcggctgctgtcccccgtcagagtgcctaattataacatgatcattatggatgaagcccattttacagaccccagctctatcgctgcccggggctacattagcacccgcgtgggaatgggcgaggccgctgcgatcttcatgacggccacacctcccgggtccgtcgaggcttttcctcagtctaatgccgttattcaggatgaagaaagagacatcccggagcggagctggaactccggatatgagtggatcaccgatttccccggcaaaaccgtgtggtttgtgccttctattaagagcgggaatgacatcgccaactgtctccgcaaaaatggaaagagagtcattcagctttcccggaagacattcgataccgaataccagaagaccaagaacaacgactgggactacgtggttaccacggatatcagcgagatgggcgctaatttcagagccgaccgcgtgattgatccccggagatgcctgaaacctgtcatcctgaaggacgggcccgaacgcgtgattctcgcgggcccgatgcctgttacagtggcttctgccgcccagcggagaggacgcatcggccggaaccacaataaagagggggatcagtatatctacatgggacagcccctgaacaatgacgaggatcatgctcactggaccgaagccaagatgcttctggacaacattaatacacccgagggcatcattcctgcgctctttgaacccgagagagaaaagtccgccgctatcgatggggagtatcgcctgagaggagaggcccggaaaaccttcgtcgaactgatgcgcagaggcgacctccctgtgtggcttagctacaaggtcgcttccgaggggtttcaatattctgatcggcgctggtgcttcgacggcgaaagaaacaatcaggtgctggaggaaaacatggatgttgagatttggacgaaagagggagaacggaagaaactgagaccgcgctggctcgacgcccggacctacagcgaccccctggctcttagagagtttaaggagttcgccgcgggccgccggtccgtgtctggggatctgatcctcgagatcggaaaactgcctcagcacctgacacagagagcccaaaatgctctcgacaaccttgtgatgctgcataatagcgaacagggcgggcgggcctatcgccacgctatggaggagctgcccgataccattgaaacactcatgctgcttgccctgatcgccgtcctcaccggaggcgttacactgtttttcctgtccggcagagggctcggaaagaccagcattggccttctgtgtgtgatggcttcttccgtgctgctctggatggcgagcgtcgagcctcattggatcgccgcttctattatcctggaatttttccttatggtgctgctcatccccgagccggaccggcagcgcacgcctcaggataaccaactggcctacgttgtgattgggctgctctttatgatccttacagtcgccgctaatgagatgggactgctggaaaccaccaagaaagacctcggcattgggcacgtggccgtcgagaaccaccatcacgcggccatgctggatgtggaccttcatcccgcttccgcctggacactgtacgctgttgccaccacaatcattacgcctatgatgagacacaccatcgaaaacacaaccgcgaatattagcctcacagccatcgctaaccaggccgctatcctgatgggactggataagggctggcccatttctaaaatggacatcggcgtgcctctccttgccctggggtgctatagccaggtcaatcccctgaccctcacggctgccgtgctgatgcttgttgcgcattacgccattatcggaccgggcctgcaagctaaggccacccgggaggctcagaaacgcacagccgccgggattatgaagaaccctaccgtggatggaatcgtcgcgatcgacctcgatcccgtggtgtatgacgctaagttcgaaaaacagctgggccagattatgctgctcatcctttgtacatcccaaattctgctgatgagaaccacgtgggccctctgcgagtctatcacactggctaccgggccccttacaaccctgtgggagggaagccctggcaagttttggaataccacaattgccgtttccatggccaacatcttccggggcagctacctcgctggggccggactggcgttctccctgatgaaatctctcggcgggggacgcagaggcacgggggcccagggagaaacccttggcgagaagtggaaacggcagctgaatcagctgagcaagccggaatttaacacatataagagatccggcatcatggaggtcgaccgctctgaagctaaagaggggctcaagcggggagagaccacaaaacacgccgtgagcagaggcaccgctaagctgcgctggttcgtggaacggaatcttgtcaaacccgaggggaaggttattgatctgggatgtggcagagggggatggtcctactattgcgccggcctcaagaaagtgacggaagtgaagggctacacaaaagggggacctggccacgaggaacccatccctatggcgacctacgggtggaacctggtcaagctgcattctggaaaagacgtgtttttcattccccctgagaagtgtgataccctcctttgcgacatcggcgagagctccccgaatcccacaattgaagaggggcgcaccctgcgggttctgaaaatggtggaaccttggctcagaggaaaccaattttgtatcaagattctgaatccctatatgcctagcgtcgtggagacacttgagcagatgcagcgcaagcacggcggcatgctggttcggaaccccctctctagaaattccacgcatgaaatgtactgggtgagctgcgggaccggaaacatcgtctctgccgtgaatatgacatcccgcatgctgctgaaccggttcaccatggctcacagaaaaccgacatatgagcgcgatgtggacctcggcgccgggaccagacacgtcgctgttgaacctgaggtggccaacctggatatcattggacagcggatcgaaaatattaagcatgagcacaaaagcacgtggcattacgacgaggataacccctataagacctgggcttaccacggctcttatgaagtgaaaccctccgggagcgcctccagcatggtcaatggagtggttaaacttctgacaaagccttgggacgtgatccccatggtcacccaaattgcgatgacagataccacaccttttggccagcagcgcgtgttcaaagagaaggttgacaccagaacgccgaaagccaagcggggcacagctcaaatcatggaagtgaccgccaaatggctctgggggtttctgtctagaaacaagaagccccggatctgtacccgcgaggagttcacaagaaaagtccggagcaatgctgccattggagccgtgtttgttgacgagaaccagtggaactccgcgaaggaggctgtggaagatgagcgcttctgggaccttgtccatagagaacgggagctgcacaaacagggcaagtgcgccacgtgcgtgtacaacatgatggggaaacgcgaaaagaagctcggagagtttggcaaagccaaggggtctagagctatctggtacatgtggctgggcgcccggttcctggagttcgaagctctcggatttatgaatgaggatcactggttcagccgcgaaaactccctgtctggcgtcgagggggagggacttcataaactgggctatattctcagagacatcagcaagattcctgggggaaatatgtacgccgatgacaccgcgggctgggatacacggatcaccgaagacgatctgcagaacgaggccaaaatcacagacattatggaacccgagcacgcccttctggccaagtccatctttaaactcacctatcaaaataaggtggttcgcgtgcagagacctgctaagaacgggacagtcatggatgtgatttctcggcgcgaccagagaggcagcggacaggtgggcacctacgggctgaatacgttcaccaacatggaagcccaactgatccggcagatggagtccgagggaatttttagcccctctgaactcgagacaccgaacctggcgggcagagttcttgattggctggaaaaacatggggtggagcgcctcaagcggatggccatctccggagacgactgtgtcgtgaaacctatcgatgacagattcgctaccgccctgacagctcttaatgatatgggcaaggttcgcaaagacattccccagtgggaacctagcaaggggtggaacgattggcagcaagtgcccttttgctctcaccacttccatcagctgatcatgaaggacggccgggagattgtcgtgccttgtagaaatcaggatgagctcgtcggacgcgcccgggtgtcccagggcgctgggtggagcctgagagaaaccgcctgcctgggaaaatcctatgcgcaaatgtggcagctcatgtactttcaccgccgggacctgagacttgccgctaacgccatctgttctgccgttcccgtggattgggtcccgacgagccgcacaacctggtccattcatgctcaccatcagtggatgacaaccgaggacatgctgagcgtgtggaatcgggtttggatcgaagagaacccttggatggaagataagacgcacgtgtcttcctggggcgacgtcccctatctcgggaaaagagaggaccaatggtgcggaagcctgattggccttaccgcccgggcgacatgggctaccaatatccaggtggccatcaaccaggtgagacgcctgctcgggaatgagaactacctggattacatgacatctatgaagcggttcaaaaatgaaagcgaccccgagggcgccctgtggtga

SEQ ID NO: 19137 - RNA, 9879 nt, synthetic construct
  misc_feature 1..9879: note = derived and/or modified CDS sequence (opt5) from DENV-1__FJ898431__SS-prME
  source 1..9879: mol_type = other RNA
agcgtgaccatgctgctgatgctgatgcccaccgcccttgctttccacctgacgaccagaggcggggaacctcatatgattgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgttctgtttcttctgatcatgggacagctcacatggaacgatctgattcggctgtgcatcatggtgggcgccaatgctagcgacagaatgggcatggggaccacctaccttgccctgatggcgacattcaagatgcgccctatgtttgctgtcggactcctgttcagacggctcacgtcccgcgaggtgctgcttctgaccattggcctctctctggtggccagcgtcgaactgcccaactcccttgaggaactgggggatggactcgccatgggcatcatgatcctgaaactcctgacagactttcagagccatcaactttgggctaccctgctctctctgacattcattaagaccacgttttccctgcactatgcctggaagacaatggctatggttcttagcatcgtgtctctgttccccctctgtctgtccaccaccagccagaaaacaacctggctccctgtgctgcttgggtctctgggatgcaagccgctgacaatgtttctcattgccgagaataaaatctggggcagaaagtcctggcccctgaacgaaggcattatggcggtcgggatcgtgagcatccttctgtccagcctcctgaaaaacgatgttcctctcgccggacccctgattgctggcgggatgcttatcgcctgttacgtgatttctggaagctccgctgacctgtctctggagaaggccgccgaggtcagctgggaagaggaagctgagcattccggcgcgtctcacaatatcctcgtggaagttcaggatgacgggacgatgaaaattaaggatgaggagcgggacgataccctgacaatccttctgaaggccaccctcctggctgtgagcggagtctatcctctctccatccccgccacactgttcgtgtggtacttctggcagaaaaagaaacaacgctctggcgtcctttgggacaccccttcccctcccgaagtggagagagccgttctggatgacggcatttatcggatcatgcagcgcgggctgctcggaagatcccaggtgggcgtcggggtgtttcaggaaaacgttttccatacgatgtggcacgtgacccggggagctgtcctgatgtaccaaggcaagcgccttgagcccagctgggcctctgtgaaaaaggacctgatttcctacgggggaggctggagactccagggcagctggaatacaggggaggaagtgcaggttatcgcggtcgagcccggaaagaaccctaaaaatgtgcagaccgctcccggcacatttaagacctctgaaggggaggtgggagccattgccctggatttcaaaccgggcacatccgggagccctatcgtcaaccgggaaggaaagattgtgggcctctatggcaatggggttgtgacgacctccggaacatacgtctctgctatcgcccaagcgaaagctagccaggagggccccctgcctgagatcgaagacgaggtgtttagaaagcgcaaccttaccattatggatctgcaccccgggtccggaaagacccggagatatctgcccgccatcgttcgcgaagccattaaacggaagctcagaacactgatccttgctcctacgcgcgtggtcgccagcgagatggctgaagccctgaaaggcatgccgattcggtaccagaccacagcggtgaagtctgagcataccgggaaagagatcgttgacctcatgtgccacgccacattcaccatgagactgctgtcccccgtgcgcgtccctaattataacatgatcattatggatgaagctcattttacggaccccagctctatcgccgctcggggctacattagcacaagagtgggaatgggcgaggccgccgctatcttcatgaccgcgacccctcccgggtccgtggaagcctttcctcaatctaatgctgtcattcaggatgaggaacgggacatcccggagcgcagctggaactccggatatgagtggatcacagatttccccggcaagaccgtttggtttgtgccttctattaagagcgggaatgacatcgccaactgtctccgcaagaatggaaagcgggtgattcagctttcccgcaaaacattcgataccgaataccagaagacgaaaaacaacgactgggactacgtcgtgacaaccgatatcagcgagatgggcgccaatttcagagctgaccgggttattgatcccagacgctgcctgaagcctgtgatcctgaaggacgggcccgaacgggtcattctcgccggcccgatgcctgtgacagttgcgtctgctgcccaaagacgcggacggatcggcagaaaccacaataaagagggggatcagtatatctacatgggacagcccctgaacaatgacgaggatcatgcccactggaccgaagctaagatgcttctggacaacattaatacgcccgagggcatcattcctgccctctttgaacccgagcgcgaaaaatccgcggccatcgatggggagtatcggctgagaggagaggctcgcaagaccttcgtggaactgatgagacggggcgacctccctgtctggcttagctacaaagtggcctccgaggggtttcagtattctgatcgcagatggtgcttcgacggcgaacggaacaatcaagtcctggaggaaaacatggatgtggagatttggacaaaggagggagaacgcaaaaagctgagaccgcggtggctcgacgctagaacctacagcgaccccctggcccttcgcgagtttaaggagttcgctgccggccggagatccgtttctggggatctgatcctcgagatcggaaaactgcctcagcacctgacacagcgcgcgcagaatgccctcgacaaccttgtgatgctgcataatagcgaacaaggcgggcgggcttatagacacgccatggaggagctgcccgataccattgaaacactcatgctgcttgctctgatcgccgtgctcaccggaggcgtcacgctgtttttcctgtccggccgggggctcggaaagacaagcattggccttctgtgtgttatggcctcttccgtgctgctctggatggctagcgtggagcctcattggatcgcggcctctattatcctggaatttttccttatggtcctgctcatccccgagccggaccgccagagaacccctcaggataaccagctggcttacgtggttattgggctgctctttatgatccttaccgtggccgccaatgagatgggactgctggaaacaaccaaaaaggacctcggcattgggcacgtcgctgtggagaaccaccatcacgccgcgatgctggatgtcgaccttcatcccgcctccgcttggacactgtacgccgtggctacgaccatcattacacctatgatgcggcacaccatcgaaaacacaaccgccaatattagcctcacggcgatcgccaaccaagctgccatcctgatgggactggataaaggctggcccatttctaagatggacatcggcgttcctctccttgctctggggtgctatagccaggtgaatcccctgaccctcacagccgctgtcctgatgcttgtggcccattacgcgattatcggaccgggcctgcaggccaaggctacccgcgaggcccagaagagaacagctgccgggattatgaagaaccctaccgttgatggaatcgtggccatcgacctcgatcccgtcgtgtatgacgcgaaattcgaaaagcagctgggccagattatgctgctcatcctttgtacgtcccagattctgctgatgcggacaacctgggctctctgcgagtctatcacactggccaccgggccccttaccacactgtgggagggaagccctggcaaattttggaatacgaccattgctgtgtccatggccaacatcttccgcggcagctacctcgccggggctggactggccttctccctgatgaagtctctcggcgggggaagacggggcacaggggcgcaaggagaaacccttggcgagaagtggaaacgccagctgaatcagctgagcaagtccgaatttaacacatataaaagatctggcatcatggaggttgaccggagcgaagccaaggaggggctcaaaagaggagagaccacgaagcacgctgtctcccgcggcacagccaagctgcggtggttcgtggaaagaaatcttgtgaaaccggaggggaaggtcattgatctgggatgtggccgcgggggatggtcttactattgcgctggcctcaaaaaggttaccgaagtgaaaggctacaccaaagggggacccggccacgaggaacctatccccatggccacatacgggtggaacctggtgaaactgcatagcggaaaggacgtctttttcattcctcccgagaagtgtgataccctcctttgcgacatcggcgagtccagccctaatccgacaattgaagaggggcggacgctgagagtgctgaaaatggttgaaccctggctccgcggaaaccagttttgtatcaagattctgaatccttatatgccctctgtggtcgagacccttgagcaaatgcagcggaaacacggcggcatgctggtgagaaaccctctctcccgcaatagcacacatgaaatgtactgggtttcttgcgggaccggaaacatcgtgtccgcggtcaatatgacaagccggatgctgctgaacagattcaccatggcccaccgcaagcccacgtatgagcgggatgtggacctcggcgctgggaccagacacgtggccgtcgaaccggaggttgctaacctggatatcattggacagcgcatcgaaaatattaaacatgagcacaagtctacatggcattacgacgaggataacccttataagacctgggcctaccacggctcctatgaagtgaaacccagcgggtccgctagctctatggtgaatggagtcgtgaaacttctgacaaaaccctgggacgttatccctatggtgacccagattgccatgacagataccacgccctttggccaacagagagtcttcaaggagaaagtggacacacggacccctaaggcgaagcgcggcaccgcccagatcatggaagttacagctaaatggctctgggggtttctgagcagaaacaagaaaccgcggatctgtacgagagaggagttcacccggaaggtgcgctccaatgccgctattggagccgtctttgtggacgagaaccaatggaactctgccaaagaggcggttgaagatgagagattctgggaccttgtgcatcgggaacgcgagctgcacaagcagggcaagtgcgctacatgcgtctacaacatgatggggaaaagagaaaagaaactcggagagtttggcaaggccaaagggagccgggccatctggtacatgtggctgggcgctcgcttcctggagttcgaagccctcggatttatgaatgaggatcactggttctccagagaaaactctctgagcggcgtggagggggagggacttcataagctgggctatattctccgggacatctccaaaattcccgggggaaatatgtacgctgatgacaccgccggctgggatacacgcatcaccgaagacgatctgcagaacgaggcgaagatcacagacattatggaacctgagcacgcccttctggctaagtctatctttaaactcacctatcagaataaggtcgtgagagttcaacggcccgccaaaaacgggacggtgatggatgtcattagccgcagagaccagcggggctccggacaggtgggcacctacgggctgaatacattcaccaacatggaagctcagctgatccgccaaatggagagcgagggaatcttttctccttccgaactcgagacacccaacctggccggcagagtgcttgattggctggaaaagcatggggttgagcggctcaaaagaatggcgatcagcggagacgactgtgtggtcaagccgatcgatgaccgcttcgccaccgctctgacggcccttaatgatatgggcaaggtgcggaaagacattcctcagtgggaaccctctaaggggtggaacgattggcagcaggttcctttttgctcccaccacttccatcaactgatcatgaaagacggcagagagattgtggtcccctgtcgcaatcaggatgagctcgtgggacgggctagagtcagccagggcgccgggtggtccctgcgcgaaacagcttgcctgggaaagtcttatgcccagatgtggcaactcatgtactttcaccggagagacctgcgccttgcggccaacgctatctgtagcgccgtgcctgttgattgggtgcccacctcccggacaacctggagcattcatgcccaccatcagtggatgacgaccgaggacatgctgtctgtctggaatagagtgtggatcgaagagaacccgtggatggaagataaaacacacatttccagctggggcgacgttccttatctcgggaagcgcgaggaccagtggtgcggatctctgatcggccttaccgctcgggccacatgggcgaccaatatccaagtggctattaaccaggtcagacggctgatcgggaatgagaactacctcgattacatgacaagcatgaagagattcaaaaatgaatccgaccccgagggcgccctgtggtga

SEQ ID NO: 19138 - RNA, 9879 nt, synthetic construct
  misc_feature 1..9879: note = derived and/or modified CDS sequence (opt5) from DENV-1__GU131678__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctgctgtttaagacaagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccaaaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcatgacaaaactggaaggaaagattgtgcagtacgagaacctcaaatattccgttatcgtgacggtccacaccggcgatcagcatcaagtggggaatgaaagcacagagcacggaaccacagctaccatcacgccccaggcccctaccacagaaattcagctgaccgactacggcgccctgacactcgactgttctccccggaccggcctggatttcaacgagatggttcttctgacgatgaaggagaaatcctggctcgtgcataagcagtggtttctggaccttcctctgccctggacaagcggggcttccacctctcaagaaacatggaatcgccaggatctcctggtcaccttcaaaaccgcgcacgccaagaagcaggaggtggtcgtgctgggaagccaagaaggcgctatgcacacagccctcacgggggccaccgagatccagacatccggaaccacaaccatttttgctggccatctgaaatgcagacttaagatggacaaactgacgctcaaggggatgagctatgttatgtgtacaggctctttcaaactggaaaaggaggtggccgagacccagcacggaaccgtcctggtgcagatcaagtacgaaggcacagatgcgccgtgcaaaattcctttctccacccaagacgagaagggggttacacagaacggacggcttatcacggctaatcccatcgtgaccgataaagaaaagcctgtcaacattgaggccgagccgccctttggcgaaagctatatcgtgattggggccggagagaaagctctcaagctgtcttggttcaagaaaggcagctccatcgggaagatgtttaaagccacagctagaggcgcccgccggatggcgattctgggagacaccgcctgggatttcggctctatcgggggagtgtttacaagcgttggcaagctcgtccatcagatcttcgggaccgcttacggagtgctgttttccggcgtgagctggacgatgaaaattgggatcggcgtccttctgacctggctcggactcaattctagatccacaagcctgtctatgacctgtattgccgtgggccttgttacactctacctgggggtgatggtccaggctgactccggatgcgtgatcaactggaagggccgcgaactgaagtgtgggagcggaattttcgttaccaatgaggtgcacacatggaccgaacaatataaatttcaggccgattcccctaagcggctctctgcggccatcggcaaggcttgggaggagggggtctgcggcattagaagcgccacgcgcctggaaaacatcatgtggaagcagatctccaacgagcttaatcatattctgctcgaaaacgacatgaaattcacagtggttgtgggagacgtcgctggcatcctggtgcaggggaagaaaatgattcggccgcaacccatggagtacaagtattcttggaaaagctggggaaaagccaagatcattggcgccgatgtgcaaaattccacctttatcatcgacgggcctaacacccccgaatgtcctgatgaccagagagcttggaatatttgggaggtcgaggattacggattcggcatctttacaaccaacatttggctgaaacttcgcgacagctatacgcaggtttgcgatcaccggctcatgtctgcggccatcaaggactccaaagctgtgcacgccgatatgggctactggattgaaagcgagaagaatgaaacatggaagctggccagagcttctttcatcgaggtgaaaacctgtatctggcccaagtcccatacactgtggagcaacggggtcctcgaatctgagatgattatcccgaaaattcacggaggccctatcagccaacataattatcgccccgggtacttcacccagacagccggaccttggcacctgggcaaacttgagctggactttgatctctgcgaagggaccacggtggttgtggacgagcactgcggaaaccggggcccctccctgagaaccacaaccgtcacaggcaaaattatccatgaatggtgttgccggagctgtaccctgcctccccttcgcttcagaggggaggatggatgctggtacggcatggagatccggccggtgaaggaaaaggaggaaaatctcgttaaatctatggtgtccgcggggagcggagaggtcgactcctttctgctgggcctcctgtgtatttctatcatgattgaagaggtgatgagaagccgctggtcccggaagatgcttatgacggggacactggctgttttctttctcctgatcatgggacagctgacctggaacgaccttattagactgtgcatcatggtgggcgccaatgcctctgatcgcatgggcatggggacaacctatctcgctctgatggccaccttcaaaatgagacctatgtttgcggtcggactcctgttccggcgccttacaagcagagaggtgctgctcctgacgattggcctgtcccttgtggcttctgtcgaactgcccaacagcctcgaggaactgggggacggactcgccatgggcatcatgatcctgaaacttctgaccgattttcaatcctaccagctctgggccacactgctgagccttaccttcattaaaacaaccttttctctgcactatgcttggaagacgatggccatggttctctccatcgtgagcctgttccccctctgtctgtctacaacctcccagaagaccacatggcttcctgtgctgctggggagcctcggatgcaaaccgctgaccatgtttcttattgctgagaataagatctggggccggaaatcttggcccctgaacgaaggcattatggccgtcgggatcgtgtccatcctcctgagctccctcctgaagaacgacgttcctcttgcgggacccctgattgccggcgggatgctgatcgcttgttacgtgattagcggatctagcgccgatctctccctggagaaagctgccgaggtctcttgggaagaggaagccgagcatagcggcgcttcccacaatatccttgtggaagttcaggacgatgggacaatgaagattaaagacgaggagcgcgatgacacgctgaccatcctcctgaaggcgacactcctggccgtgtctggagtctatcctcttagcatccccgctaccctgttcgtgtggcatttctggcaaaagaaaaagcagagatccggcgtcctgtgggatacaccttctcccccggaagtggagcgggccgttctcgacgatggcatttaccgcatcatgcagagagggctgcttggacggagccaggtgggcgtcggggtgtttcaagaaaacgttttccacaccatgtggcacgtgacgcgcggagccgtcctgatgtatcagggcaaaagactcgagccttcctgggctagcgtgaagaaagacctgatttcttacgggggaggctggcggtttcagggctcctggaataccggggaggaagtgcaggttatcgccgtcgagcccggaaagaaccctaagaatgtgcaaacagcgcccggcaccttcaaaacaccggaaggggaggtgggagctattgccctcgactttaagcctggcaccagcgggtctcccatcgtcaacagagaaggaaaaattgtgggcctgtacggcaatggggttgtgacaacgtccggaacctatgtcagcgccatcgctcaggccaaggcgtcccaggagggccctcttcccgagatcgaagatgaggtgttccgcaaacggaacctgacaattatggacctgcatcccgggtctggaaagaccagacgctacctccctgctatcgttcgggaagccattaagagaaaactgcgcacccttatcctggccccgacacgggtggtcgctagcgagatggccgaagctctcaagggcatgcccattagatatcaaacgaccgccgtgaaatccgagcacacagggaaggagatcgttgatctgatgtgccatgcgacctttacaatgcgcctgctcagccctgtgcgggtccccaattacaacatgatcattatggacgaagcccacttcaccgatccttcttccatcgctgccagaggctatattagcacgcgggtgggaatgggcgaggctgccgccatctttatgacagctacaccccctgggtctatggaagcgttcccgcagagcaatgccgtgattcaggacgaggaacgcgatatccccgagagatcctggaactctggatacgagtggatcaccgactttcctggcaaaacagtctggttcgttcccagcattaaggctgggaatgatatcgccaactgtcttcggaagaatggaaaacgcgtgattcagctgtccagaaagaccttcgacacagaatatcagaagaccaagaacaacgattgggactacgtggtcacgacagacatctctgagatgggcgccaattttcgggctgatagagtgattgaccctcgccggtgcctgaaacccgttatcctcaaggatgggccggaaagagtgattctggccggccctatgcccgtcaccgtggcgagcgctgcccagcgccggggaagaatcggccgcaaccccaataaggagggggaccagtacatctatatgggacagcctcttaacaatgatgaggaccatgcccactggacagaagctaaaatgctgctcgataacattaatacccccgagggcatcattcctgccctgttcgaaccggagcgggaaaagtccgcggccatcgacggggagtacagactgcgcggagaggctagaaaaacgtttgttgaactcatgcggcgcggcgatcttcccgtgtggctgagctataaggtcgcctctgaggggttccaatactccgacagacggtggtgctttgctggcgaacgcaacaatcaggtgctggaggaaaacatggatgtcgagatttggaccaaagagggagaaagaaagaaactcctgcctcggtggcttgacgccagaacatatagcgatcccctggctctccgcgagttcaaggaatttgccgcgggccggagatccgtgtctggggacctgatcctggagatcggaaagctccctcagcaccttacccagcgcgcccaaaatgctctggacaacctggttatgctccataatagcgaacagggcgggcgggcctacagacacgctatggaggagctgcccgatacaattgaaacccttatgctgctcgccctgatcgccgtgctgacaggaggcgtgaccctcttctttctttccggcaaagggctgggaaagacgtctattggcctgctctgtgtcatggctagctccgttctgctttggatggggagcgtggagccgcattggatcgcggcctctattatcctggagttctttctcatggtgctgctgatccctgagcccgaccggcagcgcacacctcaggataaccaactcgcttatgtcgtgattggacttctgttcatgatcctgaccgttgccgccaatgagatgggcctcctggaaaccaccaagaaggaccttgggattggacacgtggctgtcgagaaccaccatcacgccgcgatgctggatgtggacctccatcccgcctccgcttggaccctgtacgccgtcgctacaacgatcattacccctatgatgagacacacaatcgaaaacaccacagccaatattagcctgaccgcgatcgccaaccaggctgccatcctcatgggccttgctaaaggctggcccatttctaagatggatatcggggtgccgctgctggccctcggatgctactcccaggttaatcctctgacgcttaccgctgccgtgctgatgctcgtcgcgcattatgccattatcggccccgggctgcaagctaaggccacacgggaggctcagaaacgcaccgccgccggaattatgaagaaccccacaatcgacggcatcgtggcgattgatctggaccctgttgtgtacgatgctaaatttgaaaagcagctcgggcagatcatgcttctgattctgtgtaccagccaaatcctcctgatgagaacgacatgggccctttgcgagtctattaccctggctacaggaccgctcaccaccctgtgggagggcagccccggcaaattctggaatacaacgatcgccgtctccatggccaacatcttccgggggtcttatctggctggagccggcctcgcgtttagccttatgaagtccctcgggggaggccgcagagggaccggagcccagggcgaaacactgggcgagaagtggaaacggcagctcaatcagctgagcaagtccgagttcaacacctacaaacgctctgggattatggaagtggacagaagcgaagctaaggagggacttaaacggggcgagacaaccaagcacgccgtgtccagagggcctgctaagctgcgctggtttgttgaacggacgctcgtcaatcccgagggaaaagtgatcgccctgggctgtgggagaggagcgtggtcttattactgcgccggcctgaagaaaggcacagaagtgaaggggtataccaaaggaggccctgggcacgaggaacccattcctatggctacctacggatgggatctcgtcaaacttcatagcggcaaagacgttttctttatcccgcccgagaagtgtgacacactgctgtgcgatattggggagtcctctcctaaccccaccatcgaagagggacgcacactccgggtgctgaagatggtggaaccttggcttagaggcaatcaattctgtattaaaatcctgaacccctacatgccgagcgtcgtggagacgctcgagcagatgcagcgcaagcacggcgggatgctggttcggaatcctctgtccagaaacagcacccatgaaatgtattgggtgtcttgcggaacaggcaatatcgtctccgccgtgaacatgaccagccgcatgctcctgaatcggtttacaatggctcacagaaaacccacctacgagcgcgacgttgatcttggggccggaacgcggcacgtggctgtcgaccccgaagtggccaacctggatattatcggccagagaattgagaacatcaagcatgaacacaaatctacctggcattatgacgaggataatccttacaagacatgggcgtatcacgggtcctacgaggtgaagcccagcggatctgcctccagcatggtcaacggcgttgtgaaactcctgaccaagccttgggacgtgattccgatggtcacacaaatcgctatgaccgatacaacccccttcggccagcagcgcgtgtttaaagaaaaggttgacacgagaacacctaaagccaagcgggggaccgctcaaatcatggaggtgaccgcccgctggctttggggattcctgtccagaaataagaaaccccggatttgtacaagagaagagtttacgcggaaggtccgcagcaacgccgcgatcggcgctgtgttcgttgatgaaaatcagtggaactctgccaaagaggccgtggaggacgacagattttgggatctcgtccatcgggaacgcgagctgcacaagcaggggaaatgccctacctgcgtgtataatatgatgggaaagagagaaaagaaactgggcgagttcgggaaggctaaaggcagccggcccatttggtacatgtggctcggagcccgcttcctggaatttgaggctcttggcttcatgaacgaggaccactggttttccagagaaaattctctgagcggggttgagggagaagccctccataagctgggctacatccttcgggatatttccaaaatccccgggggaaacatgtatgcggacgatacagccggctgggacacccgcatcacagaggatgacctgcagaatgaggggaagattaccgatatcatggaacctgagcacgctctcctggccaaatctattttcaagctgacataccaaaacaaggtggtcagagtgcagcggcccgctaaaaatggcaccgtcatggacgtgatcagccgcagagatcagcggggatccggccaggttgggacgtatggactcaacacctttacaaatatggaagcccaactgattcgccagatggagtctgaaggcatcttccttcctaacgagctggagacccccaacctcgcggggagagtgctggactggcttgaaaagtacggagtcgagcggctgaaaagaatggccatcagcggcgatgactgtgtggtgaagcctattgacgatcgctttgctacagccctcaccgctctgaatgacatggggaaagttcggaaggatatcccccagtgggaaccgtccaagggctggaacgactggcagcaagtgcctttctgcagccatcactttcaccagctgattatgaaagatggaagagagatcgtcgtgccctgtcgcaatcaggacgaactcgttggccgggccagagtgtctcagggggctggatggacgctgcgcgagacagcctgccttggcaagtcctatgcgcaaatgtggcagctgatgtacttcccccggagagccctccgcctggctgccaacgccatttgtagcgctgtccctgtggattgggtcccgacctctcggacaacctggtccatccatgcccaccatcagtggatgacgaccgaggacatgcttagcgtgtggaatagagtttggattgaagagaacccctggatggaagataaaacacgcatctcctcttgggaggacgtgccttatctggggaagcgggaagatcaatggtgcggaagcctcatcggcctgacccccagagcgacatggcctaccaatattcaggtcgctatcaaccaggtgcggagactgattgggaatgagaactactccgactacatgacaagcatgaaacgctttaagaatgagtctgaacccgagggcgccctctggtga

SEQ ID NO: 19139 - RNA, 9879 nt, synthetic construct
  misc_feature 1..9879: note = derived and/or modified CDS sequence (opt5) from DENV-1__GU131679__SS-prME
  source 1..9879: mol_type = other RNA
agcgtgaccatgctgctgatgctgatgcccacagcccttgctttccacctgacgaccagaggcggggagcctcatatgatcgtctccaagcaggaacggggaaaatctctcctgtttaagacaagcgccggcgttaacatgtgcacccttattgccatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaggcttggcttgtccataagcagtggttcctggatctccctctgccctggacaagcggggcgtccacctctcaagagacatggaatcgcaaagaccttctggtgacctttaagaccgcccacgctaagaaacaggaagtcgtggttctcggaagccaggagggcgccatgcacacagccctgacgggggctaccgaaatccaaacatccggaaccacaaccattttcgccggccatctgaagtgcagactcaaaatggataagctgacgcttaaagggatgagctatgtgatgtgtacaggctctttcaagctggagaaggaagtcgcggagacccagcacggaaccgtgctcgttcagatcaaatacgagggcacagacgctccgtgcaagattcctttttccacccaggatgaaaaaggggtgacacaaaacggacggctgatcacggccaatcccatcgtcaccgacaaggagaaacctgtgaacattgaagccgagccgcccttcggcgagagctatatcgtgattggggctggagaaaaggccctgaaactttcttggtttaaaaagggcagctccatcgggaaaatgttcgaggctacagccagaggcgcgcgccggatggccattctcggagataccgcttgggactttggctctatcgggggagttttcacaagcgtcggcaagctggtgcatcagatctttgggaccgcctacggagtgctgttctccggcgtcagctggacgatgaaaattgggatcggcgtgctcctgacctggcttggactcaattctagatccacaagcctctctatgacctgtattgctgttggcctggtgacactgtaccttggggtcatggtgcaggccgattccggatgcgttatcaactggaagggccgcgaactcaagtgtgggagcggaatttttgtgaccaatgaggtccacacatggaccgaacagtataaattccaagcggactcccctaagcggctgtctgccgctatcggcaaagcctgggaggagggggtgtgcggcattagaagcgctacgcgcctggaaaacatcatgtggaagcagatctccaacgagctcaatcatattctgcttgaaaacgacatgaaatttacagttgtggtcggagatgtggccggcatcctggcccaggggaagaaaatgattcggccgcagcccatggagtacaagtattcttggaaaagctggggaaaggctaagatcattggcgcggacgtgcaaaatgccaccttcatcatcgatgggcctaacacccccgaatgtcctgacgatcagagagcttggaatatttgggaggtcgaggactacggatttggcatcttcacaaccaacatttggctcaaactgcgcgattcctatacgcaggtttgcgaccaccggctgatgagcgccgccatcaaggattctaaagctgtgcacgccgacatgggctactggattgaatccgagaagaatgaaacatggaaacttgcgagagctagcttcatcgaggtgaaaacctgtatctggcccaagtctcatacactctggtccaacggggtcctggaaagcgagatgattatcccgaaaatttatggaggccctatctctcagcacaattaccgccccgggtactttacccaaacagccggaccttggcatctgggcaagctcgagctggatttcgacctttgcgaagggaccacggtggttgtggatgagcactgcggaaaccggggccccagcctgagaaccacaaccgtcacaggcaaaattatccacgaatggtgttgccggtcctgtaccctccctcccctgcgctttaagggggaggacggatgctggtatggcatggagatcagaccggtgaaggaaaaagaggaaaatctggttaagagcatggtgtctgccgggtccggagaggtcgacagcttctcccttggcctcctgtgtatttctatcatgattgaagaggtgatgcggagcagatggtcccgcaaaatgctgatgacggggacactcgctgtctttttcctgcttatcatgggacagctgacctggaacgatctcattcggctgtgcatcatggtgggcgccaatgcgtctgacagaatgggcatggggacaacctacctggctcttatggccacctttaagatgcgccctatgttcgccgtcggactgctctttagacggctgacaagccgcgaggtgctcctgcttacgattggcctgtccctcgtggcttctgtcgaactgcccaacagcctggaggaacttggggatggactggccatgggcatcatgatcctcaaactgctcaccgacttccagtcccatcaactgtgggctacacttctgagcctcacctttattaagacaaccttctctctgcactatgcctggaagacgatggcgatggttctgtccatcgtgagcctttttcccctgtgtctctctacaacctcccagaaaaccacatggctgcctgtgctcctggggagccttggatgcaagccgctgaccatgttcctgattgccgagaataaaatctggggcagaaagtcttggcccctcaacgaaggcattatggctgtcgggatcgtgtccatcctgcttagctccctgctcaaaaacgatgttcctctggccggacccctcattgctggcgggatgctgatcgcctgttacgtgattagcggatctagcgccgacctttccctggagaaggctgcggaggtctcttgggaagaggaagccgagcatagcggcgcttcccacaatatcctggtggaagttcaggatgacgggacaatgaaaattaaggatgaggagcgggacgatatgctcacgatcctgcttaaggccaccctgctcgccgtgtctggagtctatcctctgagcatccccgctacactcttcgtgtggtacttttggcagaaaaagaaacaacgctccggcgtcctgtgggacaccccttctcccccggaagtggagagagccgttcttgatgacggcatttatcggatcatgcagcgcgggctgctgggaagaagccaggtgggcgtcggggtgttccaggaaaacgtttttcatacaatgtggcacgtgacccggggagcggtcctcatgtaccaaggcaagcgcctggagccttcctgggctagcgtgaaaaaggaccttatttcttacgggggaggctggagactgcagggctcctggaatacgggggaggaagtgcaggttatcgccgtcgagcccggaaagaaccctaaaaatgtgcagaccgcccccggcacattcaagaccagcgaaggggaggtgggagctattgccctcgattttaaaccgggcacatctgggtcccctatcgtcaaccgggaaggaaagattgtgggcctgtatggcaatggggttgtgaccacaagcggaacgtacgtctccgcgatcgctcaagccaaagcctctcaggagggccccctccctgagatcgaagacgaggtgttcagaaagcgcaacctgaccattatggatcttcaccccgggagcggaaagacacggagatatctgcccgctatcgttcgcgaagccattaaacggaagctgagaaccctcatcctggctcctacccgcgtggtcgcctccgagatggcggaagcccttaaaggcatgccgattcggtaccagacaacggctgtgaagtccgagcataccgggaaagagatcgttgacctgatgtgccacgccacatttaccatgagactcctgtctcccgtgcgcgtccctaattataacatgatcattatggatgaagctcatttcacagacccctccagcatcgccgcccggggctacatttctaccagagtgggaatgggcgaggctgcggccatctttatgacggctacacctcccgggagcgtggaagccttccctcaatccaatgccgtcattcaggatgaggaacgggacatcccggagcgctcttggaacagcggatatgagtggatcaccgattttcccggcaagaccgtttggttcgtgccttccattaagtctgggaatgacatcgctaactgtctgcgcaagaatggaaagcgggtgattcagctcagccgcaaaacattcgataccgaataccagaagaccaagaataacgactgggactacgtcgtgaccacggatatctccgagatgggcgccaattttagagcggaccgggttattgatcccagacgctgccttaagcctgtgatcctgaaggacgggcccgaacgggtcattctggctggcccgatgcctgtgacagttgccagcgccgctcaaagacgcggacggatcggcagaaaccacaataaagagggggatcagtatatctacatgggacagcccctcaacaatgacgaggatcatgcccactggaccgaagcgaagatgctgcttgacaacattaatacacccgagggcatcattcctgccctgttcgaacccgagcgcgaaaaatctgctgccatcgatggggagtatcggctcagaggagaggctcgcaagacctttgtggaactgatgagacggggcgacctgcctgtctggctctcctacaaagtggccagcgaggggttccagtattccgatcgcagatggtgctttgacggcgaacggaacaatcaagtccttgaggaaaacatggatgtggagatttggacgaaggagggagaacgcaaaaagctgagaccgcggtggctggacgctagaacctactctgaccccctcgccctgcgcgagttcaaggaatttgcggccggccggagaagcgtttccggggatcttatcctggagatcggaaaactccctcagcacctgacacagcgcgctcagaatgccctggacaacctcgtgatgcttcataattctgaacaaggcgggcgggcttatagacacgccatggaggagctgcccgataccattgaaacactgatgctcctggcccttatcgctgtgctgaccggaggcgtcacactcttctttctgagcggccgggggctgggaaagacctccattggcctcctttgtgttatggcgagctctgtgctgctgtggatggcctccgtggagcctcattggatcgctgccagcattatcctcgagttctttctgatggtccttctgatccccgagccggaccgccagagaacgcctcaggataaccagctcgcctacgtggttattgggctgctgttcatgatcctcacagtggctgccaatgagatgggacttctggaaaccaccaaaaaggacctgggcattgggcacgtcgcggtggagaaccaccatcacgccgctatgctcgatgtcgacctgcatcccgcctctgcttggacactttacgccgtggcgaccacaatcattacgcctatgatgcggcacaccatcgaaaacacaaccgccaatatttccctgacagctatcgccaaccaagctgccatcctcatgggactggataaaggctggcccattagcaagatggacatcggcgttcctctgctcgctcttgggtgctattctcaggtgaatcccctgaccctgacggccgcggtcctcatgctggtggcccattacgctattatcggaccgggccttcaggccaaggctacccgcgaggcccagaagagaacagccgcggggattatgaagaaccctaccgttgatggaatcgtggctatcgaactggaccccgtcgtgtatgatacaaaatttgagaagcagctcggccagattatgctgctgatcctctgtaccagccagattcttctgatgcggacgacatgggccctgtgcgagtccatcaccctcgctacagggcccctgaccaccctttgggaaggatctcctggcaaattctggaatacaacgattgccgtgagcatggccaacatcttccgcggctcctacctggctggggccggactcgcgtttagcctgatgaagtccctgggcgggggaagacggggcaccggggcccaaggagagacactcggcgaaaagtggaaacgccagcttaatcagctgtctaagagcgagttcaacacctataaaagatccggcatcatggaagttgaccggtctgaggctaaggaggggctgaaaagaggagaaacaaccaagcacgccgtcagccgcggcacggctaagctccggtggtttgtggagagaaatctggtgaaaccggaagggaaggtcattgaccttggatgtggccgcgggggatggtcctactattgcgccggcctgaaaaaggttacagaggtgaaaggctacaccaaagggggacccggccacgaggaacctatccccatggcgacctacgggtggaacctcgtgaaactgcattctggaaaggatgtcttctttattcctcccgagaagtgtgacacactgctctgcgatatcggcgaaagctcccctaatccgaccattgaggaagggcggacacttagagtgctgaaaatggttgagccctggctgcgcggaaaccagttctgtatcaagattctcaatccttatatgcccagcgtggtcgagacgctggaacaaatgcagcggaaacacggcggcatgcttgtgagaaaccctctgtctcgcaattccacccatgagatgtactgggttagctgcgggacaggaaacatcgtgtctgccgtcaatatgacctcccggatgctcctgaacagatttacaatggctcaccgcaagcccacctatgaacgggacgtggatctgggcgccgggacgagacacgtggctgtcgagccggaagttgccaacctcgacatcattggacagcgcatcgagaatattaaacatgagcacaagagcacctggcattacgatgaagacaacccttataagacatgggcttaccacggctcttatgaggtgaaaccctccgggagcgcctccagcatggtgaatggagtcgtgaagctgcttaccaaaccctgggatgttatccctatggtgacacagattgcgatgaccgacacaacccccttcggccaacagagagtctttaaggaaaaagtggatacgcggacacctaaggccaagcgcggcaccgctcagatcatggaggttaccgccaaatggctgtgggggttcctctctagaaacaagaaaccgcggatctgtacaagagaagagtttacgcggaaggtgcgcagcaatgctgccattggagccgtcttcgtggacgagaaccaatggaactccgcgaaagaagctgttgaggacgaaagattttgggatctggtgcatcgggagcgcgaacttcacaagcagggcaagtgcgcgacctgcgtctacaacatgatggggaaaagagagaagaaactgggagagttcggcaaggccaaagggtctcgggctatctggtacatgtggctcggcgcccgcttcctggaatttgaggctctgggattcatgaatgaagaccactggtttagcagagagaactccctctctggcgtggagggggaaggactgcataaacttggctatattctgcgggatatcagcaaaattcccgggggaaatatgtacgccgacgatacagcgggctgggacacccgcatcacagaggatgacctccagaacgaagccaagatcaccgatattatggagcctgaacacgctctgcttgccaagtccatcttcaaactgacatatcagaataaggtcgtgagagttcaacggcccgctaaaaacgggaccgtgatggacgtcatttctcgcagagatcagcggggcagcggacaggtgggcacgtacgggctcaatacctttacaaacatggaggcccagctgatccgccaaatggagtccgaaggaattttcagcccttctgagctggaaacccccaacctcgcgggcagagtgctggactggcttgagaagcatggggttgaacggctgaaaagaatggccatctccggagatgactgtgtggtcaagccgatcgacgatcgctttgctacagccctcaccgctctgaatgacatgggcaaggtgcggaaagatattcctcagtgggagcccagcaaggggtggaacgactggcagcaggttcctttctgctctcaccactttcatcaacttatcatgaaagatggcagagagattgtggtcccctgtcgcaatcaggacgaactggtgggacgggccagagtctcccagggcgctgggtggagcctccgcgagacggcctgcctgggaaagtcctatgcgcagatgtggcaactgatgtacttccaccggagagatctccgcctggccgctaacgccatctgttctgccgtgcctgttgactgggtgcccacaagccggaccacatggtccattcatgctcaccatcagtggatgaccacggaagatatgcttagcgtctggaatagagtgtggatcgaggaaaacccgtggatggaggacaaaacccacatttcttcctggggcgatgttccttatctggggaagcgcgaggaccagtggtgcggaagcctcatcggcctgacagcccgggcgacctgggctacaaatatccaagtggccattaaccaggtcagacggcttatcgggaatgaaaactacctggactacatgacctctatgaagagatttaaaaatgagattgatcccgaaggcgccctctggtga

SEQ ID NO: 19140 - RNA, 9879 nt, synthetic construct
  misc_feature 1..9879: note = derived and/or modified CDS sequence (opt5) from DENV-1__GU131680__SS-prME
  source 1..9879: mol_type = other RNA
agcgtgaccatgctgctcatgctgatgcccacggcccttgctttccacctgacgaccagaggaggggagcctcatatggtggtttccaagcaggaacggggaaaatctctcctgtttaagaccagcgccggagtgaacatgtgcacccttatcgcgatggacctgggggagctctgtgaagatacaatgacctacaaatgcccgcgcattacagaggctgaacccgacgatgtggactgttggtgcaatgccaccgatacgtgggtcacctatggaacatgttcccagaccggcgagcacagacgggagaagcgctctgtggccctggctcctcatgttgggctgggactcgaaacaagaaccgagacgtggatgagctccgaaggcgcctggaaacagatccagcgggtggagacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggactttgtggagggactgagcggcgccacatgggtcgatgtggtgctcgaacacgggtcttgtgtcacgaccatggctaaggacaaacccacactggatattgagctgctcaagaccgaagttacaaaccctgccgtgctgcgcaaactttgcatcgaggcgaagatttccaataccacgacagacagcagatgtccgacccaaggagaagccaccctggtggaggagcaggatgctaacttcgtctgccggcgcacatttgtggacagaggctggggcaatgggtgtggactcttcggcaaagggtctctgcttacctgcgccaagtttaagtgcgttacaaaactggaaggaaagatcgtgcagtacgagaacctcaaatattccgtcattgtgacggttcacaccggcgatcagcatcaagtggggaatgaaagcacagagcacggaaccacagctaccatcacgccccaggcccctaccacagaaatccagctgaccgactacggcgccctgacactcgactgttctccccggaccggcctggatttcaacgagatggtccttctgacgatgaaggagaaatcctggctcgtgcataagcagtggtttctggaccttcctctgccctggacaagcggggcttccacctctcaagaaacatggaatcgccaggatctcctggtcaccttcaaaaccgcgcacgccaagaagcaggaggtggttgtgctgggaagccaagaaggcgctatgcacacagccctcacgggggccaccgagattcagacatccggaaccacaaccatctttgctggccatctgaaatgcagacttaagatggacaaactgacgctcaaggggatgagctatgtcatgtgtacaggctctttcaaactggaaaaggaggtggccgagacccagcacggaaccgttctggtgcagattaagtacgaaggcacagatgcgccgtgcaaaatccctttctccacccaagacgagaagggggtcacacagaacggacggcttattacggctaatcccatcgtgaccgataaagaaaagcctgtgaacatcgaggccgagccgccctttggcgaaagctatattgttatcggggccggagagaaagctctcaagctgtcttggttcaagaaaggcagctccattgggaagatgtttgaagccacagctagaggcgcccgccggatggcgatcctgggagacaccgcctgggatttcggctctattgggggagtctttacaagcgtgggcaaactcgtgcatcagatcttcgggaccgcttacggagtcctgttttccggcgtgagctggacgatgaagatcgggattggcgttcttctgacctggctcggactcaattctagatccacaagcctgtctatgacctgtatcgccgtgggccttgtcacactctacctgggggtgatggttcaggctgactccggatgcgtgattaactggaaaggccgcgagctgaagtgtgggagcggaatcttcgtcaccaatgaagtgcacacatggaccgagcaatataagtttcaggccgattcccctaaacggctctctgcggccattggcaaggcttgggaggaaggggtttgcggcatcagaagcgccacgcgcctggagaacattatgtggaaacagatctccaacgaacttaatcatatcctgctcgagaacgacatgaagttcacagtggtcgtgggagacgtggctggcattctggtccaggggaaaaagatgatccggccgcaacccatggaatacaaatattcttggaaaagctggggaaaggccaaaattatcggcgccgatgttcaaaattccacctttattatcgacgggcctaacacccccgagtgtcctgatgaccagagagcttggaatatctgggaggtggaagattacggattcggcatttttacaaccaacatctggctgaaacttcgcgacagctatacacaggtgtgcgatcaccggctcatgtctgcggccattaaagactccaaggctgtccacgccgatatgggctactggatcgagagcgagaagaatgagacatggaagctggccagagcttctttcattgaagtgaagacctgtatctggcccaaatcccatacactgtggagcaacggggttctcgagtctgagatgatcattccgaagatccacggaggccctattagccaacataattatcgccccgggtacttcacccagacagccggaccttggcacctgggcaaacttgaactggactttgatctctgcgaggggaccacggtggtcgtggacgaacactgcggaaaccggggcccctccctgagaaccacaaccgttacaggcaagatcattcatgagtggtgttgccggagctgtaccctgcctccccttcgcttcagaggggaggatggatgctggtacggcatggaaatccggccggtgaaagagaaggaagagaatctcgtcaagtctatggtgtccgcggggagcggagaagttgactccttttctctgggcctgctctgtatcagcattatgatcgaggaggtgatgagatcccgctggtctcggaaaatgctgatgacggggacacttgctgtcttctttctgctcattatgggacagctgacctggaacgacctgatcagactttgcattatggtgggcgccaatgccagcgatcgcatgggcatggggacaacctatctggctctcatggccaccttcaagatgagacctatgtttgcggtgggactgctgttccggcgcctgacatccagagaagtccttctgctcacgatcggcctgtctctggttgctagcgtggagcttcccaactccctggaagaactgggggacggactggccatgggcattatgatcctcaaactgcttaccgattttcaaagctaccagctgtgggccacactcctgtctctgaccttcatcaagacaaccttttcccttcactatgcttggaaaacgatggccatggtgctgagcattgtctctctcttccccctgtgtctctccacaaccagccagaagaccacatggctgcctgtgcttctggggtctctgggatgcaagccgctcaccatgtttctgatcgctgaaaataaaatttggggccggaagtcctggccccttaacgagggcatcatggccgttgggattgtgagcatcctgctctccagcctgctcaaaaacgacgtccctctggcgggaccccttatcgccggcgggatgctgattgcttgttacgtgatctctggaagctccgccgatctgtctctcgagaaggctgccgaagttagctgggaggaagaggccgaacattccggcgcttctcacaatattctggtggaggtccaggacgatgggacaatgaaaatcaaggacgaggaacgcgatgacacgcttaccattctgctcaaagcgacactgctcgccgtgagcggagtctatcctctgtccatccccgctacccttttcgtgtggcatttctggcaaaagaagaaacagagatctggcgttctgtgggatacacctagccctcccgaggtggaacgggccgtcctggacgatggcatctaccgcattatgcagagagggctcctgggacggtcccaggtgggcgttggggtgtttcaagagaacgtcttccacaccatgtggcacgtgacgcgcggagccgtgcttatgtatcagggcaagagactggagcccagctgggcttctgttaaaaaggacctcatctcctacgggggaggctggcggtttcagggcagctggaataccggggaagaggtccaggtgattgccgtggaacccggcaagaaccctaagaatgtccaaacagcgcccggcaccttcaagacaccggagggggaagtgggagctatcgccctggactttaaacctggcacctctgggtcccccattgttaacagagagggaaagatcgtgggcctctacggcaatggggtcgtgacaacgagcggaacctatgtttccgccattgctcaggccaaagcgtctcaggagggccctctgcccgaaatcgaggatgaagtgttccgcaagcggaaccttacaatcatggacctgcatcccgggagcggaaaaaccagacgctacctgcctgctattgtccgggaggccatcaagagaaagctccgcaccctgattcttgccccgacacgggtggttgcttccgaaatggccgaggctctgaaaggcatgcccatcagatatcaaacgaccgccgtcaagagcgagcacacagggaaagaaattgtcgatctcatgtgccatgcgacctttacaatgcgcctgctgtctcctgtgcgggtgcccaattacaacatgatcatcatggacgaggcccacttcaccgatccttccagcattgctgccagaggctatatctctacgcgggtcggaatgggcgaagctgccgccatttttatgacagctacaccccctgggagcatggaggcgttcccgcagtccaatgccgttatccaggacgaagaaagagatattcccgagagatcttggaacagcggatacgaatggatcaccgactttcctggcaagacagtgtggttcgtgccctccatcaaagctgggaatgatattgccaactgtctccggaagaatggaaagcgcgtcatccagctttctagaaaaaccttcgacacagagtatcaaaagaccaaaaacaacgattgggactacgtggttacgacagacattagcgaaatgggcgccaattttcgggctgatagagtgatcgaccctcgccggtgcctgaagcccgtcattctgaaagatgggccggagagagtgatcctcgccggccctatgcccgttaccgtggcgtccgctgcccagcgccggggaagaattggccgcaaccataataaggagggggaccagtacatctatatgggacagcccctgaacaatgatgaagaccacgcccactggacagaggctaagatgcttctggataacatcaatacccctgaaggcattatccccgccctcttcgagcctgaacgggagaaaagcgcggccattgacggggagtacagactgcgcggagaagctagaaagacgtttgtcgagctgatgcggcgcggcgatctcccggtgtggctttcttataaagtcgcctccgaagggttccaatacagcgacagacggtggtgctttgatggcgagcgcaacaatcaggtgctggaagagaacatggacgttgagatctggaccaaggaaggagagcgcaaaaagctgcggcccagatggctcgatgctcgcacatattccgaccctctggcccttcgggagttcaaagagtttgctgccggcagacgctctgtgagcggggacctgattctcgaaatcggaaagctgccccagcatctgacccagcgggcgcaaaatgccctcgataaccttgtgatgctgcacaattccgagcagggcgggagagcttaccggcatgccatggaggaactgcctgacacaatcgagaccctcatgctgcttgctctgattgccgtcctcacaggaggcgttaccctgttctttctgtctggcaaggggctcggaaaaacgagcatcggccttctgtgtgtgatggcctccagcgtgctgctctggatggcttctgtcgaaccccactggattgcggcctccatcattctggagttctttcttatggtgctgctcatcccggagcctgatcgccagagaacaccccaggacaaccaactggcttatgttgtgatcgggctcctcttcatgattcttaccgtcgccgccaatgaaatgggactgctggagaccacaaagaaagatctcggcatcgggcacgtggctgtcgaaaaccatcaccatgccgcgatgctggacgtggatcttcaccctgccagcgcttggaccctgtacgccgttgctacaacgattatcacccccatgatgcggcatacaattgagaacaccacagccaatatctctctcaccgcgattgccaaccaggctgccatcctgatgggactggacaagggctggcctatctccaaaatggatattggcgtgcccctccttgctctggggtgctacagccaggtcaatccgctgacgctcaccgccgctgtgctgatgcttgttgcccactatgcgatcattggacctggcctgcaagccaaggctacacgcgaagcccagaagagaaccgctgccgggatcatgaaaaaccccacaattgacggaatcgtggccatcgatctcgaccccgtcgtgtacgatgcgaagtttgagaaacagctgggccagattatgctgctcatcctttgtacctctcaaattctgctgatgcggacgacatgggctctctgcgagagcatcaccctggccacagggcctcttaccaccctgtgggaaggatccccgggcaagttctggaatacaacgattgctgtgtctatggccaacatcttccgcggcagctatctcgccggggctggactggccttttccctgatgaaaagcctcggcgggggaagacggggcaccggggcgcagggagagacacttggcgaaaagtggaagcgccagctgaatcagctgtccaaatctgagttcaacacctacaagagaagcggcatcatggaagttgaccggtccgaggccaaagaggggctcaagagaggagaaacaaccaaacacgctgtctctcgcggcacggccaagctgcggtggtttgtggagagaaatcttgtgaagcccgaagggaaagtcattgacctgggatgtggccgcgggggatggagctattactgcgctggcctcaagaaagttacagaggtgaagggctataccaaagggggacctggccatgaggaacccatccctatggccacctacgggtggaacctggtgaagctgcactccggaaaagatgtcttctttattccccctgagaagtgtgacacactcctttgcgatatcggcgaatctagcccgaatcccaccattgaggaagggcggacactgagagtgctgaagatggttgagccttggctccgcggaaaccaattctgtatcaaaattctgaatccctacatgccttccgtggtcgagacgcttgaacagatgcagcggaagcatggcggcatgctggtgagaaaccccctcagccgcaattctacccacgagatgtattgggtttcctgcgggacaggaaacatcgtgagcgcggtcaatatgacctctcggatgctgctgaacagatttacaatggcccaccgcaaaccgacctacgaacgggacgtggatctcggcgctgggacgagacatgtggccgtcgagcctgaagttgctaacctggacatcattggacagcgcatcgagaatattaagcacgagcataaatccacctggcactatgatgaagacaacccctacaagacatgggcctatcatggcagctacgaggtgaagccctctgggtccgctagctccatggtgaatggagtcgtgaaacttctgaccaagccttgggatgttatccccatggtgacacaaattgccatgaccgacacaacccctttcggccagcagagagtctttaaagaaaaggtggatacgcggacaccgaaagcgaagcgcggcaccgcccaaatcatggaggttaccgctagatggctctgggggttcctgagccggaacaagaaacccagaatctgtacacgggaagagtttacgcgcaaggtgagatctaatgccgctattggagccgtcttcgtggacgagaaccagtggaatagcgccaaagaagcggttgaggacgatcggttttgggaccttgtgcaccgcgaaagagagctgcacaagcagggcaaatgcgctacctgcgtctataacatgatggggaagcgggaaaagaaactcggagagttcggcaaggccaaagggtcccgcgccatctggtacatgtggctgggcgctagattcctggagtttgaagccctcggattcatgaatgaggatcattggttttctcgggaaaacagcctgtccggcgtggagggggagggacttcacaagctgggctacattctccgcgacatctctaaaattcctgggggaaatatgtatgctgatgacacagccggctgggataccagaatcacagaagacgatctgcagaacgaggcgaagatcaccgacattatggaacccgagcatgcccttctggctaaaagcatcttcaagctcacataccaaaataaggtcgtgcgggttcagcgccctgccaaaaacgggaccgtgatggatgtcatttccagacgggaccagcgcggctctggacaggtgggcacgtatgggctgaatacctttacaaacatggaagctcaactgatcagacagatggagagcgagggaattttcctccccaacgaactggagaccccgaatcttgccggccgggtgctggattggctcgaaaagtacggggttgagagactgaaacgcatggcgatctccggagacgactgtgtggtcaagcctatcgatgaccggtttgccacagctcttaccgccctgaacgatatgggcaaagtgagaaaggacattccccagtgggaacctagcaaggggtggaatgattggcagcaagttcccttctgctctcaccactttcatcagctcatcatgaaagacggccgcgagattgtggtcccttgtcggaaccaggatgagctggtgggcagagctcgcgtctcccagggcgccgggtggagcctgcgggaaacggcttgcctcggaaagtcttatgcccaaatgtggcagctgatgtacttccacagacgcgaccttcggctggcggccaatgctatctgttccgccgtgcccgttgattgggtgccgacaagcagaaccacatggtccattcatgcccaccatcagtggatgaccacggaggacatgctctctgtctggaaccgcgtgtggatcgaagagaatccttggatggaagataaaacccggattagctcctgggaggacgttccctatctgggcaagagagaggaccaatggtgcgggagccttatcggactgacagctcgggccacctgggcgacaaacatccaggtggctattaatcaggtcagacgcctcatcggcaacgaaaattactctgattacatgacctccatgaaacggtttaagaacgagagcgaacccgagggggccctgtggtga

SEQ ID NO: 19141 - RNA, 9879 nt, synthetic construct
  misc_feature 1..9879: note = derived and/or modified CDS sequence (opt5) from DENV-1__GU131681__SS-prME
  source 1..9879: mol_type = other RNA
agcgtgaccatgctgctcatgctgatgcccaccgcccttgctttccacctgacgacccggggcggggaacctcatatgattgtcaccaagcaggaacggggaaaatccctcctgtttaagacctctgccggcgttaacatgtgcacccttattgccatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcacagacgggacaagcgctccgttgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggtccggagaggtcgacagcttttccctcggcctgctgtgtatctctattatgatcgaagaggtgatgcggagcagatggtcccgcaaggttctcatgacagggaccctggctgtgttccttctgctcattatgggacagctgacatggaacgatctgatccggctttgcattatggtcggcgccaatgcctctgacagaatgggcatggggaccacctatctggctctcatggccacatttaaaatgcgccctatgttcgcggtgggactgctctttagacggctgacgagccgcgaggtgcttctgctcaccatcggcctgtccctggtcgcttctgttgaacttcccaacagcctggaggaactcggggatggactggccatgggcatcatgattctcaagctgcttacagacttccaatcccaccagctgtgggccaccctcctgagcctgacatttatcaaaaccacgctttctctgcattacgcttggaagacaatggccatggtgctctccattgtgagcctgttccccctctgtctgtctaccacctcccagaagacaacctggcttcctgtcctgctggggagcctcggatgcaaaccgctgacaatgtttcttatcgctgagaataagatttggggcagaaaatcttggcccctgaacgaaggcatcatggccgtgggggttgtgtccatcctcctgagctccctcctgaagaacgatgtccctcttgcgggacccctgattgccggcgggatgctgatcgcttgttatgtgattagcggatctagcgccgacctctccctggagaaagctgccgaggtttcttgggaagaggaagccgagcacagcggcgcttcccataatatccttgtggaagtccaggatgacgggacgatgaagattaaagatgaggagcgggacgataccctgacaatcctcctgaaggcgaccctcctggccgtgtctggagtctaccctcttagcatccccgctacactgttcgtgtggtatttttggcaaaagaaaaagcagcgctccggcgttctgtgggacaccccttctcccccggaagtggagagagccgtcctcgatgacggcatttaccggatcatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggctagcgttaagaaagacctgatttcttacgggggaggctggagactccagggctcctggaatacaggggaggaagtccaggtgatcgccgtggagcccggaaagaaccctaagaatgtccaaaccgcgcccggcacatttaaaaccccggaaggggaggtgggagctattgccctggatttcaagcctggcacaagcgggtctcccatcgttaaccgggaaggaaaaattgtgggcctttacggcaatggggtcgtgacgacctccggaacatatgttagcgccatcgctcaggccaaggcgtcccaggagggccctctgcccgagatcgaagacgaggtgtttagaaaacgcaacctgaccattatggatctccatcccgggtctggaaagacccggagatacctgcctgctatcgtccgcgaagccattaagcggaaacttagaacactgatcctcgccccgacgcgcgtggttgctagcgagatggccgaagctctgaagggcatgcccattcggtatcaaaccacagccgtgaaatccgagcacaccgggaaggagatcgtcgacctgatgtgccatgcgacattcaccatgagactccttagccctgtgcgcgtgcccaattacaacatgatcattatggatgaagcccactttacggacccttcttccatcgctgcccggggctatattagcacaagagtcggaatgggcgaggctgccgccatcttcatgaccgctacaccccctgggtctgttgaagcgtttccgcagagcaatgccgtgattcaggatgaggaacgggacatccccgagcgctcctggaactctggatacgagtggatcacagatttccctggcaaaaccgtgtggtttgtccccagcattaagtccgggaatgacatcgctaactgtctgagaaagaatggaaaacgggtgattcagctgtctcgcaagacattcgataccgaatatcagaagacgaagaacaacgactgggactacgttgtgacaaccgatatcagcgagatgggcgccaattttagagccgaccgggtcattgatcctagacgctgcctcaaacccgtgatcctgaaggacgggccggaacgggttattcttgctggccctatgcccgtgacagtcgcctccgcggctcagagacgcggacggatcggcagaaaccataataaggagggggatcagtacatctatatgggacagcccctgaacaatgacgaggatcacgcccactggaccgaagccaaaatgctcctggacaacattaatacgcctgagggcatcattcccgctctgttcgaacctgagcgcgaaaagagcgccgcgatcgatggggagtaccggctcagaggagaggcccgcaaaaccttcgtggaacttatgagacggggcgacctgccggtctggctgtcttataaggtggcttccgaggggtttcaatacagcgatcgcagatggtgcttcgacggcgaacggaacaatcaggttctcgaggaaaacatggatgtggagatttggacaaaagagggagaacgcaagaaactgagaccccggtggcttgacgccagaacctattccgaccctctggctctccgcgagtttaaggagttcgccgctggccggagatctgtgagcggggatctgatcctggagatcggaaagctcccccagcatcttacacagcgcgcccaaaatgcgctggacaacctggtcatgctccacaattccgaacagggcgggcgggcctacagacatgctatggaggagctgcctgataccattgaaacacttatgctgctcgccctgatcgctgttctgaccggaggcgtgacgctctttttcctttctggccgggggctgggaaaaacaagcattggcctgctctgtgtgatggcctccagcgtcctgctttggatggcctctgtggagccccactggatcgctgcgtccattatcctggaatttttcctcatggttctgctgatcccggagcctgaccgccagagaacaccccaggataaccaactcgcctatgtggtcattgggcttctgtttatgatcctgaccgtggctgccaatgagatgggactcctggaaacaaccaagaaagaccttggcattgggcacgtcgccgtggagaaccatcaccatgctacaatgctggatgttgacctccaccctgccagcgcgtggacgctgtacgccgtggctaccacaatcattacccccatgatgcggcatacaatcgaaaacaccacggccaatatttctctgaccgctatcgccaaccaggcggccatcctcatgggacttgataagggctggcctatttccaaaatggacatcggcgtccccctgctggctctcgggtgctacagccaggtgaatccgctgacacttaccgccgctgttctgatgctcgtggcccactatgctattatcggacctggcctgcaagccaaggcgacacgcgaggcccagaagagaaccgctgccgggattatgaaaaaccccacggtcgatggaatcgtggctatcgacctggatcccgtggtttacgacgccaagttcgaaaaacagctcggccagattatgcttctgatcctgtgtacatctcaaattctcctgatgcggaccacatgggccctttgcgagagcatcaccctggcgaccgggcctctcacaacgctgtgggagggatccccgggcaagttttggaataccacaattgctgtctctatggccaacatcttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcattatggaggtggaccggtccgaagccaaagaggggcttaagagaggagagaccacgcgccacgcggtgtctcggggcacagccaaactgagatggttcgtcgaacgcaatctcgttaagcccgaggggaaggtgatcgatctgggatgtggcagagggggatggagctattactgcgctggcctgaaaaaggtgaccgaagtcaaaggctataccaaagggggacctggccatgaggaacccattcctatggccacatacgggtggaacctcgtgaaacttcactccggaaaggacgtctttttcacaccccctgagaaatgtgatacactgctgtgcgacatcggcgagtctagcccgaatcccacgattgaagaggggagaaccctccgcgtgctgaagatggtcgaaccttggcttcggggaaaccaattttgtatcaagattctgaatccctacatgccttccgtggttgagacactcgagcagatgcagagaaaacatggcggcatgctggtgcgcaaccccctgagcagaaattctacccacgaaatgtattgggtctcctgcgggacaggaaacatcgtgagcgctgtgaatatgacctctagaatgctcctgaaccgcttcacgatggcccaccggaagccgacctacgagagagatgtcgaccttggcgcggggacacgccatgttgccgtggaacctgaggtggctaacctggatatcattggacagagaatcgaaaatattaaacacgagcataagtccacctggcactatgacgaggataacccctacaaaacatgggcctatcatggcagctacgaagtcaagccctctgggtccgctagctccatggtgaatggagttgtgaagctcctgaccaaaccttgggacgtcatccccatggtgacacaaattgccatgaccgatacgacaccttttggccagcagcgggttttcaaggagaaagtggacacccgcaccccgaaggctaaaagaggcacagcccaaatcatggaagtcacggcgcggtggctttgggggtttctgagcagaaacaagaagccccggatctgtacccgcgaggagttcacaagaaaagtgcggtctaatgccgctattggagccgtttttgtggacgagaaccagtggaatagcgctaaggaggccgtcgaagatgagcgcttctgggacctcgtgcagaaagaaagagagctgcacaagcagggcaaatgcgcgacctgcgtctataacatgatggggaagcgggaaaagaaactgggagagtttggcaaggcgaaagggtcccgcgctatctggtacatgtggctcggcgccagattcctggagtttgaagcccttggattcatgaatgaggatcactggttctctcgggaaaacagcctgtccggcgtggagggggagggactccataagctgggctacattcttcgcgacatctctaaaattcctgggggaaatatgtatgctgatgacacagccggctgggataccagaatcacagaagacgatctgcaaaacgaggctaagatcaccgacattatggaacccgagcacgccctcctggcgacgagcatctttaaactgacctaccagaataaggttgtgcgggtccagcgccctgccaagaacgggacagtgatggatgtgatttccagacgggaccagcgcggctctggacaagttggcacctatgggctcaatacattcaccaacatgggagctcagctgatcagacagatggaaagcgagggcatcttttcccccagcgagcttgaaatcccgaacctggccgagcgggtgctcgattggctggaaaaatacggggtcgagagacttaagcgcatggctatctctggagacgactgtgtggttaaacctattgatgaccggttcgccacggcgctgacagccctcaatgatatgggcaaggtgagaaaagacgtcccccagtgggaaccttccaaggggtggaacgattggcaacaggtgcccttttgcagccatcacttccaccagctgatcatgaaggacggccgcgagattgtcgtgccttgtcggaatcaggatgagctggttggacgggctcgcgtgtctcaaggcgccgggtggtccctccgggaaaccgcttgcctgggaaaaagctatgcccagatgtggcagcttatgtactttcatagacgcgacctgcggctcgctgccaacgcgatctgttccgccgtccccgtggattgggttccgacatctagaaccacgtggagcattcacgctcatcaccaatggatgaccacagaggacatgctgtccgtgtggaatcgcgtctggatcgaagagaacccttggatggaagataagacccatgtgagctcttggggcgacgtgccctatcttgggaaacgggaggaccagtggtgcggatccctgattggcctcacagccagagccacctgggctagcaatatccaggttgccatcaaccaggtccggagactgattgggaatgagaactacctggattacatgacatctatgaagcgcttcaaaaatgaaggcgaccccgagggagcgctctggtga

SEQ ID NO: 19142 - RNA, 9879 nt, synthetic construct
  misc_feature 1..9879: note = derived and/or modified CDS sequence (opt5) from DENV-1__GU131682__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagacaagcgccggcgttaacatgtgcacccttattgccatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgtcattgggacctctatcacccagaagggaatcattttcatcctcctgatgcttgtgacacctagcatggcgatgagatgcgttggcattgggtcccgggattttgtggagggactgagcggcgccacgtgggtcgacgtggtgctcgagcacgggtcttgtgtcaccacaatggctaaggataaacccaccctggacatcgaactgctcaagacagaggttaccaaccctgccgtgctgcgcaaactttgcattgaagctaagatctccaatacgacaaccgatagcagatgtccgacccaaggagaggccacactggtggaagaacaagacgcgaacttcgtctgccggcgcacctttgtggatagaggctggggcaatgggtgtggactcttcggcaaagggtctctgattacatgcgccaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgctacgattacaccccaagcccctaccaccgagatccagctcacagactacggcgctctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagcccacgctaagaagcaggaagtggttgtgctgggaagccaagagggcgcgatgcacacggccctgaccggggctacagaaattcagacctccggaacaaccacgatctttgccggccatctcaaatgcagactgaagatggataaacttacactgaaggggatgagctatgtcatgtgtaccggctctttcaaactcgagaaggaagtggccgagacccagcacggaacagttctggtgcagattaagtacgagggcaccgacgctccgtgcaaaatccctttctccacacaagatgaaaagggggtcacgcagaacggacggctgatcaccgccaatcccattgtgacagacaaagagaagcctgtgaacatcgaagcggagccgccctttggcgagagctatattatcattggggctggagaaaaagcccttaagctctcttggttcaagaaaggcagctccatcgggaagatgtttgaggccaccgctagaggcgcccgccggatggctatcctgggagatacagcctgggacttcggctctattgggggagtttttaccagcgtcggcaaactggtgcatcagatcttcgggacggcgtacggagtgctcttttccggcgtcagctggaccatgaagattgggatcggcgtgctgcttacatggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacaaatgaggtccacacctggacggaacaatataagtttcaggccgactcccctaaacggctgtctgctgccatcggcaaggcgtgggaggagggggtgtgcggcatcagaagcgccacacgcctcgaaaacattatgtggaaacagatctccaacgagctgaatcatattcttctggaaaacgacatgaagttcaccgttgtggtcggagatgtggctggcatcctcgcccaggggaaaaagatgattcggccgcaacccatggagcacaaatactcttggaaaagctggggaaaggctaagatcatcggcgccgacgtgcagaataccacatttattatcgatgggcctaacacccccgaatgtcctgacgatcagagagcctggaatatttgggaggtcgaggactatggattcggcatctttacgacaaacatttggctgaagctgcgcgattcctacacccaggtttgcgaccaccggcttatgagcgctgcgatcaaagattctaaggccgtgcatgctgacatgggctattggatcgaatccgagaaaaatgaaacatggaagctcgccagagccagcttcattgaggtgaagacctgtatctggcccaaatctcacacactgtggtccaacggggtcctggaaagcgagatgattatcccgaagatttacggaggccctatctctcaacataattatcgccccgggtacttcacccagacggctggaccttggcacctcggcaaactggagcttgattttgacctgtgcgaagggaccacagtggttgtggatgagcactgcggaaaccggggccccagcctcagaaccacaaccgtcacgggcaagatcattcatgaatggtgttgccggtcctgtacactgcctcccctgcgcttcagaggggaggacggatgctggtacggcatggagatccggccggtgaaagaaaaggaggaaaatcttgttaagagcatggtgtctgccgggtccggagaggtcgacagcttttccctcggcctgctgtgtatttctatcatgattgaagaggtgatgagaagccgctggtcccggaaaatgctcatgaccgggacactggcggttttctttcttctgatcatgggacagctcacctggaacgatctgattagactgtgcatcatggtgggcgctaatgcctctgaccgcatgggcatggggaccacatatcttgccctgatggctacgttcaagatgagacctatgtttgccgtcggactcctgttccggcgcctcaccagcagagaggtgctgcttctgacaatcggcctctccctggtggcgtctgtcgaactgcccaacagccttgaggaactgggggatggactcgctatgggcattatgatcctgaaactcctgaccgactttcaatcccaccagctttgggccacactgctcagcctgaccttcattaagacgacattttctctgcattacgcctggaaaaccatggctatggttctttccatcgtgagcctgttccccctctgtctgtctaccacatcccagaagaccacatggctccctgtgctgcttgggagcctgggatgcaagccgctgacgatgtttctcattgccgagaataaaatctggggccggcgctcttggcccctgaacgaaggcatcatggctgtcgggattgtgtccatccttctgagctccctcctgaagaacgatgttcctctcgccggacccctgattgcgggcgggatgcttatcgcctgttatgtgattagcggatctagcgctgacctgtccctggagaaagccgctgaggtctcttgggaagaggaagccgagcacagcggcgcctcccataatatcctcgtggaagttcaggatgacgggaccatgaagatcaaagatgaggagagagacgatacactgaccattcttctgaaggctacactcctggcggtgtctggagtctaccctctcagcatccccgccaccctgttcgtgtggtatttctggcagaagaagaagcagcggtccggcgtcctttgggacacgccttctcccccggaagtggagcgcgctgttctggatgacggcatttacagaatcatgcagcgggggctgctcggacgcagccaggtgggcgtcggggtgtttcaagaaaacgttttccacaccatgtggcacgtgacaagaggagccgtcctgatgtatcagggcaaacggcttgagccttcctgggccagcgtgaagaaagacctgatttcttacgggggaggctggagactccagggctcctggaataccggggaggaagtgcaggttatcgctgtcgagcccggaaagaaccctaaaaatgtgcaaacagcccccggcacctttaagacaccggaaggggaggtgggagcgattgctctggatttcaagcctggcacgagcgggtctcccatcgtcaaccgcgaaggaaaaatcgtgggcctctacggcaatggggttgtgaccacatccggaacctatgtcagcgccattgcccaggctaaggcctcccaggagggccctctgcccgagatcgaagacgaggtgtttcggaaaagaaaccttaccattatggatctgcatcccgggtctggaaagacacgccggtacctgcctgcgatcgttagagaagctattaaacgcaagctccggacgctgatccttgccccgaccagagtggtcgccagcgagatggctgaagccctgaagggcatgcccatccgctatcaaacaaccgctgtgaaatccgagcacacagggaaggagattgttgacctcatgtgccatgccaccttcacgatgcggctgctgagccctgtgagagtccccaattacaacatgatcattatggatgaagcgcactttacagacccttcttccatcgccgctcggggctatattagcacccgcgtgggaatgggcgaggccgctgccatcttcatgaccgccacaccccctgggtctgtggaggcttttccgcagagcaatgcggtcatccaggatgaggaaagagacattcccgagcggtcctggaactctggatacgagtggatcaccgatttccctggcaaaacagtttggtttgtgcccagcattaagtccgggaatgacatcgccaactgtctccgcaaaaatggaaagagagtgattcagctttctcggaagaccttcgatacggaatatcagaaaaccaagaacaacgactgggactacgtcgtgaccacagatatcagcgagatgggcgctaatttcagagccgaccgcgttattgatcctcggagatgcctgaaacccgtgatcctgaaggacgggccggaacgcgtcatcctcgccggccctatgcccgtgaccgttgcttccgccgcgcagcggagaggacgcattggccggaaccataataaagagggggatcagtacatctatatgggacagcccctgaacaatgacgaggatcacgctcactggacggaagccaagatgcttctggacaacattaatacccctgagggcatcattcccgccctctttgaacctgagagagaaaagagcgctgccatcgatggggagtaccgcctgagaggagaggcgcggaaaacattcgtggaactgatgcgcagaggcgacctcccggtctggctttcttataaggtggcctccgaggggtttcaatacagcgatcggcgctggtgcttcgacggcgaaagaaacaatcaggtcctggaggaaaacatggatgtggagatctggaccaaagagggagaacggaagaaactgagaccccgctggctcgacgctcggacatattccgaccctctggcccttagagagtttaaggagttcgctgccggccgccggtctgttagcggggatctgattctcgagatcggaaaactgccccagcatctgacccagagagctcaaaatgccctcgacaaccttgtgatgctgcacaattccgaacagggcgggcgggcgtaccgccatgccatggaggagctgcctgatacaattgaaaccctcatgctgcttgctctgatcgccgtgctcacgggaggcgtcacactgtttttcctgtctggcagagggctcggaaagaccagcattggccttctgtgtgttatggcttccagcgtgctgctctggatggcctctgtggagccccactggatcgccgcttccatcattctggaatttttccttatggtcctgctcatcccggagcctgaccggcagcgcacaccccaggataaccaactggcgtatgtggttattgggctgctctttatgatccttacagtggccgctaatgagatgggactgctggaaaccacaaagaaagacctcggcattgggcacgtcgccgtggagaaccatcaccatgccgctatgctggatgtcgaccttcaccctgccagcgcgtggacgctgtacgccgtggctaccacaatcattacccccatgatgagacatacaatcgaaaacaccacggccaatatctctctcaccgctattgccaaccaggcggccatcctgatgggactggataagggctggcctatttccaaaatggacatcggcgttcccctccttgctctggggtgctacagccaggtgaatccgctgacactcaccgccgctgtcctgatgcttgtggcccactatgctattatcggacctggcctgcaagccaaggcgacacgggaggcccagaaacgcaccgctgccgggatcatgaagaaccccacggttgatggaattgtggctatcgacctcgatcccgtcgtgtacgacgccaagttcgaaaaacagctgggccagattatgctgctcatcctttgtacatctcaaattctgctgatgagaaccacatgggccctctgcgagagcatcaccctggcgaccgggcctcttacaacgctgtgggagggatccccgggcaagttttggaataccacaatcgctgtgtctatggccaacattttccggggcagctatctcgctggggccggactggccttctccctgatgaaaagcctcggcgggggacgcagaggcaccggggctcagggagaaacacttggcgagaagtggaaacggcagctgaatcagctgtccaagtctgaatttaacacctacaagagaagcggcatcatggaggttgaccgctccgaagccaaagaggggctcaagcggggagagacgacaaaacacgcggtctctagaggcaccgccaagctgcgctggttcgtggaacggaatcttgtgaaacccgaggggaaggtcattgatctgggatgtggcagagggggatggagctattactgcgctggcctcaagaaagttaccgaagtgaagggctatacaaaagggggacctggccatgaggaacccatccctatggccacctacgggtggaacctggtgaagctgcactccggaaaagacgtctttttcattccccctgagaagtgtgatacactcctttgcgacatcggcgagtctagcccgaatcccacgattgaagaggggcgcaccctgcgggtgctgaaaatggttgaaccttggctcagaggaaaccaattttgtatcaagatcctgaatccctacatgccttccgtggtcgagacacttgagcagatgcagcgcaagcatggcggcatgctggtgcggaaccccctcagcagaaattctacccacgaaatgtattgggtttcctgcgggacaggaaacattgtgagcgctgtcaatatgacctctcgcatgctgctgaaccggttcacgatggcccacagaaaaccgacctacgagcgcgatgtggacctcggcgcggggacaagacatgtggccgtcgaacctgaggttgctaacctggatatcattggacagcggatcgaaaatattaagcacgagcataaatccacctggcactatgacgaggataacccctacaagacatgggcctatcatggcagctacgaagtgaaaccctctgggtccgctagctccatggtgaatggagtcgtgaaacttctgaccaagccttgggacgttatccccatggtgacacaaatcgccatgaccgatacgacaccttttggccagcagcgcgtcttcaaagagaaggtggacaccagaaccccgaaagctaagcggggcacagcccaaattatggaagttacggcgaaatggctctgggggtttctgagcagaaacaagaagccccggatctgtacccgcgaggagttcacaagaaaagtgcggtctaatgccgctattggagccgtctttgtggacgagaaccagtggaatagcgctaaggaggccgttgaagatgagcgcttctgggaccttgtgcacagagaacgggagctgcacaaacagggcaagtgcgcgacctgcgtctataacatgatggggaaacgcgaaaagaagctcggagagtttggcaaagcgaaggggtccagagctatctggtacatgtggctgggcgcccggttcctggagttcgaagccctcggatttatgaatgaggatcattggttctctcgcgaaaacagcctgtccggcgtggagggggagggacttcacaaactgggctacattctcagagacatctctaagatccctgggggaaatatgtatgctgatgacacagccggctgggatacccggattacagaagacgatctgcagaacgaggctcgcatcaccgacattatggaacccgagcatgcccttctggcgaaaagcatctttaagctcacgtaccaaaataaagtcgtgagagttcagcggcctgccaagaacgggaccgtgatggatgtcatttcccgcagagaccagcggggctctggacaggtgggcacatatgggctgaataccttcacaaacatggaagctcaactgatcagacagatggagagcgagggaatcttttcccccagcgaactcgagaccccgaacctggccgaacgcgtgcttgattggctggagaagtacggcgttgaacggctcaaaagaatggctatttctggggacgactgtgtggtcaagcctatcgatgaccgcttcgccacggcgctgacagcccttaatgatatgggaaaagtgcggaaggacattccccagtgggagccttccaaaggctggaacgattggcagcaagttcccttttgcagccaccacttccatcagctgatcatgaaggacgggagagagattgtggtcccttgtcgcaatcaggatgaactcgtgggccgggctagagtctctcagggagccggctggtccctgcgcgagaccgcttgcctgggaaagagctatgcccaaatgtggcagctcatgtactttcaccggagagacctgcgccttgctgccaacgcgatctgttccgccgtgcccgttgattggattccgacatctcggaccacgtggagcatccatgctcaccatcagtggatgaccacagaagacatgctgtccgtgtggaatagagtctggatcgaggaaaacccttggatggaggataaaacccacattagctcttggggagacgtgccctatctcggcaagcgggaggaccaatggtgcgggtccctgatcggacttacagccagagccacctgggctacaaatattcaggttgccatcaaccaggtgcgccggctgattggcaatgaaaactacctcgattacatgaccagcatgaaaagattcaagaatgagtctgaccccgaaggggcgctgtggtga

SEQ ID NO: 19143 - RNA, 9879 nt, synthetic construct
  misc_feature 1..9879: note = derived and/or modified CDS sequence (opt5) from DENV-1__GU131683__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaccggccggcgttaacatgtgcacccttattgcgatggacctgggggagctctgtgaagatacaatgacctacaaatgcccccgcatcacagagaccgaacctgacgatgtggactgttggtgcaatgctacggatacctgggtgacatatggaacctgtagccaaacaggcgagcacagacgggacaagcgctccgtcgccctggccccccatgtggggctgggactcgagaccagaacggaaacatggatgtctagcgagggcgcttggaaacagattcagcgggttgaaacctgggccctgcgccaccctggcttcacagtgatcgctctttttctggcccatgcgattgggacctccatcacccagaagggaatcattttcatcctcctgatgcttgtcacaccctctatggccatgagatgcgtgggcattgggagccgggattttgttgagggactgtccggcgctacgtgggtggacgtcgtgctcgagcacgggagctgtgtgaccacaatggccaaggataaacctaccctggacatcgaactgctcaagacagaggtcaccaacccggctgttctgcgcaaactttgcattgaagccaagatctctaatacgacaaccgattccagatgtcccacccaaggagaggcgacactggtggaagagcaggacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacccctcaggctcccacaaccgagatccagctcacagactacggcgccctgaccctggattgtagccctcggacgggcctcgacttcaacgaaatggtgctgcttacaatgaaggagaaatcttggctggcccataagcagtggtttctcgatctgccccttccgtggacctccggggctagcacatcccaagagacctggaatcgccaggacctgctcgtcaccttcaaaacagcgcacgccaagaagcaggaagtggtcgtgctgggatctcaagagggcgctatgcacacggccctgaccggggccacagaaattcagaccagcggaacaaccacgatctttgctggccatctcaaatgcagactgaagatggataaacttacactgaaggggatgtcctatgttatgtgtaccggcagcttcaaactcgagaaggaactggccgagacccagcacggaacagtgctggtccagattaagtacgagggcaccgacgcgccttgcaaaatccccttctctacacaagatgaaaagggggtgacgcagaacggacggcttatcaccgctaatcctattgttacagacaaagagaagcccgtgaacatcgaagccgagcccccttttggcgagtcctatattgtcatcggggccggagaaaaagctctcaagctgagctggttcaagaaaggctctagcattgggaagatgtttgaggccaccgctagaggcgcccgccggatggcgatcctgggagatacagcctgggacttcggctccatcgggggagtgtttacctctgctggcaaactcgtgcatcagattttcgggacggcctacggagttctgtttagcggcgtctcctggaccatgaagatcgggattggcgtgcttctgacatggctcggactgaatagcagatctacctccctgagcatgacatgtatcgctgtgggccttgtcaccctctacctgggggtgatggttcaggccgattctggatgcgtgattaactggaaaggccgcgaactgaagtgtgggtccggaatcttcgtcacaaatgaggtgcacacctggacggaacaatataagtttcaggcggacagcccgaaacggctctccgccgctattggcaaggcctgggaggagggggtttgcggcatcagatctgctacacgcctggaaaacatcatgtggaaacagattagcaacgagcttaatcatatcctgctcgaaaacgacatgaagttcaccgtggtcgtgggagatgttgccggcattctggcccaggggaaaaagatgatccggccccaacctatggagtacaaatattcctggaagtcttggggaaaggctaaaattatcggcgcggacgtgcagaataccacatttatcattgatgggcccaacacccctgaatgtcccgacgatcagagagcctggaatatctgggaggtcgaggactacggattcggcatttttacgacaaacatctggctgaagcttcgcgatagctatacccaggtgtgcgaccaccggctcatgtccgctgccattaaagatagcaaggccgtgcacgctgacatgggctactggatcgaatctgagaaaaatgaaacatggaagctggccagagcgttcttcatcgaggtcaagacctgtatttggccgaaatcccatacactgtggagcaacggggttctcgaatctgagatgatcattcctaagatctatggaggccccatttcccaacacaattaccgccctgggtactttacccagacggctggaccctggcatctgggcaaacttgagctggatttcgacctctgcgaagggaccacagtggtggtcgatgagcactgcggaaaccggggccctagcctgagaaccacaaccgtgacgggcaagatcatccacgaatggtgttgccggtcttgtacactgcccccgcttcgctttagaggggaggacggatgctggtatggcatggagattcggcctgttaaagaaaaggaggaaaatctcgtgaagagcatggtctccgccgggagcggagaggtggactctttctccctgggcctgctctgtatcagcattatgatcgaagaggttatgagatcccgctggtctcggaaaatgctgatgaccgggacacttgccgtgtttttcctgctcattatgggacagctgacctggaacgatctgatcagactttgcattatggtcggcgctaatgccagcgaccgcatgggcatggggaccacatacctggcgctcatggctacgtttaagatgagacccatgttcgccgtgggactgctctttcggcgcctgacctccagagaggttcttctgctcacaatcggcctgtctctggtggccagcgtcgaacttcccaactccctggaggaactcggggatggactggctatgggcatcatgattctcaaactgcttaccgacttccaatctcatcagctgtgggccacactcctgagcctgacctttatcaagacgacattctcccttcactatgcttggaaaaccatggccatggtgctgagcattgtgtctctctttcctctgtgtctctccaccacaagccagaagaccacatggctgccggtccttctggggtctctgggatgcaagcccctcacgatgttcctgatcgcggagaataaaatttggggccggcgctcctggcctcttaacgaaggcatcatggccgttgggatcgtgagcattctgctctcttccctgctcaagaacgatgtgcccctggctggacctcttatcgccggcgggatgctgattgcttgttacgtcatcagcggatccagcgccgacctgtctctcgagaaagccgctgaggtgagctgggaagaggaagcggagcattccggcgcctctcacaatattctggttgaagtgcaggatgacgggaccatgaagatcaaagatgaggagagagacgatacacttaccatcctgctcaaggctacactgctcgccgtcagcggagtgtatcccctgtccattcctgccacccttttcgtttggtacttttggcaaaaaaagaagcagcggtctggcgtgctgtgggacacgcccagcccgcctgaagtcgagcgcgctgtgctggatgacggcatctatagaattatgcagcgggggctcctgggacgctcccaggtcggcgtgggggttttccaagaaaacgtgtttcataccatgtggcacgtcacaagaggagccgtgcttatgtaccagggcaaacggctggagccctcttgggcgagcgttaagaaagacctcatctcctacgggggaggctggagactgcagggcagctggaataccggggaggaagtgcaggtcattgctgtggagcctggaaagaaccccaaaaatgtgcaaacagccccgggcaccttcaagacacctgaaggggaggttggagccatcgctctcgattttaagcccggcacgtctgggtcccctattgtcaaccgcgaaggaaaaatcgtgggcctgtatggcaatggggtggtcaccacaagcggaacctacgtgtctgccatcgcgcaggctaaggcctcccaggagggcccccttcccgagattgaagacgaggttttccggaaaagaaacctgaccatcatggatctgcaccctgggagcggaaagacacgccggtatctcccggccattgtgagagaagctatcaaacgcaagctgcggacgcttattctggcccccaccagagtcgtggcttccgagatggccgaagcgctcaagggcatgcctatccgctaccaaacaaccgccgttaaatctgagcatacagggaaggagatcgtggacctgatgtgccacgctacctttacgatgcggctgctcagccccgtcagagtgcctaattataacatgattatcatggatgaagcccatttcacagacccctccagcattgctgcccggggctacatctctacccgcgttggaatgggcgaggccgctgcgatttttatgaccgccacacctccggggtccgtggaagctttcccccagagcaatgccgtcatccaggatgaggaaagagacatccctgagcggtcttggaacagcggatatgagtggattaccgattttcccggcaaaacagtgtggttcgtgccttccatcaagtctgggaatgacattgccaactgtcttcgcaaaaatggaaagagagtcatccagctgagccggaagaccttcgatacggaataccaaaaaacaaagaacaacgactgggactacgttgtgaccacagatatttccgagatgggcgctaattttagagccgaccgcgtgatcgatccccggagatgcctgaaaccggtcattctcaaggacgggcctgaacgcgtgatcctggcgggccccatgcccgttaccgtggcttctgccgcccagcggagaggacgcatcggccggaaccacaataaagagggggatcagtatatttacatgggacagcctcttaacaatgacgaggatcatgctcactggacggaagccaagatgctgctcgacaacatcaatacccccgagggcattatccctgcgctgttcgaaccggagagagaaaagagcgccgctattgatggggagtatcgcctgagaggagaggcccggaaaacatttgtcgaactcatgcgcagaggcgaccttcccgtgtggctgtcctacaaggttgctagcgaggggttccaatattctgatcggcgctggtgctttgacggcgaaagaaacaatcaggtgctggaggaaaacatggatgtcgagatctggaccaaagagggagaacggaagaaactcagacctcgctggctggacgcccggacatactccgacccccttgctctgagagagttcaaggaatttgccgcgggccgccggagcgtgtccggggatctcatcctggagattggaaaactgcctcagcacctcacccagagagcccaaaatgctcttgacaacctggtcatgctgcataattctgaacagggcgggcgggcctatcgccacgctatggaggagctccccgatacaatcgaaaccctgatgcttctggccctcattgccgtgctgacgggaggcgttacactgttctttctcagcggcagagggcttggaaagacctccatcggcctgctgtgtgtgatggcttctagcgtgctcctgtggatggcgtccgtcgagccgcattggattgccgctagcatcatccttgaattctttctgatggttctcctgattcctgagcccgaccggcagcgcacccctcaggataaccaactggcctacgtggtgatcgggctccttttcatgattctgacagtcgccgctaatgagatgggactgctcgaaaccacaaagaaagacctgggcatcgggcacgtggccgttgagaaccaccatcacgcggccatgcttgatgtggacctgcatcccgcttctgcctggacgctctacgctgtcgccaccacaattatcacccctatgatgagacacacaattgaaaacaccacggcgaatatctccctgaccgccatcgctaaccaggccgctattctgatgggactcgataagggctggcccatcagcaaaatggacattggcgtgccgcttctggccctggggtgctattctcaggtcaatcctctcacactgaccgctgccgtgcttatgctggttgcgcattacgccatcattggacccggcctccaagctaaggccacacgggaggctcagaaacgcaccgccgccgggatcatgaagaaccccacggtggatggaatcgtcgcgattgacctggatcctgtggtttatgacgctaagtttgaaaaacagctgggccagatcatgctccttattctgtgtacatcccaaatcctgctcatgagaaccacatgggccctgtgcgagagcattacccttgctaccgggccgctgacaacgctctgggagggatctcccggcaagttctggaataccacaatcgccgtgagcatggccaacatcttccggggctcctacctggctggggccggactggcgttttctctcatgaaaagccttggcgggggacgcagaggcaccggggcccagggagaaacactgggcgagaagtggaaacggcagctgaatcagctctccaagagcgaattcaacacctataagagatccggcattatggaggtcgaccgctctgaagctaaagaggggctgaagcggggagagacgacaaaacacgccgtgagcagaggcaccgctaagcttcgctggtttgtggaacggaatctggttaaacctgaggggaaggtcatcgatctcggatgtggcagagggggatggtcctactattgcgccggcctgaagaaagtgaccgaagtgaagggctacacaaaagggggacccggccacgaggaacctattcccatggcgacctacgggtggaacctggtcaagctccattctggaaaagacgttttctttatccctccggagaagtgtgatacacttctgtgcgacattggcgagagctcccccaatcctacgatcgaagaggggcgcaccctgcgggtgctcaaaatggtggaaccctggctgagaggaaaccaattctgtattaagatccttaatccttatatgccctctgtcgtggagacactggagcagatgcagcgcaagcacggcggcatgctcgttcggaacccgctgagcagaaattccacccatgaaatgtactgggtgagctgcgggacaggaaacatcgtctctgccgtgaatatgacctcccgcatgctgctcaaccggtttacgatggctcacagaaaacctacctatgagcgcgatgttgacctgggcgccgggacaagacacgtggctgtcgaacccgaggtggccaaccttgatattatcggacagcggattgaaaatatcaagcatgagcacaaaagcacctggcattacgacgaggataacccctataagacatgggcttaccacggctcttatgaagtgaaaccttccgggagcgcctcttccatggtcaatggagttgtgaagctgctcaccaagccctgggacgtgattcctatggtcacacaaatcgcgatgaccgatacgacaccgttcggccagcagcgcgtgtttaaagagaaggttgacaccagaacccccaaagccaagcggggcacagctcaaatcatggaagtgacggccaaatggctgtgggggttccttagcagaaacaagaagcctcggatttgtacccgcgaggaatttacaagaaaagtccggtccaatgctgccatcggagccgtgttcgttgacgagaaccagtggaatagcgcgaaggaggctgtggaagatgagcgcttttgggacctggtccatagagaacgggagctccacaaacagggcaagtgcgccacctgcgtgtacaacatgatggggaaacgcgaaaagaagctgggagagttcggcaaagccaaggggtctagagctatttggtacatgtggctgggcgcccggttcctcgagtttgaagctctgggattcatgaatgaggatcactggtttagccgcgaaaactccctttctggcgttgagggggagggactgcataaactcggctatatcctgagagacattagcaagatccccgggggaaatatgtacgccgatgacacagcgggctgggatacccggatcacagaagacgatcttcagaacgaggcccgcattaccgacatcatggaacctgagcacgctctgctcgccaaatccattttcaagctgacgtatcaaaataaagtggtcagagtgcagcggcccgctaagaacgggaccgtcatggatgtgatctctcgcagagaccagcggggcagcggacaggttggcacatacgggctgaatacctttacaaacatggaagcccaactcattagacagatggagtccgagggaatcttctctccgagcgaactggagacccctaaccttgcggaacgcgtgctggattggctcgagaagtatggcgtcgaacggctgaaaagaatggccatctccggggacgactgtgtggtgaagcccattgatgaccgctttgctacggcccttacagctctgaatgatatgggaaaagttcggaaggacatccctcagtgggagcccagcaaaggctggaacgattggcagcaagtgcctttctgctctcatcactttcaccagctcattatgaaggacgggagagagatcgtcgtgccctgtcgcaatcaggatgaactggttggccgggccagagtgtcccagggagctggctggagcctgcgcgagaccgcctgcctcgggaagtcttacgcgcaaatgtggcagctgatgtatttccatcggagagaccttcgcctggccgctaacgccatttgttccgccgtcccggtggattggatccctacaagccggaccacgtggtccattcacgctcatcaccagtggatgaccacagaagacatgctctctgtctggaatagagtgtggatcgaggaaaacccctggatggaggataaaacccatatcagctcctggggagacgttccctacctgggcaagcgggaggaccaatggtgcgggagccttattggactgacagccagagcgacctgggctacaaatatccaggtggccattaaccaggtccgccggctcatcggcaatgaaaactacctggattatatgacctctatgaaaagatttaagaatgagtccgaccctgaaggggccctgtggtga

SEQ ID NO: 19144 - RNA, 9879 nt, synthetic construct
  misc_feature 1..9879: note = derived and/or modified CDS sequence (opt5) from DENV-1__GU131684__SS-prME
  source 1..9879: mol_type = other RNA
agcgtgaccatgctgctgatgctgatgcccacagcccttgctttccacctgacgacccggggcggggagcctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctaaggtgtccgctgggagcggagaggtcgactccttttctctcggcctgctgtgtatcagcattatgatcgaagaggtgatgcggtccagatggtctcgcaaaatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaagatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaaactcctgaccgactttcaaagccatcagctttgggctacactgctctctctgaccttcatcagaacaaccttttccctgcactatgcctggaagacgatggctatggttcttagcattgtgtctctgttccccctctgtctgtccacaaccagccagaagaccacatggctccctgtgctgcttgggtctctgggatgcaaaccgctgaccatgtttctcatcgccgagaataagatttggggccggaaatcctggcccctgaacgaaggcatcatggcggtcgggatcgtgagcattcttctgtccagcctcctgaagaacgatgttcctctcgccggacccctgatcgctggcgggatgcttattgcctgttacgtgatctctggaagctccgctgacctgtctctggagaaagccgccgtcgtgagctgggaggaagaggctgaacattccggcgcgtctcacaatattctcgttgaggtgcaggatgacgggacaatgaagatcaaagatgaggaacgcgacgatacgctgaccatccttctgaaggccacactcctggctgtcagcggagtgtatcctctctccattcccgccaccctgttcgtctggtacttctggcaaaagaaaaagcagagatctggcgtgctttgggacacaccttcccctcccgaggttgaacgggccgtgctggatgacggcatctatcgcattatgcagagagggctgctcggacggtcccaggtcggcgtgggggtttttcaagagaacgtgttccataccatgtggcacgtcacgcgcggagctgtgctgatgtaccagggcaaaagacttgaacccagctgggcctctgtgaagaaagacctgatctcctacgggggaggctggcggctccagggcagctggaataccggggaggaggttcaggtcattgcggtggaacccggaaagaaccctaagaatgtgcaaacagctcccggcacctttaaaacatctgagggggaagtcggagccatcgccctggatttcaagccgggcacctccgggagccctattgtgaacagagagggaaaaatcgttggcctctatggcaatggggtggtcacaacgtccggaacctacgtgtctgctatcgcccaggcgaaggctagccaggaaggccccctgcctgagattgaggacgaagtttttcgcaaacggaaccttacaatcatggatctgcaccccgggtccggaaagaccagacgctatctgcccgccattgtgcgggaggccatcaagagaaaactccgcaccctgattcttgctcctacacgggtcgtggccagcgaaatggctgaggccctgaagggcatgccgatcagataccaaacgaccgcggttaaatctgaacatacagggaaggagatcgtggacctcatgtgccacgccaccttcacaatgcgcctgctgtcccccgtccgggtgcctaattataacatgattatcatggatgaggctcattttaccgaccccagctctattgccgctagaggctacatcagcacgcgggtgggaatgggcgaagccgccgctattttcatgacagcgacccctcccgggtccgtcgaggcctttcctcagtctaatgctgttatccaggatgaggaacgcgacatcccggaaagaagctggaactccggatatgagtggattaccgatttccccggcaaaacagtgtggtttgtgccttctatcaagagcgggaatgacattgccaactgtctccggaagaatggaaaacgcgtcatccagctttccagaaagaccttcgatacagagtaccagaagaccaagaacaacgactgggactacgtggttacgacagatattagcgaaatgggcgccaatttccgggctgacagagtgatcgatccccgccggtgcctgaaacctgtcattctgaaggacgggcccgagagagtgatcctcgccggcccgatgcctgttaccgtggcgtctgctgcccagcgccggggaagaatcggccgcaaccacaataaggaaggggatcagtatatttacatgggacagcccctgaacaatgacgaggatcatgcccactggacagaggctaaaatgcttctggacaacatcaatacccccgaaggcattatccctgccctctttgagcccgaacgggagaagtccgcggccattgatggggaatatagactgcgcggagaggctagaaaaacgttcgtcgagctgatgcggcgcggcgacctccctgtgtggcttagctacaaggtcgcctccgaagggtttcaatattctgatagacggtggtgcttcgacggcgagcgcaacaatcaggtgctggaagagaacatggatgttgaaatctggaccaaagagggagagagaaagaaactgcggccgagatggctcgacgctcgcacatacagcgaccccctggcccttcgggaatttaaggagttcgctgccggcagacgctccgtgtctggggatctgatcctcgaaattggaaagctgcctcagcacctgacccagcgggcgcaaaatgccctcgacaaccttgtgatgctgcataatagcgagcagggcgggagagcttatcggcacgccatggaggaactgcccgatacaatcgagaccctcatgctgcttgctctgattgccgtcctcacaggaggcgttaccctgtttttcctgtccggccgcgggctcggaaaaacgagcatcggccttctgtgtgtgatggcctcttccgtgctgctctggatggctagcgtcgaacctcattggattgcggcctctatcatcctggagtttttccttatggtgctgctcattcccgaaccggacagacagcggacacctcaggataaccaactggcttacgttgtgatcgggctgctctttatgattcttaccgtcgccgccaatgagatgggactgctggagaccacaaagaaagacctcggcatcgggcacgtggctgtcgaaaaccaccatcacgccgcgatgctggatgtggaccttcatcccgcctccgcttggaccctgtacgccgttgctacaacgattatcacccctatgatgcgccacacaattgagaacaccacagccaatatcagcctcaccgcgatcgccaaccaggctgccattctgatgggactggataagggctggcccatctctaaaatggacattggcgtgcctctccttgctctggggtgctatagccaggtcaatcccctgacgctcaccgccgctgtgctgatgcttgttgcccattacgcgatcattggaccgggcctgcaagccaaggctacaagagaagcccagaagcggaccgctgccgggatcatgaaaaaccctacagtggatggaatcgtcgccattgacctcgatcccgtggtgtatgacgcgaagttcgagaaacagctgggccagatcatgctgctcattctttgtacctcccaaatcctgctgatgcgcacgacatgggctctctgcgaatctattaccctggccacagggccccttaccaccctgtgggagggaagccctggcaagttttggaatacaacgatcgctgtttccatggccaacatcttcagaggcagctacctcgccggggctggactggccttctccctgatgaaatctctcggcgggggacggcgcggcaccggggcgcagggagagacacttggcgaaaagtggaagagacagctgaatcagctgagcaaatccgagtttaacacctataagcggtctggcattatggaagtcgacagaagcgaggccaaagaagggctcaagcgcggagagacaaccaaacacgctgtgtcccggggcacggccaagctgagatggttcgtggagcgcaatcttgtcaagccggaagggaaagttatcgatctgggatgtggcagagggggatggtcttactattgcgctggcctcaagaaagtgacagaggtgaagggctacaccaaagggggacccggccacgaggagcctattcccatggccacctacgggtggaacctggtcaagctgcatagcggaaaagacgtgtttttcatccctcccgaaaagtgtgatacactcctttgcgacattggcgagtccagccctaatccgaccatcgaggaagggagaacactgcgcgttctgaagatggtggagccctggctccggggaaaccaattttgtattaaaatcctgaatccttatatgccctctgtcgtggaaacgcttgagcagatgcagagaaagcacggcggcatgctggttcgcaaccctctctcccggaatagcacccatgagatgtactgggtgtcttgcgggacaggaaacatcgtctccgcggtgaatatgaccagcagaatgctgctgaaccgcttcacaatggcccaccggaaacccacctatgaaagagatgtggacctcggcgctgggacgcgccacgtcgccgttgagccggaagtggctaacctggatattatcggacagagaattgagaatatcaagcatgaacacaaatctacctggcattacgacgaggataacccttataagacatgggcctaccacggctcctatgaggtgaagcccagcgggtccgctagctctatggtcaatggagtggttaaacttctgaccaagccctgggacgtgattcctatggtcacacaaatcgccatgaccgatacaaccccctttggccagcagcgggtgttcaaagaaaaggttgacacgcgcacacctaaagcgaagagaggcaccgcccaaatcatggaggtgaccgctaagtggctctgggggtttctgagccggaacaaaaagccgagaatttgtacacgggaagagttcacgcgcaaagtcagatccaatgccgctatcggagccgtgtttgttgacgaaaaccagtggaactctgccaaggaggcggtggaggatgaacggttctgggaccttgtccatcgcgagagagaactgcacaaacagggcaagtgcgctacctgcgtgtacaacatgatggggaagcgggagaaaaagctcggagaatttggcaaagccaaggggagccgcgccatttggtacatgtggctgggcgctagattcctggagttcgaggccctcggatttatgaatgaagatcactggttctcccgggagaactctctgagcggcgtcgaaggggagggacttcataaactgggctatatcctccgcgacatttccaagatccccgggggaaatatgtacgctgatgacacagccggctgggataccagaatcacagaggacgatctgcagaacgaagcgaaaattaccgacatcatggagcctgaacacgcccttctggctaagtctatttttaagctcacatatcaaaataaagtggttcgggtgcagcgccccgccaagaacgggaccgtcatggatgtgatcagcagacgggaccagcgcggctccggacaggtgggcacgtacgggctgaataccttcacaaacatggaggctcaactgattagacagatggaaagcgagggaatcttttctccttccgagctcgaaacccccaacctggccggccgggttcttgattggctggagaaacatggggtggaaagactcaagcgcatggcgatcagcggagacgactgtgtcgtgaaaccgattgatgaccggttcgccacagctctgaccgcccttaatgatatgggcaaggttagaaaggacatccctcagtgggagccctctaaagggtggaacgattggcagcaagtgcctttttgctcccaccacttccatcagctgattatgaaggacggccgcgaaatcgtcgtgccctgtcggaatcaggatgagctcgtcggcagagctcgcgtgagccagggagccgggtggtccctgcgggagacggcttgcctgggaaaatcttatgcccaaatgtggcagctcatgtactttcacagacgcgacctgcggcttgcggccaacgctatttgtagcgccgttcctgtggattgggtccccacatccagaaccacatggagcatccatgcccaccatcagtggatgaccacggaagacatgctgtctgtgtggaatcgcgtttggattgaggaaaacccgtggatggaggataagacccacatctccagctggggcgacgtgccttatctcgggaaacgggaagaccaatggtgcggatctctgatcggccttacagctagagccacctgggcgacaaatattcaggtcgctatcaaccaggtgcggagactgctcgggaatgagaactacctggattacatgaccagcatgaagcgcttcaagaatgagtccgaccccgaaggcgccctgtggtga

SEQ ID NO: 19145 - RNA, 9879 nt, synthetic construct
  misc_feature 1..9879: note = derived and/or modified CDS sequence (opt5) from DENV-1__GU131685__SS-prME
  source 1..9879: mol_type = other RNA
agcgtgaccatgctgctcatgctgatgcccacagcccttgctttccacctgacgaccagaggaggggagcctcatatgatcgtgtccaagcaggaacggggaaaatctctcctgtttaagacaagcgccggagttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggagaaacttacactgaaggggatgagctatgtgatgtgtaccggctctttcaaactcgaaaaggaggtcgctgagacccagcacggaacagtgctggttcagattaagtacgaaggcaccgatgccccgtgcaaaatccctttctccacacaagacgagaagggggtgacgcagaacggacggctgatcaccgcgaatcccattgtcacagataaagaaaagcctgtgaacatcgaggctgagccgccctttggcgaaagctatattgtgatcggggccggagagaaagcccttaagctctcttggttcaagaaaggcagctccattgggaagatgtttgaagctaccgccagaggcgctcgccggatggccatcctgggagacacagcgtgggatttcggctctatcgggggagtttttaccagcgtcggcaaactgattcatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgactccggatgcgtgatcaactggaaaggccgcgagctgaagtgtgggagcggaattttcgttacaaatgaagtgcacacctggacggagcaatataagtttcaggctgattcccctaaacggctgtctgccgcgatcggcaaggcctgggaggaaggggtctgcggcatcagaagcgctacacgcctcgagaacattatgtggaaacagatctccaacgaactgaatcatattcttctggagaacggaatgaagttcaccgtggttgtgggcgacgtcgccgggatcctcgctcagggcaagaagatgattcggccgcaacccatggaatacaaatattcttggaaaagctggggcaaggccaagatcatcggggccgacgtgcagaataccacatttattatcgatggacctaacacccccgagtgtcctgacgatcagagagcttggaatatttgggaggtggaagactacggcttcggcatctttacgacaaacatttggctgaagctgcgcgattcctatacccaggtctgcgaccaccggcttatgagcgcggccatcaaagattctaaggctgttcacgccgacatggggtactggatcgagtccgagaaaaatgagacatggaagctcgccagagctagcttcattgaagtgaagacctgtatctggcccaaatctcatacactgtggtccaacggagtgctggagagcgagatgattatcccgaagatttatggcgggcctatctctcaacacaattaccgccccggatacttcacccagacggccggcccttggcatctcgggaaactggaacttgattttgacctgtgcgagggaaccacagtcgtggttgatgaacactgcggcaaccggggccccagcctcagaaccacaaccgtgacggggaagatcattcacgagtggtgttgccggtcctgtacactgcctcccctgcgcttcagaggagaggacggctgctggtatgggatggaaatccggccggtcaaagagaaggaagagaatcttgtcaagagcatggtttctgcgggatccggcgaagtggatagcttttccctcgggctgctgtgtatttctatcatgattgaggaggtcatgagaagccgctggtcccggaaaatgctcatgaccggaacactggctgtgttctttcttctgatcatgggccagctcacctggaacgacctgattagactgtgcatcatggttggcgccaatgcctctgaccgcatggggatgggaaccacataccttgctctgatggccacgttcaagatgagacctatgtttgcggtgggcctcctgttccggcgcctcaccagcagagaagtcctgcttctgacaatcgggctctccctggtggcttctgtggagctgcccaacagccttgaagaactgggagatggcctcgccatggggattatgatcctgaaactcctgaccgactttcaatcccatcagctttgggccacactgctcagcctgaccttcattaagacgacattttctctgcactatgcttggaaaaccatggccatggtcctttccatcgttagcctgttccccctctgtctgtctaccacatcccagaagaccacatggctccctgtgctgcttggaagcctgggctgcaagccgctgacgatgtttctcattgctgaaaataaaatctggggccggcgctcttggcccctgaacgaggggatcatggccgtgggaattgtctccatccttctgagctccctcctgaagaacgatgtgcctctcgcgggccccctgattgccgggggaatgcttatcgcttgttacgttattagcggctctagcgccgacctgtccctggagaaagctgccgaagtgtcttgggaggaagaggccgaacatagcggggcttcccacaatatcctcgtcgaggtgcaggatgacggaaccatgaagatcaaagatgaggaaagagacgatacactgaccattcttctgaaggcgacactcctggccgtttctggcgtgtatcctctcagcatccccgctaccctgttcgtctggtacttctggcagaaaaagaagcagcggtccggcgtgctttgggacacgccttctcccccggaggtcgaacgcgccgtgctggatgacgggatttatagaatcatgcagcggggactgctcggccgcagccaggttggggtgggagtctttcaagagaacgtgttccataccatgtggcacgttacaagaggcgccgtgctgatgtaccaggggaaacggcttgagccttcctgggctagcgtcaagaaagatctgatttcttacggaggcggctggagactccaggggtcctggaataccggagaagaggtccaggtgatcgccgttgaacccggcaagaaccctaaaaatgtccaaacagcgcccgggacctttaagacaccggagggagaagtgggcgctattgccctggacttcaagcctgggacgagcggatctcccatcgtgaaccgcgagggcaaaatcgtcggcctctatgggaatggagtggttaccacatccggcacctacgtgagcgccattgctcaggccaaggcgtcccaggaggggcctctgcccgaaatcgaggacgaagtctttcggaaaagaaaccttaccattatggatctgcaccccggatctggcaagacacgccggtatctgcctgctatcgtgagagaggccattaaacgcaagctccggacgctgatccttgccccgaccagagttgtggctagcgaaatggccgaggctctgaaggggatgcccatccgctaccaaacaaccgccgtcaaatccgagcatacaggcaaggaaattgtggacctcatgtgccacgcgaccttcacgatgcggctgctgagccctgttagagtgcccaattataacatgatcattatggatgaggcccattttacagacccttcttccatcgctgcccggggatacattagcacccgcgtcggcatgggggaagctgccgccatcttcatgaccgctacaccccctggatctgtggaggcgtttccgcagagcaatgccgtgatccaggatgaagagagagacattcccgagcggtcctggaactctggctatgaatggatcaccgatttccctgggaaaacagtctggtttgttcccagcattaagtccggaaatgacatcgctaactgtctccgcaaaaatggcaagagagtgattcagctttctcggaagaccttcgatacggagtaccagaaaaccaagaacaacgactgggattacgtggtcaccacagacatcagcgaaatgggggccaatttcagagccgaccgcgtgattgatcctcggagatgcctgaaacccgttatcctgaaggacggcccggagcgcgtgatcctcgctggacctatgcccgtcaccgtggcctccgcggctcagcggagaggccgcattgggcggaaccacaataaagagggagatcagtatatctacatgggccagcccctgaacaatgacgaagatcatgcccactggacggaggccaagatgcttctggacaacattaatacccctgaagggatcattcccgctctctttgagcctgaaagagaaaagagcgccgcgatcgatggagagtatcgcctgagaggcgaagcccggaaaacattcgttgagctgatgcgcagaggggacctcccggtgtggctttcttacaaggtcgcttccgaaggctttcaatatagcgatcggcgctggtgcttcgacggagagagaaacaatcaggtgctggaagagaacatggatgtcgagatctggaccaaagaaggcgagcggaagaaactgagaccccgctggctcgacgcccggacatactccgatcctctggctcttagagaatttaaggagttcgccgctgggcgccggtctgtgagcggagacctgattctcgaaatcggcaaactgccccagcacctgacccagagagcccaaaatgcgctcgacaaccttgttatgctgcataattccgagcaagggggacgggcctatcgccacgctatggaggaactgcctgatacaattgagaccctcatgctgcttgccctgatcgctgtgctcacgggcggcgtgacactgtttttcctgtctgggagaggactcggcaagaccagcattgggcttctgtgtgtcatggcctccagcgttctgctctggatggcctctgtggaaccccattggatcgctgcgtccatcattctggagtttttccttatggtgctgctcatcccggagcctgaccggcagcgcacaccccaggataaccaactggcctacgtcgtgattggactgctctttatgatccttacagttgctgccaatgaaatgggcctgctggagaccacaaagaaagacctcgggattggacacgtggccgtcgaaaaccaccatcacgctgccatgctggatgtggaccttcatcctgcgagcgcctggacgctgtacgctgtcgccaccacaatcattacccccatgatgagacacacaatcgagaacaccacggctaatatctctctcaccgccattgcgaaccaggccgctatcctgatgggcctggataagggctggcctatttccaaaatggacatcggggtgcccctccttgccctgggatgctatagccaggttaatccgctgacactcaccgctgccgtgctgatgcttgtcgctcattacgccattatcggccctgggctgcaagcgaaggccacacgggaagctcagaaacgcaccgccgctggaatcatgaagaaccccacggtggatggcattgttgccatcgacctcgatcccgtggtctatgacgccaagttcgagaaacagctggggcagattatgctgctcatcctttgtacatctcaaattctgctgatgagaaccacatgggcgctctgcgagagcatcaccctggctaccggacctcttacaacgctgtgggaaggctccccgggcaagttttggaataccacaatcgccgtgtctatggctaacattttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggatcatggaagtggatcgctccgaggcgaaagagggactcaagcggggcgaaacgacaaaacacgccgtttctagagggaccgctaagctgcgctggttcgtcgagcggaatcttgtgaaacccgaaggaaaggtgattgacctgggctgtgggagaggaggctggagctactattgcgccggcctcaagaaagtcaccgaggttaaggggtacacaaaaggaggccctgggcacgaggaacccatccctatggctacctacggatggaacctggtgaagctgcattccggcaaagacgtgtttttcattccccctgagaagtgtgatacactcctttgcgacatcggggaatctagcccgaatcccacgattgaggaaggacgcaccctgcgggtcctgaaaatggtggagccttggctcagaggcaaccaattttgtatcaagatcctgaatccctatatgccttccgttgtggagacacttgaacagatgcagcgcaagcacggcgggatgctggtccggaaccccctcagcagaaattctacccatgagatgtactgggtgtcctgcggaacaggcaacattgttagcgccgtgaatatgacctctcgcatgctgctgaaccggttcacgatggcgcacagaaaaccgacctatgaacgcgatgtcgacctcggggccggaacaagacacgtggctgtggagcctgaagtcgccaacctggatatcattggccagcggatcgagaatattaagcatgagcacaaatccacctggcattacgacgaagataacccctataagacatgggcttaccacgggagctatgaggttaaaccctctggatccgccagctccatggtgaatggcgtggtcaaacttctgaccaagccttgggacgtgatccccatggttacacaaatcgctatgaccgatacgacaccttttggccagcagcgcgtgttcaaagaaaaggtcgacaccagaaccccgaaagccaagcgggggacagcgcaaattatggaggtgacggccaaatggctctggggatttctgagcagaaacaagaagccccggatctgtacccgcgaagagttcacaagaaaagttcggtctaatgctgccattggcgctgtgtttgtcgatgagaaccagtggaatagcgccaaggaagccgtggaggacgaacgcttctgggaccttgttcatagagagcgggaactgcacaaacaggggaagtgcgcgacctgcgtgtacaacatgatgggaaaacgcgagaagaagctcggcgagtttgggaaagctaagggctccagagccatctggtacatgtggctgggagcccggttcctggagttcgaggctctcggctttatgaatgaagatcactggttctctcgcgagaacagcctgtccggggtcgagggagaaggccttcataaactggggtatattctcagagacatctctaagatccctggaggcaatatgtacgccgatgacacagctgggtgggatacccggattacagaggacgatctgcagaacgaagcccgcatcaccgacattatggagcccgaacacgcgcttctggccagaagcatctttaaactcacgtatcaaaataaggtggtccgggtgcagcgccctgctaaaaacggcaccgttatggatgtgatttccagacgggaccagagaggatctggccaggtcgggacatacggactgaataccttcacaaacatggaggcccaactgatccgccagatggagagcgaaggcatcttttcccccagcgagctcgaaaccccgaacctggctgagcgggtgcttgattggctggaaaagtatggggtggagagactcaagcgcatggccatttctggagacgattgtgttgtgaaacctatcgacgaccggttcgcgacggccctgacagctcttaatgatatgggcaaggtcagaaaagacattccccagtgggagccttccaaggggtggaacgattggcagcaagtgcccttttgcagccatcacttccaccagctgatcatgaaagacggccgcgaaattgttgtgccttgtcggaatcaggatgagctcgtcggcagagcccgcgtgtctcagggcgctgggtggtccctgcgggaaaccgcctgcctgggaaagagctacgctcaaatgtggcagctcatgtattttcatagacgcgacctgcggcttgccgcgaacgccatctgttccgctgtccccgtggattggattccgacatctagaaccacgtggagcatccacgcccatcaccagtggatgaccacagaggacatgctgtccgtttggaatcgggtgtggatcgaagagaacccttggatggaggataagacccatattagctcttggggcgacgtcccctacctcgggaaaagagaagatcaatggtgcggatccctgatcggccttacagcccgcgctacctgggccacaaatattcaggtggcgatcaaccaggttcggagactgattgggaatgagaactacctcgactatatgaccagcatgaagcgcttcaaaaatgaatctgaccccgagggcgctctgtggtga

SEQ ID NO: 19146 - RNA, 9879 nt, synthetic construct
  misc_feature 1..9879: note = derived and/or modified CDS sequence (opt5) from DENV-1__GQ868614__SS-prME
  source 1..9879: mol_type = other RNA
agcgtgaccatgctgctcatgctgatgcccacagcccttgctttccacctgacgaccagaggcggggagcctcatatgatcgtcacaaagcaggaacggggaaaatccctcctgtttaagacctctgccggcgttaacatgtgcacacttattgcgatggacctgggggagctctgtgaagataccatgacatacaaatgcccgcgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagagcaggacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattaccccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggcccgttcaaactcgagaaggaagtggccgagacccagcacggaaccgtcctggtgcagattaagtacgagggcacagacgcgccttgcaaaatccccttctctacccaagatgaaaagggggttatccagaacggacggctgattacagctaatcctatcgtgacggacaaagagaagcccgtcaacattgaagccgagcccccttttggcgagtcctatatcgtgattggggtgggagaaaaagcccttaagctcagctggttcaagaaaggctctagcatcgggaagatgtttgaggctaccgccagaggcgctcgccggatggccatcctgggagatacagcgtgggacttcggctccattgggggagtttttacctctgtcggcaaactggtgcatcagatcttcggggccgcttacggagtgctctttagcggcgtctcctggacaatgaagattgggatcggcgtgctgcttacctggctgggactcaatagcagatctacgtccctgagcatgacctgtattgccgttggcctggtgacactttacctcggggtcatggtgcaggctgattctggatgcgttatcaactggaaaggccgcgaactgaagtgtgggtccggaattttcgtgaccaatgaggtccacacatggaccgaacaatataagtttcaggccgacagcccgaaacggctgtccgcggccatcggcaaggcttgggaggagggggtgtgcggcatcagatctgttacacgcctcgaaaacattatgtggaaacagatcagcaacgagctgaatcatattcttctggaaaacgacatgaagttcaccgtggtcgtgggagatgtggtcggcatcctcgcccaggggaaaaagatgattcggccccaacctatggagcacaaatactcctggaagtcttggggaaaggctaaaatcatcggcgccgacgttcagaatacgacatttattatcgatgggcccaacacccctgaatgtcccgacgatcagagagcctggaatatttgggaggtggaggactatggattcggcatctttaccacaaacatttggctgaagctgcgcgatagctacacccaggcttgcgaccaccggcttatgtccgcggccatcaaagatagcaaggctgtgcatgccgacatgggctattggatcgaatctgagaaaaatgaaacgtggaagctcgccagagcttccttcattgaggtcaagacatgtatctggccgaaaagccacaccctgtggtctaacggggtgctggaatccgagatggttattcctaagatctacggaggccccattagccaacataattatcgccctgggtacttcacacagaccgccggaccctggcacctcggcaaactggagcttgattttgacctgtgcgaagggacaaccgtggtcgtggatgagcactgcggaaaccggggcccttctctcagaacgaccacagttaccggcaagatcatccatgaatggtgttgccggagctgtacactgcccccgctgcgcttcaaaggggaggacggatgctggtacggcatggagattagacctgtgaaggaaaaggaggaaaatcttgtcaaatccatggtgagcgcggggtctggagaggttgactcctttagcctcggcctgctgtgtatctccattatgatcgaagaggtgatgcggtctagatggagccgcaagatgctcatgaccgggacgctggctgtcttccttctgctcattatgggacagctgacatggaacgatctgatccggctttgcattatggtgggcgccaatgcctccgacagaatgggcatggggaccacatatctggctctcatggccacctttaaaatgcgccccatgttcgcggtgggactgctctttagacggctgacctctcgcgaggtccttctgctcacaatcggcctgagcctggttgcttccgtggaacttcccaactctctggaggaactcggggatggactggccatgggcatcatgattctcaagctgcttacggacttccaaagccaccagctgtgggccaccctcctgtccctgacatttatcaaaaccacacttagcctgcattacgcttggaagaccatggccatggtgctctctattgtctccctgttccctctctgtctgagcacgacatctcagaagaccacctggcttccggtgctgctggggtccctcggatgcaaacccctgacaatgtttcttatcgctgagaataagatttggggcagaaaaagctggcctctgaacgaaggcatcatggccgttggggtggtctctatcctcctgtccagcctcctgaagaacgatgtgccccttgcgggacctctgattgccggcgggatgctgatcgcttgttatgttatttccggaagctctgccgacctcagcctggagaaagctgccgaggtgtcctgggaagaggaagccgagcactctggcgctagccataatatccttgtcgaagtgcaggatgacgggaccatgaagattaaagatgaggagcgggacgatacactgacgatcctcctgaaggcgaccctcctggccgtctccggagtgtaccccctttctatccctgctacactgttcgtttggtatttttggcaaaagaaaaagcagcgcagcggcgtgctgtgggacaccccctccccgcctgaagtcgagagagccgtgctcgatgacggcatttaccggatcatgcagcgcgggctgcttggaagatctcaggttggcgtgggggtcttccaagaaaacgtgttccacacaatgtggcacgtgacccggggagccgttctgatgtatcagggcaaacgcctcgagcccagctgggcttccgtcaagaaagacctgattagctacgggggaggctggagactccagggctcttggaatacgggggaggaagtgcaggtgatcgccgtcgagcctggaaagaaccccaagaatgtgcaaaccgcgccgggcacatttaaaacccctgaaggggaggttggagctattgccctggatttcaagcccggcacatccgggagccctatcgtgaaccgggaaggaaaaattgtcggcctttacggcaatggggtggttaccacatctggaacgtatgtgtccgccatcgctcaggccaaggcgagccaggagggccccctgcccgagatcgaagacgaggtctttagaaaacgcaacctgaccattatggatctccatcctgggtccggaaagacacggagatacctgccggctatcgtgcgcgaagccattaagcggaaacttagaaccctgatcctcgcccccacccgcgttgtggcttctgagatggccgaagctctgaagggcatgcctattcggtatcaaacaacggccgtcaaaagcgagcacaccgggaaggagatcgtggacctgatgtgccatgcgacattcaccatgagactcctttcccccgtgcgcgtccctaattacaacatgatcattatggatgaagcccactttacagaccccagctctatcgctgcccggggctatatttccaccagagttggaatgggcgaggctgccgccatcttcatgacggctacacctccggggagcgtggaagcgtttccccagtctaatgccgtgattcaggatgaggaacgggacatccctgagcgcagctggaactccggatacgagtggatcaccgatttccccggcaaaaccgtctggtttgtgccttctattaagagcgggaatgacatcgctaactgtctgagaaagaatggaaaacgggttattcagctgtcccgcaagacattcgataccgaatatcaaaaaacaaagaacaacgactgggactacgtggtcaccacggatatctctgagatgggcgccaattttagagccgaccgggtgattgatcccagacgctgcctcaaaccggttatcctgaaggacgggcctgaacgggtgattcttgctggccccatgcccgtcacagtggccagcgcggctcagagacgcggacggatcggcagaaaccataataaggagggggatcagtacatctatatgggacagcctctgaacaatgacgaggatcacgcccactggaccgaagccaaaatgctcctggacaacattaatacacccgagggcatcattcctgctctgttcgaaccggagcgcgaaaagtccgccgcgatcgatggggagtaccggctcagaggagaggcccgcaaaaccttcgtcgaacttatgagacggggcgacctgcccgtgtggctgagctataaggttgcttctgaggggtttcaatactccgatcgcagatggtgcttcgacggcgaacggaacaatcaggtgctcgaggaaaacatggatgtggagatttggacgaaagagggagaacgcaagaaactgagacctcggtggcttgacgccagaacctatagcgaccccctggctctccgcgagtttaaggaattcgccgctggccggagatccgtctctggggatctgatcctggagatcggaaagctccctcagcatcttacacagcgcgcccaaaatgcgctggacaacctggttatgctccacaatagcgaacagggcgggcgggcctacagacatgctatggaggagctgcccgataccattgaaacacttatgctgctcgccctgatcgctgtgctgaccggaggcgtgacactctttttcctttccggccgggggctgggaaaaacctctattggcctgctctgtgtcatggccagctccgtgctgctttggatggccagcgttgagccgcactggatcgctgcgtctattatcctggaatttttcctcatggtgctgctgatccctgagcccgaccgccagagaacgcctcaggataaccaactcgcctatgtcgtgattgggcttctgtttatgatcctgacagtcgctgccaatgagatgggactcctggaaaccaccaagaaagaccttggcattgggcacgtggccgttgagaaccatcaccatgctacaatgctggatgtggacctccaccccgcctccgcgtggaccctgtacgccgtcgctacaacgatcattacccctatgatgcggcatacaatcgaaaacaccacagccaatattagcctgaccgctatcgccaaccaggcggccatcctcatgggacttgataagggctggcccatttctaaaatggacatcggcgtgccgctgctggctctcgggtgctactcccaggttaatcctctgacgcttaccgccgctgtgctgatgctcgtcgcccactatgctattatcggacccggcctgcaagccaaggcgacacgcgaggcccagaagagaaccgctgccgggattatgaaaaaccccacagtggatggaatcgtggctatcgacctggatcctgttgtctacgacgccaagttcgaaaaacagctcggccagattatgcttctgatcctgtgtaccagccaaattctcctgatgcggacgacatgggccctttgcgagtctatcaccctggcgacagggccgctcaccaccctgtgggagggaagccccggcaagttttggaatacaacgattgctgtgtccatggccaacatcttccgcggctcttatctggctggggccggactcgcctttagccttatgaaatccctgggcgggggaagacggggcaccggggctcagggagaaacactgggcgagaagtggaagcgccagctcaatcagctgagcaaatccgaattcaacatctacaagagatctggcattatggaggtggaccggagcgaagccaaagaggggcttaagagaggagagaccacacgccacgcggtctcccggggcaccgccaaactgagatggttcgttgaacgcaatctcgtgaagcctgaggggaaggtgatcgatctgggatgtggccgggggggatggtcttattactgcgctggcctgaaaaaggtcacggaagtgaaaggctatacaaaggggggacccggccatgaggaacctattcccatggccacctacgggtggaacctcgttaaacttcacagcggaaaggacgtgtttttcacccctccggagaaatgtgatacactgctgtgcgacatcggcgagtcctctcccaatcctaccattgaagaggggagaacactccgcgtcctgaagatggtggaaccctggcttcggggaaaccaattttgtatcaagattctgaatccttacatgcccagcgttgtggagacgctcgagcagatgcagagaaaacatggcggcatgctggtccgcaacccgctgtcccggaatagcacccacgaaatgtattgggtgtcttgcgggacaggaaacatcgtgtccgctgtcaatatgaccagcagaatgctcctgaaccgcttcacaatggcccaccggaagcctacctacgagagagatgttgaccttggcgcggggacgcgccatgtggccgtggaacccgaggtcgctaacctggatatcattggacagagaatcgaaaatattaaacacgagcataagtctacctggcactatgacgaggataacccctacaaaacatgggcctatcatggctcctacgaagtgaagcctagcgggtctgcttccagcatggttaatggagtggtcaagctcctgaccaaaccctgggacgtgatccctatggttacacaaattgccatgaccgatacaaccccgtttggccagcagcgggtgttcaaggagaaagtcgacacgcgcacacccaaggctaaaagaggcaccgcccaaatcatggaagtgaccgcgcggtggctttgggggtttctgtccagaaacaagaagcctcggatctgtacacgcgaggaattcacgagaaaagttcggagcaatgccgctattggagccgtgtttgtcgacgagaaccagtggaattctgctaaggaggccgtggaagatgagcgcttctgggacctcgtccagaaagaaagagagctgcacaagcagggcaaatgcgccacctgcgtgtataacatgatggggaagcgggaaaagaaactgggagagtttggcaaggcgaaagggagccgcgctatctggtacatgtggctcggcgccagattcctggagtttgaagcccttggattcatgaatgaggatcactggttctcccgggaaaactctctgagcggcgttgagggggagggactccataagctgggctacattcttcgcgacatctccaaaattcccgggggaaatatgtatgctgatgacacagccggctgggataccagaatcacagaagacgatctgcaaaacgaggctaagatcaccgacattatggaacctgagcacgccctcctggcgacatctatctttaaactgacctaccagaataaggtggtccgggtgcagcgccccgccaagaacgggacggtgatggatgttattagcagacgggaccagcgcggctccggacaagtgggcacctatgggctcaatacattcaccaacatggaagctcagctgatcagacagatggagtctgagggaatttttcttccgagcgaactggagacacctaacctcgccgaacgggtcctggattggcttgagaaacatggcgtggaaagactgaagcgcatggctatctccggggacgactgtgttgtgaaacccatcgatgaccggttcgccaccgcgctcacggccctgaatgatatgggaaaggtcagaaaagacattcctcagtgggagcccagcaagggctggaacgattggcaacaggtgcctttttgctctcaccacttccatcagctgatcatgaaggacgggcgcgagattgtcgtgccctgtcggaatcaggatgaactcgttggcagagctcgcgtgtcccaaggagccggctggagcctgcgggagacagcttgccttgggaaatcttacgcccagatgtggcagctgatgtattttcacagacgcgacctccggctggctgccaacgcgatctgttccgccgtcccggtggattgggttcctaccagcagaacaacctggtccattcatgctcaccatcaatggatgacgaccgaagacatgctttctgtgtggaatcgcgtctggatcgaggaaaacccctggatggaggataagacacacgtgagctcctggggagacgtgccctacctgggcaaacgggaggaccagtggtgcgggagcctcattggactgaccgccagagccacatgggcttctaatatccaggttgccatcaaccaggtccggagactgattggcaatgaaaactatctcgattacatgacctccatgaagcgcttcaaaaatgagggggaccctgaaggcgcgctgtggtga

SEQ ID NO: 19147 - RNA, 9879 nt, synthetic construct
  misc_feature 1..9879: note = derived and/or modified CDS sequence (opt5) from DENV-1__GU131688__SS-prME
  source 1..9879: mol_type = other RNA
agcgtgaccatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcattgaagcgaagatctccaacaccacgacagacagcagatgtccgacccaaggagaggccacccttgtggaagaacaagatgctaattttgtgtgccggcgcacattcgtcgacagaggctggggcaacgggtgtggactgtttggcaaagggtctctcatgacctgcgccaagttcaagtgcgtgacaaaactggagggaaagattgttcagtacgaaaatcttaaatattccgtgatcgtcacggtgcacaccggcgaccagcatcaagttgggaacgagagcacagaacacggaaccacagctaccatcacgccccaggccccttctaccgagattcagctgacagattacggcgccctcaccctggactgtagcccccggacaggcctggattttaatgaaatggtgctcctgaccatgaaggagaaaagctggcttgtccataagcagtggttcctggacctccctctgccctggacgtccggggcttctacaagccaagagacctggaaccgcaaagatcttctggtgacatttaagaccgcgcacgccaagaaacaggaagtcgtggttctcggatcccaggagggcgctatgcacaccgccctgacaggggccacggaaatccaaaccagcggaacaaccacaattttcgctggccatctgaagtgcagactcaaaatggacaagctgacccttaaagggatgtcttatgtgatgtgtacgggctccttcaagctggagaaggaagtcgccgagacacagcacggaaccgtgctcgttcagatcaaatacgagggcaccgatgcgccgtgcaagattccttttagcacacaggacgaaaaaggggtgacccaaaatggacggctgatcacagctaaccccatcgtcacggataaggagaaacctgtgaatattgaagccgagccgcccttcggcgagtcttatatcgtgattggggccggagaaaaggctctgaaacttagctggtttaaaaagggctcctctatcgggaaaatgttcgaggccaccgctagaggcgcccgccggatggcgattctcggagacacagcctgggattttggcagcatcgggggagttttcacctccgtcggcaagctggtgcatcagatctttgggacagcttacggagtgctgttcagcggcgtctcttggaccatgaaaattgggatcggcgtgctcctgacgtggcttggactgaactccagaagcacctctctctccatgacatgtattgccgttggcctggtgaccctgtaccttggggtcatggtgcaggctgacagcggatgcgttatcaattggaagggccgcgaactcaagtgtgggtccggaatttttgtgacaaacgaggtccacacctggacagaacagtataaattccaagccgactctcctaagcggctgagcgcggccatcggcaaggcttgggaggagggggtgtgcggcattagatccgccacccgcctggaaaatatcatgtggaagcagatctctaacgagctcaaccatattctgcttgaaaatgatatgaaatttacggttgtggtcggagacgtggctggcatcctggcccaggggaagaaaatgattcggccgcagcccatggagtacaagtatagctggaagtcctggggaaaagccaagatcattggcgctgatgtgcaaaacacaaccttcatcatcgacgggcctaatacccccgaatgtcctgatgaccagagagcgtggaacatttgggaggtcgaggattacggatttggcatcttcacaaccaatatttggctcaaactgcgcgacagctatacgcaggtttgcgatcaccggctgatgtctgccgctatcaaggactccaaagccgtgcacgccgatatgggctactggattgaaagcgagaagaacgaaacatggaaacttgctagagcctctttcatcgaggtgaaaacctgtatctggcccaagtcccatacactctggagcaatggggtcctggaatctgagatgattatcccgaaaatttatggaggccctatcagccagcacaactaccgccccgggtactttacccaaacagcgggaccttggcatctgggcaagctcgagctggacttcgatctttgcgaagggaccacggtggttgtggacgagcactgcggaaatcggggcccctccctgagaaccacaaccgtcacaggcaaaattatccacgaatggtgttgccggagctgtaccctccctcccctgcgctttaagggggaggacggatgctggtatggcatggagatcagaccggtgaaggaaaaagaggaaaacctggttaagtctatggtgtccgctgggagcggagaggtcgattccttctctcttggcctcctgtgtattagcatcatgattgaagaggtgatgcggtccagatggtctcgcaaaatgctgatgacggggacactcgccgtctttttcctgcttatcatgggacagctgacctggaatgacctcattcggctgtgcatcatggtgggcgccaacgctagcgatagaatgggcatggggacaacctacctggcccttatggcgacctttaagatgcgccctatgttcgctgtcggactgctctttagacggctgacatcccgcgaggtgctcctgcttacgattggcctgtctctcgtggccagcgtcgaactgcccaattccctggaggaacttggggacggactggccatgggcatcatgatcctcaaactgctcaccgatttccagagccatcaactgtgggctacacttctgtctctcacctttattaagacaaccttctccctgcactatgcctggaagacgatggctatggttctgagcatcgtgtctctttttcccctgtgtctctccacaaccagccagaaaaccacatggctgcctgtgctcctggggtctcttggatgcaagccgctgaccatgttcctgattgccgagaacaaaatctggggcagaaagtcctggcccctcaatgaaggcattatggcggtcgggatcgtgagcatcctgctttccgccctgctcaaaaacgacgttcctctggctggacccctcattgccggcgggatgctgatcgcttgttacgtgattagcggatctagcgccgatctttccctggagaaggccgctgaggtctcttgggaagaggaagcggagcatagcggcgcctcccacaacatcctggtggaagttcaggacgatgggacaatgaaaattaaggacgaggagcgggatgacacgctcaccatcctgcttaaggctacactgctcgccgtgtctggagtctatcctctgagcatccccgccaccctcttcgtgtggtacttttggcagaaaaagaaacaacgctccggcgtcctgtgggatacaccttctcccccggaagtggagagagctgttcttgacgacggcatttatcggatcatgcagcgcgggctgctgggaagaagccaggtgggcgtcggggtgttccaggaaaatgtttttcataccatgtggcacgtgacgcggggagccgtcctcatgtaccaaggcaagcgcctggagccttcctgggcgagcgtgaaaaaggatcttatttcttacgggggaggctggagactgcagggctcctggaacaccggggaggaagtgcaggttatcgctgtcgagcccggaaagaatcctaaaaacgtgcagacagcccccggcaccttcaagacaagcgaaggggaggtgggagccattgctctcgactttaaaccgggcacctctgggtcccctatcgtcaatcgggaaggaaagattgtgggcctgtatggcaacggggttgtgacaacgagcggaacctacgtctccgccatcgcgcaagctaaagcctctcaggagggccccctccctgagatcgaagatgaggtgttcagaaagcgcaatctgacaattatggaccttcaccccgggagcggaaagacccggagatatctgcccgccatcgttcgcgaagctattaaacggaagctgagaaccctcatcctggcccctacacgcgtggtcgcttccgagatggccgaagcgcttaaaggcatgccgattcggtaccagacgaccgccgtgaagtccgagcatacagggaaagagatcgttgatctgatgtgccacgctacctttacaatgagactcctgtctcccgtgcgcgtccctaactataatatgatcattatggacgaagcccatttcaccgatccctccagcatcgctgcccggggctacatttctacgagagtgggaatgggcgaggccgctgcgatctttatgacagccacccctcccgggagcgtggaggctttccctcaatccaacgccgtcattcaggacgaagaacgggatatcccggagcgctcttggaatagcggatatgagtggatcaccgactttcccggcaagacagtttggttcgtgccttccattaagtctgggaacgatatcgccaattgtctgcgcaagaacggaaagcgggtgattcagctcagccgcaaaaccttcgacacagaataccagaagaccaaaaataacgactgggattacgtcgtgacgacagacatctccgagatgggcgctaactttagagccgatcgggttattgaccccagacgctgccttaagcctgtgatcctgaaggatgggcccgaacgggtcattctggcgggcccgatgcctgtgaccgttgctagcgccgcccaaagacgcggacggatcggcagaaatcacaacaaagagggggaccagtatatctacatgggacagcccctcaataacgatgaggaccatgctcactggacagaagccaagatgctgcttgataatattaacacccccgagggcatcattcctgcgctgttcgaacccgagcgcgaaaaatctgccgctatcgacggggagtatcggctcagaggagaggcccgcaagacgtttgtggaactgatgagacggggcgatctgcctgtctggctctcctacaaagtggctagcgaggggttccagtattccgaccgcagatggtgctttgatggcgaacggaataaccaagtccttgaggaaaatatggacgtggagatttggaccaaggagggagaacgcaaaaagctgagaccgcggtggctggacgccagaacatactctgatcccctcgctctgcgcgagttcaaggaatttgccgcgggccggagaagcgtttccggggaccttatcctggagatcggaaaactccctcagcacctgacccagcgcgcccagaacgctctggataatctcgtgatgcttcataactctgaacaaggcgggcgggcctatagacacgctatggaggagctgcccgacacaattgaaaccctgatgctcctggcccttatcgccgtgctgacaggaggcgtcaccctcttctttctgagcggccgggggctgggaaagacgtccattggcctcctttgtgttatggctagctctgtgctgctgtggatggcgtccgtggagcctcattggatcgccgctagcattatcctcgagttctttctgatggtccttctgatccccgagccggatcgccagagaacacctcaggacaatcagctcgcctacgtggttattgggctgctgttcatgatcctcaccgtggccgctaacgagatgggacttctggaaaccaccaagaaggatctgggcattgggcacgtcgccgtggagaatcaccatcacgcggccatgctcgacgtcgatctgcatcccgcttctgcctggaccctttacgctgtggccacaacgatcattacccctatgatgcggcacacaatcgaaaacaccacagcgaacatttccctgaccgccatcgctaatcaagccgctatcctcatgggactggacaaaggctggcccattagcaagatggatatcggcgttcctctgctcgcccttgggtgctattctcaggtgaaccccctgacgctgaccgctgccgtcctcatgctggtggcgcattacgccattatcggaccgggccttcaggctaaggccacacgcgaggctcagaagagaaccgccgccgggattatgaagaatcctacagttgacggaatcgtggcgatcgatctggaccccgtcgtgtatgacgctaaatttgaaaagcagctcggccagattatgctgctgatcctctgtaccagccagattcttctgatgcggacgacatgggccctgtgcgagtccatcaccctcgctacagggcccctgaccaccctttgggagggatctcctggcaaattctggaacacaacgattgccgtgagcatggccaatatcttccgcggctcctacctggctggggccggactcgcgtttagcctgatgaagtccctgggcgggggaagacggggcaccggggcccaaggagaaacactcggcgagaagtggaaacgccagcttaaccagctgtctaagagcgagttcaatacctataaaagatccggcatcatggaggttgatcggtctgaagctaaggaggggctgaaaagaggagagacaaccaagcacgccgtcagccgcggcacggctaagctccggtggtttgtggaaagaaacctggtgaaaccggaggggaaggtcattgaccttggatgtggccgcgggggatggtcctactattgcgccggcctgaaaaaggttacagaagtgaaaggctacaccaaagggggacccggccacgaggaacctatccccatggcgacctacgggtggaatctcgtgaaactgcattctggaaaggatgtcttctttattcctcccgagaagtgtgacacactgctctgcgatatcggcgagagctcccctaacccgaccattgaagaggggcggacacttagagtgctgaaaatggttgaaccctggctgcgcggaaatcagttctgtatcaagattctcaacccttatatgcccagcgtggtcgagacgctggagcaaatgcagcggaaacacggcggcatgcttgtgagaaatcctctgtctcgcaactccacccatgaaatgtactgggttagctgcgggacaggaaatatcgtgtctgccgtcaacatgacctcccggatgctcctgaatagatttacaatggctcaccgcaagcccacctatgagcgggacgtggatctgggcgccgggacgagacacgtggctgtcgaaccggaggttgccaacctcgacatcattggacagcgcatcgaaaacattaaacatgagcacaagagcacctggcattacgatgaggacaatccttataagacatgggcttaccacggctcttatgaagtgaaaccctccgggagcgcctccagcatggtgaacggagtcgtgaagctgcttaccaaaccctgggatgttatccctatggtgacacagattgcgatgaccgacacaacccccttcggccaacagagagtctttaaggagaaagtggacacgcggacacctaaggccaagcgcggcaccgctcagatcatggaagttaccgccaaatggctgtgggggttcctctctagaaataagaaaccgcggatctgtacaagagaggaatttacgcggaaggtgcgcagcaacgctgccattggagccgtcttcgtggatgagaatcaatggaactccgcgaaagaggctgttgaagacgagagattttgggatctggtgcatcgggaacgcgagcttcacaagcagggcaagtgcgccacatgcgtctacaatatgatggggaaaagagaaaagaaactgggagagttcggcaaggccaaagggtctcgggctatctggtacatgtggctcggcgcccgcttcctggagtttgaagctctgggattcatgaacgaggaccactggtttagcagagaaaattccctctctggcgtggagggggagggactgcataaacttggctatattctgcgggatatcagcaaaattcccgggggaaacatgtacgccgacgatacagcgggctgggacacccgcatcacagaagatgacctccagaatgaggccaagatcaccgatattatggaacctgagcacgctctgcttgccaagtccatcttcaaactgacatatcagaacaaggtcgtgagagttcaacggcccgctaaaaatgggaccgtgatggacgtcatttctcgcagagatcagcggggcagcggacaggtgggcacgtacgggctcaacacctttacaaatatggaagcccagctgatccgccaaatggagtccgagggaattttcagcccttctgaactggagacccccaacctcgcgggcagagtgctggactggcttgaaaagcatggggttgagcggctgaaaagaatggccatctccggagacgattgtgtggtcaagccgatcgacgatcgctttgctgccgctctcacagccctgaacgacatgggcaaggtgcggaaagatattcctcagtgggaacccagcaaggggtggaatgactggcagcaggttcctttctgctctcaccactttcatcaacttatcatgaaagatggcagagagattgtggtcccctgtcgcaaccaggacgagctggtgggacgggctagagtctcccagggcgccgggtggagcctccgcgaaaccgcgtgcctgggaaagtcctatgcccagatgtggcaactgatgtacttccaccggagagatctccgcctggctgccaatgccatctgttctgctgtgcctgttgactgggtgcccacgagccggacaacctggtccattcatgcccaccatcagtggatgacaaccgaggatatgcttagcgtctggaacagagtgtggatcgaagagaatccgtggatggaagacaaaacgcacatttcttcctggggcgacgttccttatctggggaagcgcgaggatcagtggtgcggaagcctcatcggcctgaccgcgcgggctacatgggccaccaacatccaagtggccattaatcaggtcagacggcttatcgggaacgagaattacctggactacatgacatctatgaagagatttaaaaacgaaagcgatcccgagggcgctctctggtga

SEQ ID NO: 19148 - RNA, 9879 nt, synthetic construct
  misc_feature 1..9879: note = derived and/or modified CDS sequence (opt5) from DENV-1__GU131689__SS-prME
  source 1..9879: mol_type = other RNA
agcgtgaccatgttcctgatgctcatgcccacagccctggcttttcaccttacgaccagaggaggggaacctcatatgatcgtctccaagcaggaacggggaaaatctctcctgttcaagacaagcgccggcgttaacatgtgcaccctgattgcgatggaccttggggagttttgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctcggactggagacaagaaccgaaacgtggatgagctccgagggcgcctggaaacagattcagcgggttgaaacatgggctctgcgccaccccggcttcaccgtgatcgccctctttctggcgcatgccattgggacatctatcacccagaagggaatcattttcatccttctgatgctcgtcacccctagcatggctatgagatgcgtgggcattgggtcccgggattttgttgagggactgagcggcgccacatgggtggacgtcgtgcttgagcacgggtcttgtgtgacgaccatggctaaggataaacccacactggacatcgaactcctgaagaccgaggtcacaaaccctgccgttctgcgcaaactctgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggacttttcggcaaagggtctctgattacctgcgccaagtttaagtgcgtgacaaaactcgagggaaagatcgttcagtacgaaaacctgaaatattccgtgatcgtcacggtgcacaccggcgaccagcatcaagttgggaatgagagcacagaacacggaaccacagctaccattacgccccaggccccttctaccgagatccagcttacagactacggcgccctgaccctcgattgtagcccccggacaggcctggacttcaacgaaatggtgctgctcaccatgaaggagaaaagctggctggtccataagcagtggtttcttgatctgcctctcccctggacgtccggggcttctacaagccaagagacctggaatcgccaggacctgcttgtgacattcaaaaccgcgcacgccaagaagcaggaagtcgtggttctgggatcccaagagggcgctatgcacaccgccctcacaggggccacggaaattcagaccagcggaacaaccacaatcttcgctggccatctgaaatgcagactgaagatggataaactcaccctgaaggggatgtcttatgtgatgtgtacgggctcctttaaacttgagaaggaagtcgccgagacacagcacggaaccgtgctggttcagattaagtacgagggcaccgacgcgccgtgcaaaatccctttcagcacacaagatgaaaagggggtgacccagaacggacggctcatcacagctaatcccattgtcacggacaaagagaagcctgtgaacatcgaagccgagccgccctttggcgagtcttatattgtgatcggggccggagaaaaagctctgaagctgagctggttcaagaaaggctcctctattgggaagatgtttgaggccaccgctagaggcgcccgccggatggcgatccttggagatacagcctgggacttcggcagcatcgggggagtttttacctccgtcggcaaactcgtgcatcagattttcgggacagcttacggagtgctgtttagcggcgtctcttggaccatgaagatcgggattggcgtgctgctcacgtggctgggacttaattccagaagcacctctctgtccatgacatgtatcgccgttggcctcgtgaccctgtacctgggggtcatggtgcaggctgatagcggatgcgttattaactggaaaggccgcgaacttaagtgtgggtccggaatcttcgtgacaaatgaggtccacacctggacagaacaatataagtttcaggccgactctcctaaacggctcagcgcggccattggcaaggcttgggaggagggggtgtgcggcatcagatccgccacccgcctggaaaacatcatgtggaaacagatttctaacgagctgaatcatatcctcctggaaaacgacatgaaacttacggttgtggtcggagatgtggctggcattctggcccaggggaaaaagatgatccggccgcaacccatggagtacaaatatagctggaagtcctggggaaaggccaaaattatcggcgctgacgtgcagaatacaaccttcatcattgatgggcctaacacccccgaatgtcctgacgatcagagagcgtggaatatctgggaggtcgaggactacggatttggcattttcacaaccaacatctggctcaagctgcgcgatagctatacgcaggtttgcgaccaccggctgatgtctgccgctattaaagattccaaggccgtgcacgccgacatgggctactggatcgaaagcgagaaaaatgaaacatggaaacttgctagagcctctttcatcgaggtgaagacctgtgtctggcccaaatcccatacactctggagcaacggggtgctggaatctgagatgattatcccgaagatttatggaggccctatcagccaacacaattaccgccccgggtactttacccagacagcgggaccttggcatctgggcaaactcgagctggatttcgacctttgcgaagggaccacggttgtggtcgatgagcactgcggaaaccggggcccctccctgagaaccacaaccgtgacaggcaagattatccacgaatggtgttgccggagctgtaccctccctcccctgcgctttaaaggggaggacggatgctggtatggcatggagatcagaccggttaaggaaaaggaggaaaatctggtgaaatctatggtctccgctgggagcggagaggtggactccttctctcttggcctcctgtgtattagcatcatgattgaagaggttatgcggtccagatggtctcgcaagatgctgatgacggggacactcgccgtgtttttcctgcttatcatgggacagctgacctggaacgatctcattcggctgtgcatcatggtcggcgccaatgctagcgacagaatgggcatggggacaacctacctggcccttatggcgacctttaaaatgcgccctatgttcgctgtgggactgctctttagacggctgacatcccgcgaggtgctcctgcttacgattggcctgtctctcgtcgccagcgttgaactgcccaactccctggaggaacttggggatggactggccatgggcatcatgatcctcaagctgctcaccgacttccaaagccatcagctgtgggctacacttctgtctctcacctttattagaacaaccttctccctgcactatgcctggaaaacgatggctatggtgctgagcatcgtgtctctttttcccctgtgtctctccacaaccagccagaagaccacatggctgcctgtcctcctggggtctcttggatgcaagccgctgaccatgttcctgattgccgagaataaaatctggggccggaagtcctggcccctcaacgaaggcattatggcggtggggatcgttagcatcctgctttccagcctgctcaaaaacgatgtgcctctggccggacccctcattgctggcgggatgctgatcgcctgttacgtcatttctggaagctccgctgacctttctctggagaaggccgccgaggtgagctgggaagaggaagctgagcattccggcgcgtctcacaatatcctggttgaagtgcaggatgacgggacaatgaaaattaaggatgaggagcgcgacgatacgctcaccatcctgcttaaagccacactgctcgctgtcagcggagtgtatcctctgtccatccccgccaccctcttcgtctggtacttttggcaaaagaagaaacagagatctggcgtgctgtgggacacaccttcccctcccgaagttgagcgggccgtgcttgatgacggcatttatcgcatcatgcagagagggctgctgggacggtcccaggtcggcgtgggggttttccaagaaaacgtgtttcataccatgtggcacgtcacgcgcggagctgtgctcatgtaccagggcaagagactggagcccagctgggcctctgtgaaaaaggaccttatttcctacgggggaggctggcggctgcagggcagctggaataccggggaggaagttcaggtcatcgcggtggagcccggcaagaatcctaagaatgtgcaaacagctcccggcaccttcaagacatctgaaggggaggtcggagccattgccctcgattttaaaccgggcacctccgggagccctatcgtgaacagagaaggaaagattgttggcctgtatggcaatggggtggtcacaacgtccggaacctacgtgtctgctatcgcccaggcgaaagctagccaggagggccccctccctgagatcgaagacgaggttttccgcaagcggaacctgacaattatggatcttcaccccgggtccggaaaaaccagacgctatctgcccgccatcgtgcgggaagccatgaagagacgcctgcggaccctcattctggctcctacaagagtcgtggccagcgagatggctgaagcccttaagggcatgccgatccgctaccaaacgaccgcggttaaatctgagcatacagggaaggagattgtggacctgatgtgccacgccacctttacaatgcggctcctgtcccccgtcagagtgcctaattataacatgatcatcatggatgaagctcatttcaccgaccccagctctattgccgctcggggctacatcagcacgcgcgtgggaatgggcgaggccgccgctatttttatgacagcgacccctcccgggtccgtcgaagccttccctcagtctaatgctgttatccaggatgaggaaagagacattccggagcggagctggaactccggatatgagtggatcaccgattttcccggcaaaacagtgtggttcgtgccttctatcaagagcgggaatgacattgccaactgtctgcgcaaaaatggaaagagagtcatccagctctcccggaagaccttcgatacagaataccagaagaccaagaacaacgactgggactacgtggttacgacagatattagcgagatgggcgccaattttagagctgaccgcgtgatcgatccccggagatgccttaaacctgtcattctgaaggacgggcccgaacgcgtgatcctggccggcccgatgcctgttaccgtggcgtctgctgcccagcggagaggacgcattggccggaaccacaataaagagggggatcagtatatctacatgggacagcccctcaacaatgacgaggatcatgcccactggacagaagctaagatgctgcttgacaacatcaatacccccgagggcattatccctgccctgttcgaacccgagagagaaaagtccgcggccattgatggggagtatcgcctcagaggagaggctcggaaaacgtttgtcgaactgatgcgcagaggcgacctgcctgtgtggctcagctacaaggtcgcctccgaggggttccaatattctgatcggcgctggtgctttgacggcgaaagaaacaatcaggtgcttgaggaaaacatggatgttgagatctggaccaaagagggagaacggaagaaactgagaccgcgctggctggacgctcggacatacagcgaccccctcgccctgagagagttcaaggaatttgctgccggccgccggtccgtgtctggggatcttattctggagatcggaaaactccctcagcacctgacccagagagcgcaaaatgccctggacaacctcgtgatgcttcataatagcgaacagggcgggcgggcttatcgccacgccatggaggagctgcccgatacaatcgaaaccctgatgctcctggctcttattgccgtcctgacaggaggcgttaccctcttctttctgtccggcagagggctgggaaagacgagcatcggcctcctttgtgtgatggcctcttccgtgctgctgtggatggctagcgtcgagcctcattggattgcggcctctatcattctcgagttctttctgatggtgcttctgatccccgagccggaccggcagcgcacacctcaggataaccaactcgcttacgttgtgatcgggctgctgttcatgattctcaccgtcgccgccaatgagatgggacttctggaaaccacaaagaaagacctgggcatcgggcacgtggctgtcgagaaccaccatcacgccgcgatgctcgatgtggacctgcatcccgcctccgcttggaccctttacgccgttgctacaacgattatcacccctatgatgagacacacaattgaaaacaccacagccaatatcagcctgaccgcgattgccaaccaggctgccatcctcatgggactggataagggctggcccatctctaaaatggacattggcgtgcctctgctcgctcttgggtgctatagccaggtcaatcccctgacgctgaccgccgctgtgctcatgctggttgcccattacgcgatcattggaccgggccttcaagccaaggctacacgggaggcccagaaacgcaccgctgccgggatcatgaagaaccctacagtggatggaattgtcgccatcgacctggatcccgtggtgtatgacgcgaagtttgaaaaacagctcggccagatcatgctgctgattctctgtacctcccaaatccttctgatgagaacgacatgggctctgtgcgagtctattaccctcgccacagggcccctgaccaccctttgggagggaagccctggcaagttctggaatacaacgatcgctgtttccatggccaacattttccggggcagctacctggccggggctggactcgccttttccctgatgaaatctctgggcgggggacgcagaggcaccggggcgcagggagaaacactcggcgagaagtggaaacggcagcttaatcagctgagcaagtccgagttcaacacctataagagatctggcatcatggaggtcgaccgcagcgaagccaaagaggggctgaagcggggagagacaaccaaacacgctgtgtccagaggcacggccaagctccgctggtttgtggaacggaatctggtcaaaccggaggggaaggttatcgatcttggatgtggcagagggggatggtcttactattgcgctggcctgaagaaagtgacagaagtgaagggctacaccaaagggggacccggccacgaggaacctattcccatggccacctacgggtggaacctcgtcaagctgcatagcggaaaagacgtgttctttatccctcccgagaagtgtgatacactgctctgcgacattggcgagtccagccctaatccgaccatcgaagaggggcgcacacttcgggttctgaaaatggtggaaccctggctgagaggaaaccaattctgtattaagatcctcaatccttatatgccctctgtcgtggagacgctggagcagatgcagcgcaagcacggcggcatgcttgttcggaaccctctgtccagaaatagcacccatgaaatgtactgggtgtcttgcgggacaggaaacattgtctccgcggtgaatatgaccagccgcatgctcctgaaccggtttacaatggcccacagaaaacccacctatgagcgcgatgtggacctgggcgctgggacgagacacgtcgccgttgaaccggaggaagctaacctcgatatcatcggacagcggattgagaatatcaagcatgagcacaaatctacctggcattacgacgaagataacccttataagacatgggcctaccacggctcctatgaggtgaaacccagcgggtccgctagctctatggtgaatggagtcgtgaagctgcttaccaagccctgggacgttattcctatggtgacacaaatcgccatgaccgatacaacccccttcggccagcagcgcgtctttaaagaaaaggtggacacgagaacacctaaagcgaagcggggcaccgcccaaattatggaggttaccgctaaatggctgtgggggttcctcagcagaaacaagaagccgcggatctgtacacgcgaagagtttacgagaaaagtgcggtccaatgccgctatcggagccgtcttcgtggacgagaaccagtggaactctgccaaggaagcggttgaggatgaacgcttttgggacctggtgcatagagagcgggaacttcacaaacagggcaagtgcgctacctgcgtctacaacatgatggggaaacgcgagaagaagctgggagagttcggcaaagccaaggggagcagagccatttggtacatgtggctcggcgctcggttcctggaatttgaggccctgggattcatgaatgaagatcactggttttcccgcgagaactctctcagcggcgtggagggggaaggactgcataaacttggctatatcctgagagacatttccaagatccccgggggaaatatgtacgctgatgacacagccggctgggatacccggattacagaggacgatctccagaacgaagcgaaaatcaccgacatcatggagcctgaacacgccctgcttgctaagtctattttcaaactgacatatcaaaataaggtcgtgcgcgttcagagacccgccaagaacgggaccgtgatggatgtcatcagccggcgcgaccagagaggctccggacaggtgggcacgtacgggctcaatacctttacaaacatggaggctcaactgattcggcagatggagagcgaaggaatcttctctccttccgagctggaaacccccaacctcgccggcagagtgctggattggcttgagaaacatggggttgaacgcctgaagcggatggcgattagcggagacgactgtgtggtcaaaccgatcgatgacagatttgccacagctctcaccgccctgaatgatatgggcaaggtgcgcaaagacatccctcagtgggagccctctaaggggtggaacgattggcagcaagttcctttctgctcccaccactttcatcagcttattatgaaggacggccgggagatcgtggtcccctgtagaaatcaggatgaactggtgggacgcgctcgggtcagccagggcgccgggtggtccctcagagagacggcttgcctgggaaaatcttatgcccaaatgtggcagctgatgtacttccaccgccgggacctcagactggcggccaacgctatttgtagcgccgtgcctgttgattgggtgcccacatcccgcaccacatggagcatccatgcccaccatcagtggatgaccacggaagacatgctttctgtctggaatcgggtgtggattgaggaaaacccgtggatggaggataagacccacgtttccagctggggcgacgtgccttatctggggaaaagagaggaccaatggtgcggatctctcatcggcctgacagctcgggccacctgggcgacaaatattcaggtcgctatcaaccaggtgagacgccttctggggaatgaaaactacctcgattacatgaccagcatgaagcggtttaaaaatgagtccgaccccgaaggcgccctgtggtga

SEQ ID NO: 19149 - RNA, 9879 nt, synthetic construct
  misc_feature 1..9879: note = derived and/or modified CDS sequence (opt5) from DENV-1__GU131690__SS-prME
  source 1..9879: mol_type = other RNA
agcgtgaccatgctgctcatgctgatgcccacagcccttgctttccacctgacgaccagaggcggggaacctcatatgattgtctccaagcaggaacgggggaaatctctcctgtttaagacaagcgccggcgttaacatgtgcacccttattgccatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgtgacacgcctggaaaacatcatgtggaaacagatttccaacgagcttaatcatatcctgctcgaaaacgacatgaagttcaccgttgtggtcggagatgtggctggcattctggcccaggggaaaaagatgatccggccgcaacccatggagcacaaatactcttggaaaagctggggaaaggctaagattatcggcgccgacgtgcagaataccacatttatcattgatgggcctaacacccccgaatgtcctgacgatcagagagcctggaatatctgggaggtcgaggactatggattcggcatttttacgacaaacatctggctgaaacttcgcgattcctacacccaggtttgcgaccaccggctcatgagcgctgcgattaaagattctaaggccgtgcatgctgacatgggctattggatcgaatccgagaaaaatgaaacatggaagctggccagagccagcttcatcgaggtgaagacctgtatttggcccaaatctcacacactgtggtccaacggggtcctcgaaagcgagatgatcattccgaagatctacggaggccctatttctcaacataattatcgccccgggtacttcacccagacggctggaccttggcacctgggcaaacttgagctggattttgacctctgcgaagggaccacagtggttgtggatgagcactgcggaaaccggggccccagcctgagaaccacaaccgtcacgggcaagatcatccatgaatggtgttgccggtcctgtacactgcctccccttcgcttcagaggggaggacggatgctggtacggcatggagattcggccggtgaaagaaaaggaggaaaatctcgttaagagcatggtgtctgccgggtccggagaggtcgacagcttttccctgggcctgctctgtatctctattatgatcgaagaggtgatgagaagccgctggtcccggaaaatgctgatgaccgggacacttgcggttttctttctgctcattgtgggacagctgacctggaacgatctgatcagactttgcattatggtcggcgctaatgcctctgaccgcatgggcatggggaccacatatctggccctcatggctacgttcaagatgagacctatgtttgccgtgggactgctgttccggcgcctgaccagcagagaggtgcttctgctcacaatcggcctgtccctggtcgcgtctgttgaacttcccaacagcctggaggaactcggggatggactggctatgggcatcatgattctcaaactgcttaccgactttcaatcccaccagctgtgggccacactcctgagcctgaccttcatcaagacgacattttctcttcattacgcctggaaaaccatggctatggtgctgtccgtggtcagcctcttccccctgtgtctctctaccacatcccagaagaccacatggctgcctgtgcttctggggagcctgggatgcaagccgctcacgatgtttctgattgccgagaataaaatctggggccggcgctcttggccccttaacgaaggcattatggctgttgggatcgtgtccatcctgctcagctccctgctcaagaacgatgtccctctggccggaccccttattgcgggcgggatgctgatcgcctgttatgtgattagcggatctagcgctgacctgtccctcgagaaagccgctgaggtttcttgggaagaggaagccgagcacagcggcgcctcccataatatcctggtggaagtccaggatgacgggaccatgaagattaaagatgaggagagagacgatacacttaccatcctgctcaaggctacactgctcgcggtgtctggagtctaccctctgagcatccccgccacccttttcgtgtggtatttctggcagaagaagaagcagcggtccggcgttctgtgggacacgccttctcccccggaagtggagcgcgctgtcctggatgacggcatttacagaatcatgcagcgggggctcctgggacgcagccaggtgggcgttggggtgtttcaagaaaacgtcttccacaccatgtggcacgtgacaagaggagccgtgcttatgtatcagggcaaacggctggagccttcctgggccagcgttaagaaagacctcatttcttacgggggaggctggagactgcagggctcctggaataccggggaggaagtccaggtgatcgctgtggagcccggaaagaaccctaaaaatgtccaaacagcccccggcacctttaagacaccggaaggggaggtgggagcgattgctctcgatttcaagcctggcacgagcgggtctcccatcgttaaccgcgaaggaaaaattgtgggcctgtacggcaatggggtcgtgaccacatccggaacctatgttagcgccatcgcccaggctaaggcctcccaggagggccctcttcccgagatcgaagacgaggtgtttcggaaaagaaacctgaccattatggatctgcatcccgggtctggaaagacacgccggtacctccctgcgatcgtcagagaagctattaaacgcaagctgcggacgcttatcctggccccgaccagagtggttgccagcgagatggctgaagccctcaagggcatgcccattcgctatcaaacaaccgctgtgaaatccgagcacacagggaaggagatcgtcgacctgatgtgccatgccaccttcacgatgcggctgctcagccctgtgagagtgcccaattacaacatgatcattatggatgaagcgcactttacagacccttcttccatcgccgctcggggctatattagcacccgcgtcggaatgggcgaggccgctgccatcttcatgaccgccacaccccctgggtctgttgaggcttttccgcagagcaatgcggtgattcaggatgaggaaagagacatccccgagcggtcctggaactctggatacgagtggatcaccgatttccctggcaaaacagtgtggtttgtccccagcattaagtccgggaatgacatcgccaactgtcttcgcaaaaatggaaagagagtgattcagctgtctcggaagaccttcgatacggaatatcagaagaccaagaacaacgactgggactacgttgtgaccacagatatcagcgagatgggcgctaatttcagagccgaccgcgtcattgatcctcggagatgcctgaaacccgtgatcctcaaggacgggccggaacgcgttattctggccggccctatgcccgtgaccgtcgcttccgccgcgcagcggagaggacgcatcggccggaaccataataaagagggggatcagtacatctatatgggacagccccttaacaatgacgaggatcacgctcactggacggaagccaagatgctgctcgacaacattaatacccctgagggcatcattcccgccctgtttgaacctgagagagaaaagagcgctgccatcgatggggagtaccgcctgagaggagaggcgcggaaaacattcgtggaactcatgcgcagaggcgaccttccggtctggctgtcttataaggtggcctccgaggggtttcaatacagcgatcggcgctggtgcttcgacggcgaaagaaacaatcaggttctggaggaaaacatggatgtggagatttggaccaaagagggagaacggaagaaactcagaccccgctggctggacgctcggacatattccgaccctcttgccctgagagagtttaaggagttcgctgccggccgccggtctgtgagcggggatctcatcctggagatcggaaaactgccccagcatctcacccagagagctcaaaatgcccttgacaacctggtcatgctgcacaattccgaacagggcgggcgggcgtaccgccatgccatggaggagctccctgatacaattgaaaccctgatgcttctggctctcatcgccgttctgacgggaggcgtgacactgtttttcctctctggcagagggcttggaaagaccagcattggcctgctgtgtgtgatggcttccagcgtcctcctgtggatggcctctgtggagccccactggatcgccgcttccattatccttgaatttttcctgatggttctcctgatcccggagcctgaccggcagcgcacaccccaggataaccaactggcgtatgtggtcattgggctcctttttatgatcctgacagtggccgctaatgagatgggactgctcgaaaccacaaagaaagacctgggcattgggcacgtcgccgtggagaaccatcaccatgccgctatgcttgatgttgacctgcaccctgccagcgcgtggacgctctacgccgtggctaccacaatcattacccccatgatgagacatacaatcgaaaacaccacggccaatatttctctgaccgctatcgccaaccaggcggccatcctgatgggactcgataagggctggcctatttccaaaatggacatcggcgtcccccttctggctctggggtgctacagccaggtgaatccgctcacactgaccgccgctgttcttatgctggtggcccactatgctattatcggacctggcctccaagccaaggcgacacgggaggcccagaaacgcaccgctgccgggattatgaagaaccccacggtcgatggaatcgtggctatcgacctggatcccgtggtttacgacgccaagttcgaaaaacagctgggccagattatgctccttatcctgtgtacatctcaaattctgctcatgagaaccacatgggccctgtgcgagagcatcacccttgcgaccgggcctctgacaacgctctgggagggatccccgggcaagttttggaataccacaattgctgtctctatggccaacatcttccggggcagctatctggctggggccggactggccttctccctcatgaaaagccttggcgggggacgcagaggcaccggggctcagggagaaacactgggcgagaagtggaaacggcagctgaatcagctctccaagtctgaatttaacacctacaagagaagcggcatcatggaggtggaccgctccgaagccaaagaggggctgaagcggggagagacgacaaaacacgcggtgtctagaggcaccgccaaacttcgctggttcgtcgaacggaatctggttaaacccgaggggaaggtgattgatctcggatgtggcagagggggatggagctattactgcgctggcctgaagaaagtgaccgaagtcaagggctatacaaaagggggacctggccatgaggaacccatccctatggccacctacgggtggaacctggtgaagctccactccggaaaagacgtgtttttcattccccctgagaagtgtgatacacttctgtgcgacatcggcgagtctagcccgaatcccacgattgaagaggggcgcaccctgcgggttctcaaaatggtcgaaccttggctgagaggaaaccaattttgtatcaagattcttaatccctacatgccttccgtggttgagacactggagcagatgcagcgcaagcatggcggcatgctcgtgcggaaccccctgagcagaaattctacccacgaaatgtattgggtctcctgcgggacaggaaacatcgtgagcgctgtgaatatgacctctcgcatgctgctcaaccggttcacgatggcccacagaaaaccgacctacgagcgcgatgtcgacctgggcgcggggacaagacatgttgccgtggaacctgaggtggctaaccttgatatcattggacagcggatcgaaaatattaagcacgagcataaatccacctggcactatgacgaggataacccctacaagacatgggcctatcatggcagctacgaagtcaaaccctctgggtccgctagctccatggtgaatggagttgtgaagctgctcaccaagccttgggacgtcatccccatggtgacacaaattgccatgaccgatacgacaccttttggccagcagcgcgttttcaaagagaaggtggacaccagaaccccgaaagctaagcggggcacagcccaaatcatggaagtcacggcgaaatggctgtgggggtttcttagcagaaacaagaagccccggatctgtacccgcgaggagttcacaagaaaagtgcggtctaatgccgctattggagccgtttttgtggacgagaaccagtggaatagcgctaaggaggccgtcgaagatgagcgcttctgggacctggtgcacagagaacgggagctccacaaacagggcaagtgcgcgacctgcgtctataacatgatggggaaacgcgaaaagaagctgggagagtttggcaaagcgaaggggtccagagctatctggtacatgtggctgggcgcccggttcctcgagttcgaagccctgggatttatgaatgaggatcattggttctctcgcgaaaacagcctttccggcgtggagggggagggactgcacaaactcggctacattctgagagacatctctaagattcctgggggaaatatgtatgctgatgacacagccggctgggatacccggatcacagaagacgatcttcagaacgaggctcgcatcaccgacattatggaacccgagcatgccctgctcgcgaaaagcatctttaagctgacgtaccaaaataaagttgtgagagtccagcggcctgccaagaacgggaccgtgatggatgtgatttcccgcagagaccagcggggctctggacaggttggcacatatgggctgaataccttcacaaacatggaagctcaactcatcagacagatggagagcgagggaatcttttcccccagcgaactggagaccccgaaccttgccgaacgcgtgctggattggctcgagaagtacggcgtcgaacggctgaaaagaatggctatctctggggacgactgtgtggttaagcctatcgatgaccgcttcgccacggcgcttacagccctgaatgatatgggaaaagtgcggaaggacattccccagtgggagccttccaaaggctggaacgattggcagcaagtccccttttgcagccaccacttccatcagctcatcatgaaggacgggagagagattgtggtcccttgtcgcaatcaggatgaactggtgggccgggctagagtttctcagggagccggctggtccctgcgcgagaccgcttgcctcggaaagagctatgcccaaatgtggcagctgatgtactttcaccggagagaccttcgcctggctgccaacgcgatctgttccgccgtgcccgtcgattggattccgacatctcggaccacgtggagcatccatgctcaccatcagtggatgaccacagaagacatgctctccgtgtggaatagagtttggattgaggaaaacccttggatggaggataaaacccacatcagctcttggggagacgtgccctatctgggcaagcgggaggaccaatggtgcgggtcccttatcggactgacagccagagccacctgggctacaaatattcaggtcgccatcaaccaggtgcgccggctcattggcaatgaaaactacctggattacatgaccagcatgaaaagattcaagaatgagtctgaccccgaaggggcgctgtggtga

SEQ ID NO: 19150 - RNA, 9879 nt, synthetic construct
  misc_feature 1..9879: note = derived and/or modified CDS sequence (opt5) from DENV-1__GU131695__SS-prME
  source 1..9879: mol_type = other RNA
tccgtgaccatgctgctcatgctgatgcccacagcccttgctttccacctgacgaccagaggaggggaacctcatatgatcgtctccaagcaggaacggggaaaatctctcctgtttaagaccagcgccggagttaatatgtgcacccttatcgcgatggacctgggggagctctgtgaagatacaatgacctacaaatgcccgcgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacggaatgaagttcaccgttgtggtcggcgacgtggccgggattctcgctcagggcaagaagatgatccggccgcaacccatggagtacaaatattcttggaaaagctggggcaaggccaagattatcggggccgatgtgcagaataccacatttatcattgacggacctaacacccccgaatgtcctgatgaccagagagcttggaatatctgggaggtcgaggattacggcttcggcatttttacgacaaacatctggctgaagctgcgcgactcctatacccaggtttgcgatcaccggcttatgagcgcggccattaaagactctaaggctgtgcacgccgatatggggtactggatcgaatccgagaaaaatgaaacatggaagctcgccagagctagcttcatcgaggtgaagacctgtatttggcccaaatctcatacactgtggtccaacggagtcctggaaagcgagatgatcattccgaagatctatggcgggcctatttctcaacacaattaccgccccggatacttcacccagacggccggcccttggcatctcgggaaactggagcttgactttgatctgtgcgaaggaaccacagtggttgtggacgagcactgcggcaaccggggccccagcctcagaaccacaaccgtcacggggaagatcatccacgaatggtgttgccggacatgtaccctgcctcccctgcgcttcagaggagaggatggctgctggtatgggatggagattcggccggtgaaagaaaaggaggaaaatcttgttaagtccatggtgagcgcgggatctggcgaggtcgactcctttagcctcgggctgctgtgtatctccattatgatcgaagaggtgatgagatctcgctggagccggaaaatgctcatgacaggaaccctggctgttttctttcttctgattatgggccagctcacctggaacgacctgatcagactgtgcattatggtgggcgccaatgcctccgatcgcatggggatgggaacaacgtaccttgctctgatggccaccttcaagatgagacctatgtttgcggtcggcctcctgttccggcgcctcacatctagagaggtgctgcttctgaccatcgggctcagcctggtggcttccgtcgaactgcccaactctcttgaggaactgggagacggcctcgccatggggatcatgattctgaaactcctgacagattttcaaagccatcagctttgggccaccctgctctccctgacgttcatcaagacaacctttagcctgcactatgcttggaaaaccatggccatggttctttctattgtgtccctgttccccctctgtctgagcacaacctctcagaagacaacgtggctccctgtgctgcttggatccctgggctgcaagccgctgaccatgtttctcatcgctgagaataaaatttggggccggcgcagctggcccctgaacgaagggatcatggccgtcggaatcgtgtctattcttctgtccagcctcctgaagaacgacgttcctctcgcgggccccctgatcgccgggggaatgcttattgcttgttacgtgatctccggcagctctgccgatctgagcctggagaaagctgccgaggtctcctgggaagaggaagccgagcattctggggctagccacaatattctcgtggaagttcaggacgatggaacaatgaagatcaaagacgaggagagagatgacaccctgacaatccttctgaaggcgaccctcctggccgtgtccggcgtctatcctctctctattcccgctacgctgttcgtgtggtacttctggcagaaaaagaagcagcggagcggcgtcctttgggatacccctagccctcccgaagtggagcgcgccgttctggacgatgggatctatagaattatgcagcggggactgctcggccgctctcaggtgggggtcggagtgtttcaagaaaacgttttccatacaatgtggcacgtgaccagaggcgccgtcctgatgtaccaggggaaacggcttgagcccagctgggcttccgtgaagaaagacctgatcagctacggaggcggctggagactccaggggtcttggaatacaggagaggaagtgcaggttattgccgtcgagcccggcaagaaccctaaaaatgtgcaaaccgcgcccgggacatttaagacgccggaaggagaggtgggcgctatcgccctggacttcaagcctgggacctccggaagccccattgtcaaccgcgaaggcaaaatcgtgggcctctatgggaatggagttgtgacaacctctggcacctacgtctccgccatcgctcaggccaaggcgagccaggaggggcctctgcccgagattgaagatgaggtgtttcggaaaagaaaccttacaatcatggacctgcaccccggatccggcaagacgcgccggtatctgcctgctattgttagagaagccatcaaacgcaagctccggaccctgattcttgccccgacaagagtggtcgcttctgagatggccgaagctctgaaggggatgcccatccgctaccaaaccacagccgtgaaaagcgagcataccggcaaggagatcgttgatctcatgtgccacgcgacgttcacaatgcggctgctgtcccctgtgagagtccccaattataacatgattatcatggacgaagcccattttaccgatcctagctctattgctgcccggggatacatctccacccgcgtgggcatgggggaggctgccgccattttcatgacagctacaccccctggaagcgtggaagcgtttccgcagtctaatgccgtcatccaggacgaggaaagagatatccccgagcggagctggaactccggctatgagtggattacagacttccctgggaaaaccgtttggtttgtgccctctatcaagagcggaaatgatattgctaactgtctccgcaaaaatggcaagagagtgatccagctttcccggaagacgttcgacacagaataccagaaaaccaagaacaacgattgggactacgtcgtgacaaccgacatttctgagatgggggccaatttcagagccgatcgcgttatcgaccctcggagatgcctgaaacccgtgattctgaaggatggcccggaacgcgtcatcctcgctggacctatgcccgtgacggttgccagcgcggctcagcggagaggccgcatcgggcggaaccacaataaagagggagaccagtatatttacatgggccagcccctgaacaatgatgaggaccatgcccactggaccgaagccaagatgcttctggataacatcaatacacctgaggggattatccccgctctctttgaacctgagagagaaaagtccgccgcgattgacggagagtatcgcctgagaggcgaggcccggaaaaccttcgtggaactgatgcgcagaggggatctcccggtctggcttagctacaaggtggcttctgagggctttcaatattccgaccggcgctggtgcttcgatggagaaagaaacaatcaggtcctggaggaaaacatggacgtggagatctggacaaaagagggcgaacggaagaaactgagaccccgctggctcgatgcccggacctacagcgaccctctggctcttagagagtttaaggagttcgccgctgggcgccggtccgtttctggagacctgatcctcgagattggcaaactgccccagcacctgacacagagagcccaaaatgcgctcgataaccttgtgatgctgcataatagcgaacaagggggacgggcctatcgccacgctatggaggagctgcctgacaccatcgaaacgctcatgctgcttgccctgattgctgtgctcacaggcggcgtcaccctgtttttcctgtccgggagaggactcggcaagacctctatcgggcttctgtgtgttatggccagctccgtgctgctctggatggccagcgtggagccccattggattgctgcgtctatcatcctggaatttttccttatggtcctgctcattccggagcctgatcggcagcgcacaccccaggacaaccaactggcctacgtggttatcggactgctctttatgattcttaccgtggctgccaatgagatgggcctgctggaaacaacgaagaaagatctcgggatcggacacgtcgccgtggagaaccaccatcacgctgccatgctggacgtcgatcttcatcctgcgtccgcctggaccctgtacgctgtggccacaaccattatcacacccatgatgagacacaccattgaaaacacgaccgctaatatcagcctcacagccatcgcgaaccaggccgctattctgatgggcctggacaagggctggcctatctctaaaatggatattggggttcccctccttgccctgggatgctattcccaggtgaatccgctgaccctcacagctgccgtcctgatgcttgtggctcattacgccatcattggccctgggctgcaagcgaaggccacccgggaggctcagaaacgcacggccgctggaatcatgaagaaccccacagttgacggcatcgtggccattgatctcgaccccgtcgtgtatgatgccaagttcgaaaaacagctggggcagatcatgctgctcattctttgtaccagccaaatcctgctgatgagaacaacctgggcgctctgcgagtctattaccctggctacaggacctcttacgaccctgtgggagggcagcccgggcaagttttggaatacaaccatcgccgtgtccatggctaacatcttccgggggtcttacctcgccggagccggcctggctttcagcctgatgaaatccctcgggggaggccgcagagggacaggagcccagggcgaaacccttggcgagaagtggaaacggcagctgaatcagctgagcaagtccgaatttaacacgtataagagatctgggattatggaggttgaccgcagcgaagcgaaagagggactcaagcggggcgagacaaccaaacacgccgtctccagagggaccgctaagctgcgctggttcgtggaacggaatcttgtgaaacccgagggaaaggtcatcgacctgggctgtgggagaggaggctggtcttactattgcgccggcctcaagaaagttacagaagtgaaggggtacaccaaaggaggccctgggcacgaggaacccattcctatggctacatacggatggaacctggtgaagctgcatagcggcaaagatgtctttttcattccccctgagaagtgtgacacgctcctttgcgatattggggagtcctctccgaatcccaccatcgaagagggacgcacactgcgggtgctgaaaatggttgaaccttggctcagaggcaaccaattttgtattaagatcctgaatccctatatgcctagcgtggtcgagacccttgagcagatgcagcgcaagcacggcgggatgctggtgcggaaccccctctccagaaatagcacacatgaaatgtactgggtttcttgcggaaccggcaacatcgtgtccgccgtcaatatgacgagccgcatgctgctgaaccggttcaccatggcgcacagaaaaccgacatatgagcgcgacgtggatctcggggccggaaccagacacgtggctgtcgaacctgaggttgccaacctggacattatcggccagcggattgaaaatatcaagcatgagcacaaatctacatggcattacgatgaggacaacccctataagacctgggcttaccacgggtcctatgaagtgaaacccagcggatctgcctccagcatggtgaatggcgtcgtgaaacttctgacaaagccttgggatgttattcccatggtgacccaaatcgctatgacggacacaaccccttttggccagcagcgcgtcttcaaagagaaggtggataccagaacaccgaaagccaagcgggggacggcgcaaatcatggaagttaccgccaaatggctctggggatttctgtccagaaacaagaagccccggatttgtacacgcgaggagttcaccagaaaagtgcggagcaatgctgccatcggcgctgtctttgtggacgagaaccagtggaactctgccaaggaggccgttgaagacgagcgcttctgggatcttgtgcatagagaacgggagctgcacaaacaggggaagtgcgcgacatgcgtctacaacatgatgggaaaacgcgaaaagaagctcggcgagtttgggaaagctaagggcagcagagccatttggtacatgtggctgggagcccggttcctggagttcgaagctctcggctttatgaatgaggaccactggttctcccgcgaaaactctctgagcggggtggagggagagggccttcataaactggggtatatcctcagagatatttccaagatccctggaggcaatatgtacgccgacgataccgctgggtgggacacacggatcaccgaagatgacctgcagaacgaggcccgcattacggatatcatggaacccgagcacgcgcttctggccagatctatttttaaactcacctatcaaaataaggtcgtgcgggttcagcgccctgctaaaaacggcacagtgatggacgtcatcagcagacgggatcagagaggatccggccaggtggggacctacggactgaatacattcaccaacatggaagcccaactgattcgccagatggagtctgagggcatctttagcccctccgaactcgagacgccgaacctggctgaacgggtgcttgactggctggagaagtatggggttgaaagactcaagcgcatggccatcagcggagatgactgtgtggtcaaacctattgacgatcggttcgcgacagccctgaccgctcttaatgacatgggcaaggtgagaaaagatatcccccagtgggagccttctaaggggtggaacgactggcagcaagttcccttttgctcccatcacttccaccagctgattatgaaagatggccgcgagatcgtggtcccttgtcggaatcaggacgaactcgtgggcagagcccgcgtcagccagggcgctgggtggtctctgcgggagacagcctgcctgggaaagtcctacgctcaaatgtggcagctcatgtattttcatagacgcgatctgcggcttgccgcgaacgccatttgtagcgctgtgcccgttgactggatcccgacctccagaacgacctggtctattcacgcccatcaccagtggatgacaaccgaagatatgctgagcgtgtggaatcgggtctggatcgaggaaaacccttggatggaggacaagacacatatctccagctggggcgatgtgccctacctcgggaaaagagaggaccaatggtgcggatctctgattggccttaccgcccgcgctacatgggccaccaatatccaggttgcgattaaccaggtgcggagactgatcgggaatgaaaactacctcgactatatgacgtccatgaagcgcttcaaaaatgagagcgatcccgaaggcgctctgtggtga

SEQ ID NO: 19151 - RNA, 9879 nt, synthetic construct
  misc_feature 1..9879: note = derived and/or modified CDS sequence (opt5) from DENV-1__GU131697__SS-prME
  source 1..9879: mol_type = other RNA
tccgtgaccatgctgctcatgctgatgcccaccgcccttgctttccacctgacgaccagaggaggggaacctcatatgatcgtctccaagcaggaacggggaaagtctctcctgtttaagaccagcgccggcgttaatatgtgcacccttatcgcgatggacctgggggagctctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagtaccaagttgggaatgagagcacagaacatggaaccacagctaccattacgccccaggcccctaccacagagatccagctcaccgactatggcgccctgacactggattgttctccccggaccggcctcgacttcaacgaaatggtgctgcttacgatgaaggagaaatcctggctggtccacaagcagtggtttctcgatctgcctcttccctggacaagcggggcttccacctctcaagagacatggaataaacaggacctgctcgtgaccttcaagaccgcgcatgccaagaaacaggaagtcgtggttctgggaagccaagagggcgctatgcacacagccctgacgggggccaccgaaattcagacatccggaaccacaaccatctttgctggccacctcaagtgccgcctgaaaatggataaacttacgctgaaagggatgagctacgtgatgtgtacaggctctttcaagctcgagaaggaagtcgccgagacccagcatggaaccgtgctggttcagattaaatatgagggcacagacgcgccgtgcaagatccctttctccacccaagatgaaaaaggggtgacacagaacggaagactgatcacggctaatcccattgtcaccgacaaggagaaacctgtgaacatcgaagccgagccgccctttggcgagagctacattgtgatcggggccggagaaaaggctcttaagctctcttggttcaaaaagggcagctccattgggaaaatgtttgaggccacagctcggggcgccagacgcatggcgatcctgggagataccgcctgggacttcggctctatcgggggagtttttacaagcgtcggcaagctgattcaccagatcttcgggaccgcttacggagtgctcttttccggcgtgagctggacgatgaaaattgggatcggcgtcctgcttacctggctgggactcaattctcggtccacaagcctgtctatgacctgtattgccgtgggcctggttacactttatctcggggtgatggtccaggctgattccggatgcgtgatcaactggaagggcagagaactgaagtgtgggagcggaattttcgttaccaatgaggtgcatacatggaccgaacaatacaaatttcaggccgactcccctaagcgcctgtctgcggccatcggcaaggcttgggaggagggggtctgcggcatccggagcgccacgagactcgaaaacattatgtggaagcagatctccaacgagctgaatcacattcttctggaaaacgacatgaaactcacagtggttgtgggagatgtcgctggcatcctggggcagggaaagaaaatgattcgcccgcaacccatggagtataagtactcttggaaaagctggggcaaggccaagatcatcggggccgacgctcagaataccaccttcattatcgatggacctaacacacccgaatgtcctgacgatcagcgggcgtggaatatttgggaggtggaggactatggctttggcatcttcaccacgaacatttggctgaaacttagagattcctacacacaggtgtgcgaccatcgcctcatgagcgccgctatcaaggattctaaagccgtccacgccgacatggggtattggatcgaatccgagaagaatgaaacctggaagctggctcgggccagctttattgaggttaaaacatgtatctggcccaagtctcacaccctgtggtccaacggagtgctcgaaagcgagatgattatcccgaaaatttacggcgggcctatctctcaacataattacagacccggatatttcacacagaccgcgggcccttggcacctggggaaacttgagctggatttcgacctctgcgaaggaacgaccgtggtcgtggatgagcattgcggcaaccgcggccccagcctgcggacaaccacagttaccgggaaaatcattcacgaatggtgttgcagatcctgtacgctgcctccccttcggtttcgcggagaggacggctgctggtacgggatggagatcagaccggtgaaggaaaaggaggaaaatctcgtcaaaagcatggtgtctgctggatccggcgaggttgacagcttctccctggggctgctctgtatttctatcatgattgaagaggtgatgcggagcagatggtcccgcaagatgctgatgacaggaacccttgccgtctttttcctgctcatcatgggccagctgacatggaacgatctgattcggctttgcatcatggtgggcgccaatgcttttgacagaatggggatgggaaccacctatctggccctcatggcgacattcaaaatgcgccctatgtttgctgttggcctcctgttcagacggctgacgtctcgcgaggtgcttctgctcaccatcgggctgagcctggtcgcctccgtggaacttcccaactctctggaggaactcggagatggcctggccatggggattatgatcctcaagctgcttacagactttcaaagccaccagctgtgggctaccctcctgtccctgacattcattaaaaccacgtttagccttcattacgcctggaagacaatggctatggtgctgtctatcgtctccctcttccccctgtgtctcagcaccacctctcagaagacaacctggctgcctgttcttctgggatccctgggctgcaaaccgctcacaatgtttctgattgccgagaataagatctggggcagaaaaagctggccccttaacgaagggatcatggcggtgggaattgtgtctatcctgctctccagcctgctcaagaacgatgtccctctggccggcccccttattgctgggggaatgctgatcgcctgttatgtgatttccggcagctctgctgacctgagcctcgagaaagccgccgaggtttcctgggaagaggaagctgagcactctggggcgagccataatatcctggtggaagtccaggatgacggaacgatgaagatcaaagatgaggagcgggacgatacccttacaattctgctcaaggccaccctgctcgctgtgtccggcgtttaccctctgtctatccccgccacacttttcgtgtggtatttctggcaaaagaaaaagcagcgcagcggcgtcctgtgggacacccctagccctcccgaagtggagagagccgtcctggatgacgggatttaccggatcatgcagcgcggactcctgggcagatctcaggtgggggttggagtgtttcaagaaaacgtcttccacacgatgtggcatgtgacccggggcgctgttcttatgtaccaggggaaacgcctggagcccagctgggcctccgtgaagaaagacctcattagctatggaggcggctggagactgcgggggtcttggaatacaggagaggaagtccaggtgatcgcggtggagcccggcaagaaccctaagaatgttcagaccgctcccgggacatttaaaaccccggaaggagaggtcggcgccattgccctcgatttcaagcctgggacatccggaagccccatcgtgaacagagaaggcaaaatcgtgggcctgtacgggaatggagtcgtgacgacctctggcacatatgtttccgctattgcccaagcgaaggctagccaggaggggcctcttcccgagatcgaagacgaggtgtttcgcaaacggaacctgaccattatggatctgcaccccggatccggcaagaccagacgctacctccctgccatcgtccgggaagccattaagagaaaactgcgcacacttatcctggctccgacgcgggtggttgcctctgagatggctgaagccctcaaggggatgcccatcagatatcagaccacagcggtgaaaagcgagcacaccggcaaggagattgtcgacctgatgtgccatgccacattcaccatgcgcctgctctcccctgtgcgggttcccaattacaacatgatcattatggatgaagctcactttacggaccctagctctatcgccgctagaggatatatttccacacgggtgggcatgggggaggccgccgctatcttcatgaccgcgacaccccctggaagcgtcgaagcctttccgcaatctaatgctgtgatccaggatgaggaacgcgacattcccgagagaagctggaactccggccatgagtggatcacagatttccctgggaaaaccgtgtggtttgtcccctctattaagagcggaaatgacatcgccaactgtcttcggaagaatggcaaacgcgttattcagctgtccagaaagacattcgataccgaataccagaaaacgaagaacaacgactgggactacgtggtgacaaccgatatctctgagatgggggccaatttccgggctgacagagtcattgatcctcgccggtgcctgaaacccgtgatcctcaaggacggcccggaaagagttatcctggccggacctatgcccgtgacagtcgcgagcgctgcccaacgccggggcagaattgggcgcaaccacaataaggagggagatcagtatatctacatgggccagccccttaacaatgacgaggatcatgcccactggaccgaagctaaaatgctgctcgacaacattaatacgcctgaggggatcattcccgccctgtttgaacctgagcgggaaaagtccgcggccgtggatggagagtatagactgcgcggcgaggctagaaaaaccttcgttgaactcatgcggcgcggggaccttccggtgtggctgagctacaaggtcgcctctgagggctttcagtattccgatagacggtggtgcttcgacggagaacgcaacaatcaagtgctggaggaaaacatggatgtcgagatctggacaaaagagggcgaaagaaagaaactccggcccagatggctggacgctcgcacctacagcgaccctcttgccctgcgggagtttaaggagttcgctgccgggagacgctccgtgtctggagatctcatcctggagattggcaagctgccccagcacctcacacagcgggcgcagaatgcccttgacaacctggttatgctgcataatagcgaacaagggggcagagcttatcggcacgccatggaggagctccctgataccatcgaaacactgatgcttctggctctcattgccgtgctgaccggcggcgtgacgctgtttttcctctccgggcgcggacttggcaaaacatctatcgggctgctgtgtgtcatggccagctccgttctcctgtggatggctagcgtggagccccattggattgcggcctctatcatccttgaatttttcctgatggtgctcctgattccggagcctgacagacagcggacaccccaggataaccagctggcttacgtcgtgatcggactcctttttatgattctgaccgttgccgccaatgagatgggcctgctcgaaacaaccaagaaagacctggggatcggacacgtggctgtcgagaaccaccatcacgccgcgatgcttgatgtggacctgcatcctgcctccgcttggacactctacgccgtcgctacgaccattatcacacccatgatgcgccacaccattgaaaacacaaccgccaatatcagcctgacggcgatcgccaaccaagctgccattctgatgggcctcgataagggctggcctatctctaaaatggacattggggtgccccttctggctctgggatgctattcccaggttaatccgctcaccctgacagccgctgtgcttatgctggtcgcccattacgcgatcattggccctgggctccaggccaaggctaccagagaggcccaaaagcggacagctgccggaatcatgaaaaaccccaccgtggatggcatcgttgccattgacctggatcccgtggtctatgacgcgaagttcgaaaaacagctggggcagatcatgctccttattctgtgtacgagccagatcctgctcatgcgcacaacctgggctctgtgcgagtctattacacttgccaccggacctctgaccacactctgggagggcagcccgggcaagttttggaatacgaccatcgctgtgtccatggccaacatcttcagagggtcttacctggccggagctggcctggccttcagcctcatgaaatcccttgggggaggccggcgcgggacaggagcgcaaggcgaaaccctgggcgagaagtggaagagacagctgaatcagctcagcaaatccgaatttaacacatataagcggtctgggattatggaggtggacagaagcgaagccaaagagggactgaagcgcggcgagaccacgaaacacgctgtttcccgggggacagccaaacttagatggttcgtcgaacgcaatctggtgaagcccgagggaaaagtgatcgatctcggctgtgggcggggaggctggtcttactattgcgctggcctgaagaaagtcaccgaagttaaggggtacaccaaaggaggccctgggcacgaggaacccattcctatggccacatacggatggaacctggtgaagctccatagcggcaaagacgtgtttttcattccccctgagaagtgtgatacccttctgtgcgacattggggagtcctctccgaatcccacaatcgaagagggaagaacgctgcgcgtcctcaagatggtggaaccttggctgcggggcaaccagttttgtattaaaatccttaatccctatatgcctagcgttgtggagaccctggagcaaatgcagagaaagcacggcgggatgctcgtccgcaaccccctgtcccggaatagcacacatgaaatgtactgggtgtcttgcggaaccggcaacatcgtttccgcggtgaatatgacaagcagaatgctgctcaaccgcttcaccatggcccaccggaaaccgacgtatgagagagatgtcgacctggggaccggaacacgccacgtggctgtggaacctgaggtcgccaaccttgatattatcggccagagaattgaaaatatcaagcatgagcacaaatctacctggcattacgacgaggataacccctataagacatgggcttaccacgggtcctatgaagttaagcccagcggatctgcctccagcatggtgaatggcgtggtcaaactgctcaccaagccttgggacgtgattcccatggttacacagatcgctatgaccgatacgacaccttttggccaacagcgggtgttcaaagagaaggtcgacacccgcaccccgaaagccaagagagggacagcgcagatcatggaagtgacggcccggtggctgtggggatttctttccagaaacaagaaaccccggatttgtacccgcgaggagttcacaagaaaggttcggagcaatgctgccatcggcgctgtgtttgtcgacgagaaccaatggaactctgccaaagaggccgtggaagatgagcgcttctgggacctggttcatagagaacgggagctccacaagcaggggaaatgcgcgacctgcgtgtacaacatgatgggaaagcgcgaaaagaaactgggcgagtttgggaaggctaaaggcagcagagccatttggtacatgtggctgggagcccggttcctcgagttcgaagctctgggctttatgaatgaggatcactggttctcccgcgaaaactctcttagcggggtcgagggagagggcctgcataagctcgggtatatcctgagagacatttccaaaatccctggaggcaatatgtacgccgatgacacagctgggtgggatacccggatcacagaagacgatcttcagaacgaggccaagattaccgacatcatggaacccgagcacgcgctgctcgccaaagctatttttaagctgacgtatcagaataaggtggtccgcgtgcaaagacctgccaaaaacggcaccgttatggatgtgatctctcggcgcgaccagagaggaagcggccaggtcgggacatacggactgaataccttcacaaacatggaagctcagctcattcggcaaatggagtccgagggcatcttttctcccagcgaactggagaccccgaaccttgccgaaagagcgctggattggctcgagaagtatggggtggaacgcctgaaacggatggccatctccggagacgactgtgtggttaagcctattgatgacagattcgctacggcccttacagctctgaatgatatgggcaaagtgcgcaaggacatcccccagtgggagcctagcaaggggtggaacgattggcagcaggtccccttttgctctcatcacttccaccaactcattatgaaagacggccgggagatcgtggttccttgtagaaatcaggatgaactggtgggacgcgcccgggtctcccagggcgctgggtggagcctgagagagaccgcctgcctcggaaagtcttacgcgcagatgtggcaactgatgtattttcatcgccgggaccttagactggccgctaacgccatttgttccgccgtgcccgtcgattgggtgccgacaagccgcaccacgtggtccatccacgctcatcaccagtggatgaccacagaagacatgctctctgtttggaatcgggtgtggattgaggaaaacccttggatggaggataaaacccatatcagctcctgggaggacgtcccctacctgggcaagagagaagaccagtggtgcgggagccttatcggactgacagcccgggcgacctgggctacaaatattcaagtggccatcaaccaggttagacgcctcattggcaatgagaactacctggattatatgacctctatgaaacggttcaagaatgaatccgaccccgagggggccctgtggtga

SEQ ID NO: 19152 - RNA, 9879 nt, synthetic construct
  misc_feature 1..9879: note = derived and/or modified CDS sequence (opt5) from DENV-1__GU131700__SS-prME
  source 1..9879: mol_type = other RNA
agcgtgaccatgctgctgatgctgatgcccaccgcccttgctttccacctgacgaccagaggaggggagcctcatatgatcgtctccaagcaggaacggggaaagtctctcctgtttaagacaagcgccggcgttaacatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagccacacacaggtttgcgaccaccggctgatgtctgccgctatcaaggattccaaagccgtgcatgccgacatgggctattggattgaaagcgagaagaatgaaacctggaaacttgctagagcctctttcatcgaggtgaaaacatgtatctggcccaagtcccacaccctctggagcaacggggtcctggaatctgagatgattatcccgaaaatttacggaggccctatcagccagcataattatcgccccgggtactttacacaaaccgcgggaccttggcacctgggcaagctcgagctggatttcgacctttgcgaagggacgaccgtggttgtggatgagcactgcggaaaccggggcccctccctgagaacaaccacagtcaccggcaaaattatccatgaatggtgttgccggagctgtacgctccctcccctgcgctttaagggggaggacggatgctggtacggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctatctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccaccaactgtgggctacccttctgtctctcacatttattaagaccacgttctccctgcattacgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttatgtgatttctggaagctccgctgacctttctctggagaaggccgccgaggtcagctgggaagaggaagctgagcactccggcgcgtctcataatatcctggtggaagttcaggatgacgggacgatgaaaattaaggatgaggagcgggacgataccctcacaatcctgcttaaggccaccctgctcacagtgagcggagtctaccctctgtccatccccgctaccctcttcgtgtggtatttttggcagaaaaagaaacaacgctctggcgtcctgtgggacacgccttcccctcccaaggtggaaagagccgttcttgatgacggcatttaccggatcatgcagcgcgggctgctgggaagatcccaggtgggcgtcggggtgttccaggagaacgtttttcacaccatgtggcacgtgacacggggagccgtcctcatgtatcaaggcaaacgcctggaacccagctgggcttctgtgaagaaggaccttatttcctacgggggaggctggagactgcagggcagctggaataccggggaggaggtgcaggttatcgccgtcgaacccggcaagaatcctaagaatgtgcagacagcgcccggcaccttcaaaacatctgagggggaagtgggagctattgccctcgattttaagccgggcacgtccgggagccctatcgtcaaccgggagggaaaaattgtgggcctgtacggcaatggggttgtgaccacatccggaacctatgtctctgccatcgctcaagccaaggcgagccaggaaggccccctccctgagatcgaggacgaagtgttcagaaagcgcaacctgaccattatggatcttcatcccgggtccggaaaaacacggagatacctgcccgctatcgttcgcgaggccattaagcggaaactgagaacgctcatcctggcccctacccgcgtggtcgctagcgaaatggccgaggctcttaagggcatgccgattcggtatcagacaaccgccgtgaaatctgaacacacagggaaggagatcgttgacctgatgtgccatgcgacctttacgatgagactcctgtcccccgtgcgcgtccctaattacaacatgatcattatggatgaggcccacttcacagaccccagctctatcgctgcccggggctatattagcaccagagtgggaatgggcgaagctgccgccatctttatgaccgctacacctcccgggtccgtggaggcgttccctcaatctaatgccgtcattcaggatgaagaacgggacatcccggaacgcagctggaactccggatacgagtggatcaccgattttcccggcaagacagtttggttcgtgccttctattaaaagcgggaatgacatcgctaactgtctgagaaagaatggaaaacgggtgattcagctctcccgcaagaccttcgatacggagtatcagaaaacaaagaacaacgactgggactacgtcgtgaccacagatatcagcgaaatgggcgccaattttagagccgaccgggttattgatcccagacgctgccttaagcctgtgatcctgaaagacgggcccgagcgggtcattctggctggcccgatgcctgtgaccgttgcctctgcggctcaaagacgcggacggatcggcagaaaccataataaggaaggggatcagtacatctatatgggacagcccctcaacaatgacgaggatcacgcccactggacggaggccaaaatgctgcttgacaacattaatacccccgaaggcatcattcctgctctgttcgagcccgaacgcgagaagtccgccgcgatcgatggggaataccggctcagaggagaggcccgcaaaacatttgtggagctgatgagacggggcgacctgcctgtctggctcagctataaggtggcttccgaagggttccagtactctgatcgcagatggtgctttgacggcgagcggaacaatcaagtccttgaagagaacatggatgtggaaatttggaccaaagagggagagcgcaagaagctgagaccgcggtggctggacgccagaacatatagcgaccccctcgctctgcgcgagttcaaagagtttgccgctggccggagatccgtttctggggatcttatcctggaaatcggaaagctccctcagcatctgacccagcgcgcccagaatgcgctggacaacctcgtgatgcttcacaatagcgagcaaggcgggcgggcctacagacatgctatggaggaactgcccgatacaattgagaccatgatgctgctcgccctgatcgctgtgcttacgggaggcgtcacactgttctttctctccggccgggggctgggaaaaaccagcattggcctgctctgtgttatggcctcttccgtgcttctgtggatggccagcgtggaacctcactggatcgctgcgtctattatcctggagttctttctcatggtcctgcttatccccgaaccggaccgccagagaacccctcaggataaccagctggcctatgtggttattgggctcctgttcatgatcctgacagtggctgccaatgagatgggactccttgagaccacaaagaaagacctgggcattgggcacgtcgccgtggaaaaccatcaccatgctgccatgctggatgtcgacctccaccccgcgtccgcctggacgctgtacgctgtggccaccacaatcattacccctatgatgcggcatacaatcgagaacaccacggctaatattagccttaccgccatcgcgaaccaagccgctatcctgatgggactcgataagggctggcccatttctaagatggacatcggcgttcctctgctggccctcgggtgctacagccaggtgaatccccttacactgaccgctgccgtcctgatgctcgtggctcactatgccattatcggaccgggcctgcaggcgaaagccacacgcgaagctcaaaagagaaccgccgctgggattatgaaaaaccctacggttgatggaatcgtggccatcgaccttgatcccgtcgtgtacgacgccaagtttgagaaacagctgggccagattatgctcctgatcctgtgtacatcccagattctccttatgcggaccacatgggcgctgtgcgaatctatcaccctggctaccgggcccctcacaacgctgtgggagggaagccctggcaagttctggaataccacaattgccgtgtccatggctaacatcttccgcggcagctatcttgccggggccggactggctttttccctcatgaagtctctgggcgggggaagacggggcaccggggcccaaggagagacactgggcgaaaaatggaagcgccagctcaatcagcttagcaaatccgagttcaacacctacaagagatctggcatcatggaagttgaccggagcgaggcgaaagaagggctgaagagaggagagacgacaaagcacgccgtctcccgcggcaccgctaaactgcggtggtttgtggagagaaatctcgtgaagccggaagggaaagtcattgatctgggatgtggccgcgggggatggtcttattactgcgccggccttaagaaagttaccgaggtgaagggctatacaaaagggggacccggccatgaggaacctatccccatggctacctacgggtggaacctggtgaagctccacagcggaaaggacgtcttctttattcctcccgaaaaatgtgatacactgctgtgcgacatcggcgagtccagccctaatccgacgattgaggaagggcggaccctcagagtgcttaagatggttgagccctggctgcgcggaaaccagttctgtatcaaaattctgaatccttacatgccctctgtggtcgaaacactcgagcaaatgcagcggaagcatggcggcatgctggtgagaaaccctctttcccgcaatagcacccacgagatgtattgggtttcttgcgggacaggaaacatcgtgtccgccgtcaatatgaccagccggatgctgctcaacagatttacgatggcgcaccgcaaacccacctacgaacgggatgtggacctgggcgccgggacaagacatgtggctgtcgagccggaagttgccaacctggatatcattggacagcgcatcgagaatattaagcacgaacataagtctacctggcactatgacgaggataacccttacaaaacatgggcttatcatggctcctacgaggtgaagcccagcgggtccgccagctctatggtgaatggagtcgtgaaactcctgaccaagccctgggacgttatccctatggtgacacagattgctatgaccgatacgacacccttcggccaacagagagtctttaaagaaaaggtggacacccggacccctaaggccaaacgcggcacagcgcagatcatggaggttacggccaagtggctttgggggttcctgagcagaaacaaaaagccgcggatctgtaccagagaagagtttacacggaaagtgcgctccaatgctgccattggagctgtcttcgtggacgaaaaccaatggaactctgccaaggaggccgttgaggatgaaagattttgggacctcgtgcaccgggagcgcgaactgcacaagcagggcaaatgcgcgacctgcgtctataacatgatggggaagagagagaagaaacttggagagttcggcaaagctaaagggagccgggccatctggtacatgtggctgggcgcccgcttcctcgagtttgaggctctgggattcatgaatgaagatcattggttttccagagagaactctctgagcggcgtggaaggggagggactccacaaactgggctacattcttcgggacatctccaagattcccgggggaaatatgtatgccgatgacacagctggctgggatacccgcatcacagaggacgatctgcagaacgaagccaagatcaccgacattatggagcctgaacatgcgctcctggccaaatctatcttcaaacttacgtaccagaataaagtcgtgagagttcaacggcccgctaagaacgggaccgtgatggatgtcattagccgcagagaccagcggggctccggacaggtgggcacatatgggctgaatacctttacaaacatggaggcccagctcatccgccaaatggaaagcgagggaattttctctccttccgagctggaaacccccaacctggctagacgggtgctcgattggctggagaaacacggcgttgaaagacttaagcgcatggccatcagcggggacgactgtgtggtcaagccgatcgatgaccggtttgcgacggccctgacagctctcaatgatatgggaaaagtgagaaaggacattcctcagtgggagccctctaaaggctggaacgattggcagcaggttcctttctgctcccaccattttcaccaactgatcatgaaggacgggcgcgaaattgtggtcccctgtcggaatcaggatgagcttgtgggcagagcccgcgtcagccagggagctggctggtccctgcgggagaccgcctgcctcgggaaatcttacgctcagatgtggcaactgatgtatttccatagacgcgacctgcggctcgccgcgaacgccatctgtagcgctgtgcctgttgattgggtgcccacatccagaaccacgtggagcattcacgcccatcaccagtggatgaccacagaagacatgctgtctgtctggaatcgcgtgtggatcgaggaaaacccgtggatggaggataagacccacatttccagctggggagacgttccttaccttggcaagcgggaagaccagtggtgcgggtctctgatcggactcacagccagagctacctgggccacaaatatccaagtggcgattaaccaggtccggagactgatcggcaatgagaactatcttgattacatgaccagcatgaaacgctttaagaatgagtccgaccccgaaggggctctgtggtga

SEQ ID NO: 19153 - RNA, 9879 nt, synthetic construct
  misc_feature 1..9879: note = derived and/or modified CDS sequence (opt5) from DENV-1__GU131701__SS-prME
  source 1..9879: mol_type = other RNA
agcgtgaccatgctgctcatgctgatgcccacagctcttgctttccacctgacgaccagaggaggggaacctcatatgatcgtctccaagcaagaacggggaaaatctctcctgtttaagacaagcgccggcgttaatatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgaccgctctttttctggcccatgtcatcgggacctctattacacagaagggaatcatcttcattctcctgatgcttgtgacgcctagcatggcgatgagatgcgttggcatcgggtcccgggattttgtggagggactgagcggcgccacctgggtcgacgtggtgctcgagcacgggtcttgtgtcacaaccatggctaaggataaacccacactggacattgaactgctcaagaccgaggttacgaaccctgccgtgctgcgcaaactttgcatcgaagctaagatttccaatacaaccaccgatagcagatgtccgacacaaggagaggccaccctggtggaagaacaagacgcgaacttcgtctgccggcgcacatttgtggatagaggctggggcaatgggtgtggactcttcggcaaagggtctctgatcacgtgcgccaagtttaagtgcgttaccaaacttgagggaaagattgtgcagtacgaaaacctgaaatattccgtcatcgtgacagttcacaccggcgaccagcatcaagtggggaatgagagcacagaacacggaaccacggctaccatcacaccccaggcccctaccacagagattcagctcaccgactacggcgctctgacgctggattgttctccccggacaggcctcgacttcaacgaaatggtcctgcttaccatgaaggagaaatcctggctggtgcataagcagtggtttctcgatctgcctcttccctggacaagcggggcctccacctctcaagagacctggaatcgccaggacctgctcgtcacattcaaaacggcccacgctaagaagcaggaagtggttgtgctgggaagccaagagggcgcgatgcacaccgccctgacaggggctaccgaaatccagacatccggaaccacgacaatttttgccggccatctcaaatgcagactgaagatggataaacttaccctgaaggggatgagctatgtcatgtgtaccggctctttcaaactcgagaaggaagtggccgagacacagcacggaaccgttctggtgcagatcaagtacgagggcacagacgctccgtgcaaaattcctttctccacgcaagatgaaaagggggtcacccagaacggacggctgatcacagccaatcccaccgtgacagacaaagagaagcctgtgaacatcgaagcggagccgccctttggcgagagctatattatcattggggctggagaaaaagcccttaagctctcttggttcaagaaaggcagctccatcgggaagatgtttgaggccaccgctagaggcgcccgccggatggctattctgggagatacggcctgggacttcggctctatcgggggagtttttaccagcgtcggcaaactggtgcatcagatcttcgggacagcgtacggagtgctcttttccggcgtcagctggaccatgaagattgggatcggcgtgctgcttacatggctgggactcaattctagatccaccagcctgtctatgacatgtattgccgttggcctggtgaccctttacctcggggtcatggtgcaggctgattccggatgcgttatcaactggaaaggccgcgaactgaagtgtgggagcggaattttcgtgacgaatgaggtccacacatggaccgaacaatataagtttcaggccgactcccctaaacggctgtctgctgccatcggcaaggcgtgggaggagggggtgtgcggcattagaagcgccacccgcctcgaaaacatcatgtggaaacagatctccaacgagctgaatcatattcttctggaaaacgacatgaagttcacagttgtggtcggagatgtggctggcatcctcgcccaggggaaaaagatgattcggccgcaacccatggagtacaaatattcttggaaaagctggggaaaggctaagatcattggcgccgacgtgcagaataccacgtttatcatcgatgggcctaacacacccgaatgtcctgacgatcagagagcctggaatatttgggaggtcgaggactacggattcggcatctttaccacaaacatttggctgaagctgcgcgattcctatacccaggtttgcgaccaccggcttatgagcgctgcgatcaaagattctaaggccgtgcacgctgacatgggctactggattgaatccgagaaaaatgaaacatggaagctcgccagagccagcttcatcgaggtgaagacctgtatctggcccaaatctcatacgctgtggtccaacggggtcctggaaagcgagatgattatcccgaagatttatggaggccctatctctcaacacaatcatcgccccgggtacttcacccagacagctggaccttggcacctcggcaaactggagcttgattttgacctgtgcgaagggaccacagtggttgtggatgagcactgcggaaaccggggccccagcctcagaaccacgacagtcaccggcaagattatccatgaatggtgttgccggtcctgtacactgcctcccctgcgcttcagaggggaggacggatgctggtacggcatggagatccggccggtgaaagaaaaggaggaaaatcttgttaagagcatggtgtctgccgggtccggagaggtcgacagcttttccctcggcctgctgtgtatttctatcatgattgaagaggtgatgagaagccgctggtcccggaaaatgctcatgaccgggaccctggcggttttctttcttctgatcatgggacagctcacatggaacgatctgattagactgtgcatcatggtgggcgctaatgcctctgaccgcatgggcatggggacgacctatcttgccctgatggctacattcaagatgagacctatgtttgccgtcggactcctgttccggcgcctcaccagcagagaggtgctgcttctgacaattggcctctccctggtggcgtctgtcgaactgcccaacagccttgaggaactgggggatggactcgctatgggcatcatgatcctgaaactcctgaccgactttcaaccccaccagctttgggccacgctgctctccctgacattcattaagaccacctttagcctgcattacgcctggaaaacaatggctatggttctttctatcgtgtccctgttccctctctgtctgagcaccacatctcagaagacgacctggctcccggtgctgcttgggtccctgggatgcaagcccctgacaatgtttctcattgccgagaataaaatctggggccggcgcagctggcctctgaacgaaggcattatggctgtcgggatcgtgtctatccttctgtccagcctcctgaagaacgatgttcccctcgccggacctctgattgcgggcgggatgcttatcgcctgttatgtgatttccggaagctctgctgacctgagcctggagaaagccgctgaggtctcctgggaagaggaagccgagcactctggcgccagccataatatcctcgtggaagttcaggatgacgggaccatgaagattaaagatgaggagagagacgatacactgaccatccttctgaaggctacgctcctggcggtgtccggagtctaccccctctctatccctgccaccctgttcgtgtggtatttctggcagaagaagaagcagcggagcggcgtcctttgggacacaccctccccgcctgaagtggagcgcgctgttctggatgacggcatttacagaatcatgcagcgggggctgctcggacgctctcaggtgggcgtcggggtgtttcaagaaaacgttttccacaccatgtggcacgtgacaagaggagccgtcctgatgtatcagggcaaacggcttgagcccagctgggcctccgtgaagaaagacctgattagctacgggggaggctggagactccagggctcttggaataccggggaggaagtgcaggttatcgctgtcgagcctggaaagaaccccaaaaatgtgcaaacagccccgggcacgtttaagacccctgaaggggaggtgggagcgattgctctggatttcaagcccggcacatccgggagccctatcgtcaaccgcgaaggaaaaattgtgggcctctacggcaatggggttgtgaccacctctggaacatatgtctccgccatcgcccaggctaaggccagccaggagggccccctgcccgagatcgaagacgaggtgtttcggaaaagaaaccttacgattatggatctgcatcctgggtccggaaagacccgccggtacctgccggcgatcgttagagaagctattaaacgcaagctccggacactgatccttgcccccaccagagtggtcgcctctgagatggctgaagccctgaagggcatgcctattcgctatcaaacaaccgctgtgaaaagcgagcacacggggaaggagatcgttgacctcatgtgccatgccacattcaccatgcggctgctgtcccccgtgagagtccctaattacaacatgatcattatggatgaagcgcactttaccgaccccagctctatcgccgctcggggctatatttccacacgcgtgggaatgggcgaggccgctgccatcttcatgaccgccacacctccggggagcgtggaggcttttccccagtctaatgcggtcattcaggatgaggaaagagacatccctgagcggagctggaactccggatacgagtggatcaccgatttccccggcaaaacggtttggtttgtgccttctattaagagcgggaatgacatcgccaactgtctccgcaaaaatggaaagagagtgattcagctttcccggaagacattcgataccgaatatcagaaaacaaagaacaacgactgggactacgtcgtgaccacggatatctctgagatgggcgctaatttcagagccgaccgcgttattgatccccggagatgcctgaaaccggtgatcctgaaggacgggcctgaacgcgtcattctcgccggccccatgcccgtgaccgttgctagcgccgcgcagcggagaggacgcatcggccggaaccataataaagagggggatcagtacatctatatgggacagcctctgaacaatgacgaggatcacgctcactggacagaagccaagatgcttctggacaacattaatacccccgagggcatcattcctgccctctttgaaccggagagagaaaagtccgctgccatcgatggggagtaccgcctgagaggagaggcgcggaaaacattcgtggaactgatgcgcagaggcgacctccccgtctggcttagctataaggtggcctctgaggggtttcaatactccgatcggcgctggtgcttcgacggcgaaagaaacaatcaggtcctggaggaaaacatggatgtggagatttggaccaaagagggagaacggaagaaactgagacctcgctggctcgacgctcggacatatagcgaccccctggcccttagagagtttaaggagttcgctgccggccgccggtccgtttctggggatctgatcctcgagatcggaaaactgcctcagcatctgacccagagagctcaaaatgccctcgacaaccttgtgatgctgcacaatagcgaacagggcgggcgggcgtaccgccatgccatggaggagctgcccgatacgattgaaacactcatgctgcttgctctgatcgccgtgctcaccggaggcgtcaccctgtttttcctgtccggcagagggctcggaaagacatctattggccttctgtgtgttatggctagctccgtgctgctctggatggccagcgtggagccgcactggatcgccgcttctattatcctggaatttttccttatggtcctgctcatccctgagcccgaccggcagcgcacccctcaggataaccaactggcgtatgtggttattgggctgctctttatgatccttacagtggccgctaatgagatgggactgctggaaacgaccaagaaagacctcggcattgggcacgtcgccgtggagaaccatcaccatgccgctatgctggatgtcgaccttcaccccgcctccgcgtggacactgtacgccgtggctaccacaatcattacccctatgatgagacatacgatcgaaaacaccacagccaatattagcctcaccgctatcgccaaccaggcggccatcctgatgggactggataagggctggcccatttctaaaatggacatcggcgttccgctccttgctctggggtgctactcccaggtgaatcctctgacactcaccgccgctgtcctgatgcttgtggcccactatgctattatcggacccggcctgcaagccaaggcgacgcgggaggcccagaaacgcacagctgccgggattatgaagaaccccaccgttgatggaatcgtggctatcgacctcgatcctgtcgtgtacgacgccaagttcgaaaaacagctgggccagattatgctgctcatcctttgtacaagccaaattctgctgatgagaaccacctgggccctctgcgagtctatcacactggcgacggggccgcttaccacactgtgggagggaagccccggcaagttttggaataccacaattgctgtgtccatggccaacatcttccggggctcttatctcgctggggccggactggccttcagcctgatgaaatccctcggcgggggacgcagaggcaccggggctcagggagaaacgcttggcgagaagtggaaacggcagctgaatcagctgagcaagtccgaatttaacacatacaagagatctggcatcatggaggttgaccgcagcgaagccaaagaggggctcaagcggggagagaccaccaaacacgcggtctccagaggcacagccaagctgcgctggttcgtggaacggaatcttgtgaaacctgaggggaaggtcattgatctgggatgtggcagagggggatggtcttattactgcgctggcctcaagaaagttaccgaagtgaagggctatacaaaagggggacccggccatgaggaacctatccccatggccacgtacgggtggaacctggtgaagctgcacagcggaaaagacgcctttttcattcctccggagaagtgtgataccctcctttgcgacatcggcgagtcctctcccaatcctacaattgaagaggggcgcaccctgcgggtcctgaaaatggtggaaccctggctcagaggaaaccaattttgtatcaagattctgaatccttacatgcccagcgttgtggagacacttgagcagatgcagcgcaagcatggcggcatgctggtccggaacccgctctccagaaatagcacccacgaaatgtattgggtgtcttgcgggacgggaaacatcgtttccgccatcaatatgaccagccgcatgctgctgaaccggttcacaatggcgcacagaaaacctacctacgagcgcgatgtggacctcggcgccgggacaagacatgtcgctgtggaacccgaggtggccaacctggatattatcggacagcggattgaaaatatcaagcacgagcataaatctacctggcactatgacgaggataacccctacaagacatgggcttatcatggctcctacgaagtcaaacctagcgggtctgcctccagcatggttaatggagtggtgaaacttctgaccaagccctgggacgtcattcctatggtgacgcaaatcgctatgacagataccaccccgtttggccagcagcgcgttttcaaagagaaggtggacacaagaacgcccaaagccaagcggggcaccgcgcaaatcatggaagtcacagccaaatggctctgggggtttctgtccagaaacaagaagcctcggatttgtacccgcgaggagttcacaagaaaagtgcggagcaatgctgccatcggagctgtttttgtggacgagaaccagtggaactctgccaaggaggccgtcgaagatgagcgcttctgggaccttgtgcacagagaacgggagctgcacaaacagggcaagtgcgcgacctgcgtttataacatgatggggaaacgcgaaaagaagctcggagagtttggcaaagctaaggggagcagagccatttggtacatgtggctgggcgcccggttcctggagttcgaagctctcggatttatgaatgaggatcattggttctcccgcgaaaactctctgagcggcgtggagggggagggacttcacagactgggctacatcctccgggacatttccaaaatccccgggggaaatatgtatgccgatgacacagctggctgggatacccgcatcacggaagacgatctgcagaacgaggccagaattaccgacatcatggaacctgagcatgcgcttctggccaagtctatttttaaactcacataccaaaataaggtcgtgcgggtccagcgccccgggaaaaacggcaccgtgatggatgttatcagcagacgggaccagagaggatccggccaggtggggacatatggactgaataccttcacgaacatggaagctcaactgattcgccagatggagtctgagggcatctttagcccgtccgaactcgagacacctaacctggccgaacgggtccttgattggctggagaagtacggggtggaaagactcaagcgcatggctatcagcggagacgactgtgtggttaaacccattgatgaccggttcgccaccgcgctgacagcccttaatgatatgggcaaggtgagaaaagacatccctcagtgggagccctctaaggggtggaacgattggcagcaagtccctttttgctcccaccacttccatcagctgattatgaaagacggccgcgagatcgtggttccctgtcggaatcaggatgaactcgtgggcagagctcgcgtcagccagggcgccgggtggtctctgcgggagaccgcttgcctgggaaagtcctatgcccaaatgtggcagctcatgtactttcacagacgcgacctgcggcttgctgccaacgcgatttgtagcgccgtgccggtcgattggatccctacgtccagaaccacatggtctattcatgctcaccatcagtggatgaccacagaagacatgctgagcgtgtggaatcgggtttggatcgaggaaaacccctggatggaggataagacccacatctccagctggggcgacgtgccctatctcgggaaaagagaggaccaatggtgcggatctctgattggccttacagcccgcgccacctgggctacgaatatccaggtcgccattaaccaggtgcggagactgatcgggaatgaaaactacctcgattacatgacatccatgaagcgcttcaaaaatgagagcgaccctgaaggcgcgctgtggtga

SEQ ID NO: 19154 - RNA, 9879 nt, synthetic construct
  misc_feature 1..9879: note = derived and/or modified CDS sequence (opt5) from DENV-1__GU131703__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacaacccccggcacattcaagacgccggaaggggaggtgggagcgattgctctcgattttaagcctggcaccagcgggtctcccatcgtgaaccgcgaaggaaaaatcgtcggcctgtatggcaatggggtggttacaacctccggaacctacgtgagcgccattgcccaggctaaggcctcccaggagggccctcttcccgagatcgaagacgaggtcttccggaaaagaaacctgacaattatggatctgcaccccgggtctggaaagacgcgccggtatctccctgcgatcgtgagagaagctattaaacgcaagctgcggacccttatcctggccccgacaagagttgtggccagcgagatggctgaagccctcaagggcatgcccatccgctaccaaaccacagctgtcaaatccgagcataccgggaaggagattgtggacctgatgtgccacgccacgtttacaatgcggctgctcagccctgttagagtgcccaattataacatgatcattatggatgaagcgcatttcaccgacccttcttccatcgccgctcggggctacattagcacccgcgtcggaatgggcgaggccgctgccatctttatgacagccacaccccctgggtctgtggaggctttcccgcagagcaatgcggtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacgtttgatacagaataccagaaaaccaagaacaacgactgggactacgtggtcacaaccgatatcagcgagatgggcgctaatttcagagccgaccgcgtgattgatcctcggagatgcctgaaacccgttatcctcaaggacgggccggaacgcgtgatcctggccggccctatgcccgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacctgagggcatcattcccgccctgttcgaacctgagagagaaaagagcgctgccatcgatggggagtatcgcctgagaggagaggcgcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagctcaaaatgcccttgacaacctggttatgctgcataattccgaacagggcgggcgggcgtatcgccacgccatggaggagctccctgataccattgaaacgctgatgcttctggctctcatcgccgtgctgacaggaggcgtgaccctgttctttctctctggcagagggcttggaaagaccagcattggcctgctgtgtgtcatggcttccagcgttctcctgtggatggcctctgtggagccccattggatcgccgcttccatcattcttgagttctttctgatggtgctcctgatcccggagcctgaccggcagcgcacaccccaggataaccaactggcgtacgtcgtgattgggctccttttcatgatcctgaccgttgccgctaatgagatgggactgctcgaaacaacgaagaaagacctgggcattgggcacgtggccgtcggaaaccaccatcacgccgctatgcttgatgtggacctgcatcctgccagcgcgtggaccctctacgccgtcgctacaaccatcattacacccatgatgagacacaccatcgagaacacgaccgccaatatctctctgacagctattgccaaccaggcggccatcctgatgggcctcgataagggctggcctatttccaaaatggacatcggggtgccccttctggctctgggatgctatagccaggttaatccgctcaccctgacagccgctgtgcttatgctggtcgcccattacgctattatcggccctgggctccaagccaaggcgacccgggaagcccagaaacgcacggctgccggaatcatgaagaaccccacagtggatggcattgttgctatcgacctggatcccgtggtctatgacgccaagtttgagaaacagctggggcagattatgctccttatcctgtgtacctctcaaattctgctcatgagaacaacctgggccctgtgcgaaagcatcacccttgcgacaggacctctgacgaccctctgggagggctccccgggcaagttctggaatacaaccatcgctgtgtctatggccaacatttttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggatcatggaagtggaccgctccgaggccaaagaaggactgaagcggggcgagacaaccaaacacgcggtttctagagggaccgccaaacttcgctggtttgtcgagcggaatctggtgaaacccgaaggaaaggtgattgatctcggctgtgggagaggaggctggagctactattgcgctggcctgaagaaagtcacagaggttaaggggtacaccaaaggaggccctgggcacgaagaacccatccctatggccacatacggatggaacctggtgaagctccattccggcaaagacgtgttctttattccccctgaaaagtgtgatacgcttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgctgtgaatatgacgtctcgcatgctgctcaaccggtttaccatggcccacagaaaaccgacatatgaacgcgatgtcgacctgggggcgggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacggatacaacccctttcggccagcagcgcgtgtttaaagaaaaggtcgacaccagaacaccgaaagctaagcgggggacggcccaaattatggaggtgaccgcgaaatggctgtggggattccttagcagaaacaagaagccccggatctgtacacgcgaagagtttaccagaaaagttcggtctaatgccgctattggcgccgtgttcgtcgacgaaaaccagtggaatagcgctaaggaggccgtggaggatgaacgcttttgggacctggttcatagagagcgggaactccacaaacaggggaagtgcgccacatgcgtgtacaacatgatgggaaaacgcgagaagaagctgggcgagttcgggaaagcgaagggctccagagctatctggtacatgtggctgggagcccggtttctcgagttcgaggccctgggcttcatgaatgaagatcactggttttctcgcgagaacagcctttccggggtcgaaggagagggcctgcataaactcgggtatattctgagagacatctctaagatccctggaggcaatatgtacgctgatgacaccgccgggtgggatacacggattaccgaggacgatcttcagaacgaagctcgcatcacggacattatggagcccgaacacgccctgctcgcgaaaagcatcttcaagctgacctatcaaaataaagtggtcagagtgcagcggcctgccaagaacggcacagttatggatgtgatttcccgcagagaccagcggggatctggccaggtcgggacctacggactgaatacatttaccaacatggaggctcaactcatcagacagatggaaagcgagggcatcttctcccccagcgagctggaaacgccgaaccttgccgagcgcgtgctggattggctcgaaaagtatggggtggagcggctgaaaagaatggctatttctggagacgactgtgttgtgaagcctatcgatgaccgctttgccacagcgcttaccgccctgaatgatatgggcaaagtccggaaggacattccccagtgggaaccttccaaagggtggaacgattggcagcaagtgcccttctgcagccatcactttcaccagctcatcatgaaggacggcagagagattgttgtgccttgtcgcaatcaggatgagctggtcggacgggctagagtgtctcagggcgccgggtggtccctgcgcgaaacagcttgcctcggaaagagctacgcccaaatgtggcagctgatgtatttccatcggagagaccttcgcctggctgccaacgcgatctgttccgccgtccccgtggattggattccgacctctcggacgacctggagcatccacgctcatcaccagtggatgacaaccgaggacatgctctccgtttggaatagagtgtggatcgaagagaacccttggatggaagataaaacacatattagctcttggggcgacgtcccctacctggggaagcgggaggaccaatggtgcggatcccttatcggcctgaccgccagagccacatgggctaccaatattcaggtggccatcaaccaggttcgccggctcattgggaatgagaactacctggattatatgacgagcatgaaaagatttaagaatgaatctgaccccgagggcgcgctgtggtga

SEQ ID NO: 19155 - RNA, 9879 nt, synthetic construct
  misc_feature 1..9879: note = derived and/or modified CDS sequence (opt5) from DENV-1__GU131706__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttatcgcgatggacctgggggagctctgtgaagataccatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcagaaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattcagaggggaagacggatgctggtatggcatggagattcggccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggatgacctaccttgctctgatggccacattcaaaatgcggcctatgtttgcggtcggactcctgttccgcagactcacgagccgggaggtgctgcttctgaccatcggcctctccctggtggcttctgtcgaactgcccaacagccttgaggaactgggggatggactcgccatgggcatcatgattctgaagctcctgacagactttcaatcccatcagctttgggccaccctgctcagcctgacattcatcaaaaccacgttttctctgcactatgcttggaagacaatggccatggttctttccattgtgagcctgttccccctctgtctgtctaccacctcccagaaaacaacctggctccctgtgctgcttgggagcctgggatgcaagccgctgacaatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgttacgtgatcagcggatctagcgccgacctgtccctggagaaggctgccgaggtctcttgggaagaggaagccgagcatagcggcgcttcccacaatattctcgtggaagttcaggatgacgggacgatgaaaatcaaggatgaggagcgggacgataccctgacaatccttctgaaagcgaccctcctggccgtgtctggagtctatcctctcagcattcccgctacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagccgtcctgatgtaccagggcaagagacttgagccttcctgggctagcgtgaaaaaggacctgatctcttacgggggaggctggcgcctccagggctcctggaatacaggggaggaagtgcaggttattgccgtcgagcccggcaagaaccctaagaatgtgcaaaccgcgcccggcacatttaaaaccccggaaggggaggtgggagctatcgccctggatttcaagcctggcacaagcgggtctcccattgtcaaccgggaaggaaagatcgtgggcctctatggcaatggggttgtgacgacctccggaacatacgtcagcgccatcgctcaggccaaagcgtcccaggagggccctctgcccgagattgaagacgaggtgtttagaaagcgcaaccttaccatcatggatctgcaccccgggtctggaaaaacccggagatatctgcctgctattgttcgcgaagccatcaagcggaaactcagaacactgattcttgccccgacgcgcgtggtcgctagcgagatggccgaagctctgaagggcatgcccatccggtaccaaaccacagccgtgaagtccgagcataccgggaaagagatcgttgacctcatgtgccacgcgacattcaccatgagactgctgagccctgtgcgggtccccaattataacatgattatcatggatgaagcccattttacggacccttcttccattgctgcccgcggctacatcagcacaagagtgggaatgggcgaggctgccgccattttcatgaccgctacaccccctgggtctgtggaagcgtttccgcagagcaatgccgtcatccaggatgaggaacgggacatccccgagcgctcctggaactctggatatgagtggattacagatttccctggcaagaccgtttggtttgtgcccagcatcaaatccgggaatgacattgctaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgccgaccgggttatcgatcctagacgctgcctgaagcccgtgattctgaaagacgggccggaacgggtcatcctcgctggccctatgcccgtgacagttgcctccgcggctcagagacgcggacggatcggcagaaaccacaataaggagggggatcagtatatttacatgggacagcccctgaacaatgacgaggatcatgcccactggaccgaagccaaaatgcttctggacaacatcaatacgcctgagggcattatccccgctctctttgaacctgagcgcgaaaagagcgccgcgattgatggggagtatagactgcggggagaggcccgcaagaccttcgtggaactgatgagacggggcgacctcccggtctggctttcttacaaagtggcttccgaggggtttcaatatagcgatcgcagatggtgcttcgacggcgaacggaacaatcaggtcctggaggaaaacatggatgtggagatctggacaaaggagggagaacgcaagaagctgcgcccccggtggctcgacgccagaacctactccgaccctctggctcttagagagtttaaagagttcgccgctggccggagatctgttagcggggatctgatcctcgagattggaaagctgccccagcacctgacacagcgggcccaaaatgcgctcgacaaccttgtgatgctgcataattccgaacagggcgggcgcgcctatagacacgctatggaggagctgcctgataccatcgaaacactcatgctgcttgccctgattgctgtgctcaccggaggcgtcacgctgtttttcctgtctggccgggggctcggaaaaacaagcatcggccttctgtgtgttatggcctccagcgtgctgctctggatggcctctgtggagccccattggattgctgcgtccatcatcctggaatttttccttatggtcctgctcattccggagcctgaccgccagagaacaccccaggataaccaactggcctacgtggttatcgggctgctctttatgattcttaccgtggctgccaatgagatgggactgctggaaacaaccaagaaggacctcggcatcgggcacgtcgccgtggagaaccaccatcacgctgccatgctggatgtcgaccttcatcctgcgagcgcctggacactgtacgctgtggccacgaccattatcacacccatgatgcggcacaccattgaaaacacaaccgctaatatctctctcacggccatcgcgaaccaggccgctattctgatgggactggataaaggctggcctatctccaagatggacattggcgttcccctccttgccctggggtgctatagccaggtgaatccgctgaccctcacagctgccgtcctgatgcttgtggctcattacgccatcattggacctggcctgcaagcgaaagccacccgcgaggctcagaagagaacagccgctgggatcatgaaaaaccccaccgttgatggaatcgtggccattgacctcgatcccgtcgtgtatgacgccaagttcgaaaagcagctgggccagatcatgctgctcattctttgtacgtctcaaatcctgctgatgcggacaacctgggcgctctgcgagagcattacactggctaccgggcctcttaccacactgtgggagggatccccgggcaaattttggaatacgaccatcgccgtgtctatggctaacatcttccgcggcagctacctcgccggggccggactggctttctccctgatgaaaagcctcggcgggggaagacggggcacaggggcccagggagaaacccttggcgagaaatggaagagacagctgaatcagctgtccaaatctgaatttaacacatataagcgcagcggcattatggaggttgaccggtccgaagcgaaggaggggctcaaaagaggagagaccacgaagcacgccgtctctcgcggcacagctaaactgcggtggttcgtggaaagaaatcttgtgaagcccgaggggaaagtcatcgatctgggatgtggccgcgggggatggagctactattgcgccggcctcaagaaggttaccgaagtgaaaggctacaccaaaggcgggcctgggcacgaggaacccattcctatggctacatacgggtggaacctggtgaaactgcattccggaaaggacgtctttttcattccccctgagaaatgtgataccctcctttgcgacattggcgagtctagcccgaatcccacaatcgaagaggggcggacgctgagagtgctgaagatggttgaaccttggctccgcggaaaccaattttgtattaaaatcctgaatccctatatgccttccgtggtcgagacccttgagcagatgcagcggaagcacggcggcatgctggtgagaaaccccctcagccgcaattctacacatgaaatgtactgggtttcctgcgggaccggaaacatcgtgagcgccgtcaatatgacatctcggatgctgctgaacagattcaccatggcgcaccgcaagccgacgtatgagagagatgtggacctcggcgccgggacccggcacgtggctgtcgaacctgaggttgccaacctggatattatcggacagcgcattgaaaatatcaaacatgagcacaagtccacatggcattacgacgaggataacccctataaaacctgggcttaccacggcagctatgaagtgaagccctctgggtccgccagctccatggtgaatggagtcgtgaaacttctgacaaagccttgggacgttattcccatggtgacccaaatcgctatgacagataccacgccttttggccagcagagagtcttcaaggagaaagtggacacacggaccccgaaggccaaaagaggcaccgcgcaaatcatggaagttacagccaagtggctctgggggtttctgagccggaacaaaaagccccgcatttgtacgagagaggagttcacccggaaggtgcgctctaatgctgccatcggagctgtctttgtggacgagaaccagtggaatagcgccaaagaggccgttgaagatgagagattctgggaccttgtgcatcgggaacgcgagctgcacaagcagggcaaatgcgcgacatgcgtctacaacatgatggggaagagagagaaaaagctcggagagtttggcaaggctaaagggtcccgggccatttggtacatgtggctgggcgcccgcttcctggagttcgaagctctcggatttatgaatgaggatcactggttctctagagaaaacagcctgtccggcgtggagggggagggacttcataagctgggctatatcctccgggacatttctaaaatccctgggggaaatatgtacgccgatgacaccgctggctgggatacacgcatcaccgaagacgatctgcagaacgaggccagaattacagacatcatggaacccgagcacgcgcttctggccaagagcatttttaaactcacctatcaaaataaggtcgtgcgggttcagcgccctgctaaaaacgggacggtgatggatgtcatctccagacgggaccagagaggctctggacaggtgggcacctacgggctgaatacattcaccaacatggaagcccaactgattcgccagatggagagcgagggaatcttttcccccagcgaactcgagacaccgaacctggctgaacgggtgcttgattggctggagaagtatggcgttgaaagactcaagcgcatggccatctctggggacgactgtgtggtcaaacctattgatgaccggttcgcgaccgccctgacggctcttaatgatatgggaaaggtgagaaaagacatcccccagtgggagccttccaagggctggaacgattggcagcaagttcccttttgcagccatcacttccaccagctgattatgaaagacgggcgcgagatcgtggtcccttgtcggaatcaggatgaactcgtgggcagagcccgcgtctctcagggagctggctggtccctgcgggagacagcctgcctgggaaagagctacgctcaaatgtggcagctcatgtattttcatagacgcgacctgcggcttgccgcgaacgccatttgttccgctgtgcccgttgattggatcccgacctctagaacaacctggagcattcacgcccatcaccagtggatgacgaccgaagacatgctgtccgtgtggaatcgggtctggatcgaggaaaacccttggatggaggataagacacatatcagctcttggggagacgtgccctacctcggcaaaagagaggaccaatggtgcgggtccctgattggacttaccgcccgcgctacatgggccaccaatatccaggttgcgattaaccaggtgcggagactgatcggcaatgaaaactacctcgattatatgacaagcatgaagcgcttcaaaaatgagtctgaccccgaaggggctctgtggtga

SEQ ID NO: 19156 - RNA, 9879 nt, synthetic construct
  misc_feature 1..9879: note = derived and/or modified CDS sequence (opt5) from DENV-1__GU131708__SS-prME
  source 1..9879: mol_type = other RNA
agcgtgaccatgctgctcatgctgatgcccacagcccttgctttccacctgacgaccagaggaggggagcctcatatggtcgtttccaagcaggaacggggaaagtctctcctgtttaagaccagcgccggcgtgaatatgtgcacccttatcgcgatggacctgggggagctctgtgaagatacaatgacctacaaatgcccgcgcattacagaggctgaacccgacgatgtggactgttggtgcaatgccaccgatacgtgggtcacctatggaacatgttcccaaaccggcgagcacagacgggacaagcgctctgtggccctggctcctcatgttgggctgggactcgagacaagaaccgaaacgtggatgagctccgagggcgcctggaaacagatccagcgggtggaaacatgggctctgcgccaccccggcttcaccgtcattgccctttttctggcgcatgccatcgggacatctattacccagaagggaatcatcttcattctcctgatgcttgtgacccctagcatggctatgagatgcgttggcatcgggtcccgggattttgtggagggactgagcggcgccacatgggtcgacgtggtgctcgagcacgggtcttgtgtcacgaccatggctaaggataaacccacactggacattgaactgctcaagaccgaggttacaaaccctgccatcctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacatcttccttcaaactcgagaaggaagtcgccgagacccagcacggcaccgtgctggttcagattaagtacgagggaacagacgcgccgtgcaaaatccctttcagcacccaagatgaaaagggcgtgacacagaacgggcggctgatcacggctaatcccattgtcaccgacaaagagaagcctgtgaacatcgaagccgagccgccctttggagagtcttatattgtgatcggcgccggggaaaaagctcttaagctcagctggttcaagaaaggatcctctattggcaagatgtttgaggccacagctagaggggcccgccggatggcgatcctgggcgataccgcctgggacttcggaagcatcggcggggtttttacatccgtcggaaaactggtgcatcagattttcggcaccgcttacggggtgctctttagcggagtctcttggacgatgaagatcggcctgggggtgcttctgacctggctcggcctcaattccagaagcacatctctgtccatgacctgtattgccgttggacttgtgacactctacctgggcgtcatggtgcaggctgatagcgggtgcgttatcaactggaaaggacgcgaactgaagtgtggctccgggattttcgtgaccaatgaggtccacacatggaccgaacaatataagtttcaggccgactctcctaaacggctcagcgcggccatcggaaaggcttgggaggagggcgtgtgcgggattagatccgccacgcgcctggaaaacgttatgtggaaacagatctctaacgagcttaatcatatcctgctcgaaaacgacatgaagttcacagtggtcgtgggcgatgtggctggcattctggcccagggcaaaaagatgatccggccgcaacccatggagtacaaatatagctggaagtcctgggggaaggccaaaattatgggagctgacgtccagaataccacctttatcattgatggccctaacacacccgaatgtcctgacgatcagagagcgtggaatatctgggaggttgaggactacgggttcggaatctttaccacgaacatttggctgaaacttcgcgatagctatacacaggtgtgcgaccaccggctcatgtctgccgctatcaaagattccaaggccgtgcacgccgacatgggctactggattgaaagcgagaaaaatgaaacctggaagctggctagagcctctttcatcgaggtcaagacatgtatttggcccaaatcccataccctgtggagcaacggcgtgctcgaatctgagatgatcatcccgaagatttatgggggacctatcagccaacacaattaccgccccggctacttcacacagaccgcggggccttggcatctgggaaaacttgagctggattttgacctctgcgaaggcacgaccgttgtggtcgatgagcactgcgggaaccggggaccctccctgagaacaaccacagtgaccggcaagattatccacgaatggtgttgccggagctgtacgctgcctccccttcgcttcagaggcgaggacgggtgctggtatggaatggagattcggccggttaaagaaaaggaggaaaatctcgtgaagtctatggtctccgctggcagcggggaggtggactccttttctctgggactgctctgtatcagcatcatgattgaagaggttatgagatcccgctggtctcggaaaatgctgatgacaggcacccttgccgtgttcctgctcctgatcatggggcagctgacatggaacgatcttattagactgtgcatcatggtcggagccaatgctagcgaccgcatgggcatgggcaccacctacctcgccctgatggcgacatttaagatgagacctatgttcgctgtggggctcctgtttcggcgccttacgtccagagaggtgctgctcctgaccattggactgtctcttgtcgccagcgttgaactgcccaactccctcgaggaactgggcgatgggctcgccatgggaatcatgattctgaaacttctgacagacttccaaagccatcagctctgggctaccctgctgtctcttacatttatcaagaccacgttctccctgcactatgcctggaaaacaatggctatggtgctcagcatcgtgtctctgtttcccctctgtctgtccaccaccagccagaagacaacctggcttcctgtcctgctgggctctctcgggtgcaagccgctgacaatgttccttattgccgagaataaaatctggggacggcgctcctggcccctgaacgaaggcattatggcggtgggcatcgttagcattctcctgtccagcctcctgaagaacgatgtgcctcttgccgggcccctgatcgctggaggcatgctgatcgcctgttacgtcatttctgggagctccgctgacctctctctggagaaagccgccgaggtgagctgggaagaggaagctgagcattccggagcgtctcacaatatccttgttgaagtgcaggatgacggcacgatgaagattaaagatgaggagagagacgataccctgacaatcctcctgaaggccaccctcctggctgtcagcggggtgtatcctctttccattcccgccacactgtttgtctggtacttctggcagaagaagaagcagcggtctggagtgctgtgggacacccctagccctcccgaagttgagcgcgccgtgctcgatgacggcatctatagaatcatgcagcggggcctgcttgggcgctcccaggtcggagtgggcgttttccaagaaaacgtgtttcatacgatgtggcacgtcaccagaggggctgtgctgatgtaccagggaaaacggctcgagcccagctgggcctctgtgaagaaagacctgatttcctacggcgggggatggagactccagggcagctggaatacaggcgaggaagttcaggtcatcgcggtggagcccgggaagaaccctaaaaatgtgcaaaccgctcccggaacattcaagaccccggaaggcgaggtcggggccattgccctggattttaagcctggaacatctggctcccccatcgtgaaccgcgaagggaaaattgttggactttatggcaatggcgtggtcacgaccagcgggacatacgtgtccgctatcgcccaggcgaaggcttctcaggagggacctctgcccgagattgaagacgaggttttccggaaaagaaacctgaccatcatggatctccaccccggcagcgggaagacccgccggtatctgcctgccatcgtgagagaagccattaaacgcaaacttcggacactgatcctcgctccgacgagagtcgtggcctccgagatggctgaagccctgaagggaatgcccattcgctaccaaaccacagcggttaaaagcgagcataccggcaaggagatcgtggacctgatgtgccacgccacatttaccatgcggctcctttctcctgtcagagtgcccaattataacatgattatcatggatgaagctcatttcacggacccttccagcatcgccgctcgggggtacatttctacacgcgtgggcatgggagaggccgccgctatctttatgaccgcgacaccccctggcagcgtcgaagccttcccgcagtccaatgctgttattcaggatgaggaaagagacatccccgagcggtcttggaacagcgggtatgagtggattacagattttcctggaaaaaccgtgtggttcgtgccctccatcaagtctggcaatgacatcgccaactgtctgcgcaaaaatgggaagagagtcattcagctgagccggaagacatttgataccgaataccagaagacgaagaacaacgactgggactacgtggttacaaccgatatctccgagatgggagccaatttcagagctgaccgcgtgattgatcctcggagatgcctcaaacccgtcatcctgaaggacggcccggaacgcgtgattcttgccgggcctatgcccgttacagtggcgagcgctgcccagcggagaggccgcatcggacggaaccacaataaagagggcgatcagtatatttacatggggcagcccctgaacaatgacgaggatcatgcccactggaccgaagctaagatgctcctggacaacatcaatacgcctgagggaatcattcccgccctgttcgaacctgagagagaaaagtctgcggccatcgatggcgagtatcgcctcagaggggaggctcggaaaacctttgtcgaacttatgcgcagaggagacctgccggtgtggctgtcctacaaggtcgccagcgagggcttccaatattccgatcggcgctggtgctttgacggggaaagaaacaatcaggtgctcgaggaaaacatggatgttgagatttggacaaaagagggcgaacggaagaaactgagaccccgctggcttgacgctcggacctactctgaccctctggccctcagagagttcaaggaatttgctgccggacgccggagcgtgtccggcgatctgatcctggagattgggaaactcccccagcaccttacacagagagcgcaaaatgccctggacaacctggtgatgctccataattctgaacagggaggccgggcttatcgccacgccatggaggagctgcctgataccatcgaaacacttatgctgctcgctctgatcgccgtcctgaccgggggagttacgctgttctttcttagcggcagaggcctggggaagacatccattggactgctctgtgtgatggccagctctgtgctgctttggatggcttccgtcgagccccattggatcgcggccagcattatcctggagttctttctcatggtgctgctgattccggagcctgaccggcagcgcacaccccaagataaccaactcgcttacgttgtgatcggccttctgttcatgatcctgaccgtcgccgccaatgagatggggctcctggaaaccaccaagaaagaccttggaattggccacgctgccgtggggaaccaccatcacgcggccatgctggatgtcgacctccatcctgcttctgcctggacactgtacgctgtggccacgaccatcattacacccatgatgagacacaccatcgagaacacaaccgcgaatatttccctgacggccatcgctaaccaggccgctattctcatgggacttgataagggctggcctatcagcaaaatggacatcggcgttcccctgctggccctcgggtgctattctcaggtgaatccgctgacccttacagctgccgtcctgatgctcgtggcgcattacgccattatcggacctggcctgcaagctaaggccacccgggaagctcagaaacgcacagccgccgggattatgaagaaccccaccgttgatggaatcgtggcgattgacctggatcccgtcgtgtatgacgctaagtttgagaaacagctcggccagatcatgcttctgatcctgtgtacgagccaaattctcctgatgagaacaacctgggccctttgcgaatccatcacactggctaccgggcctctcaccacactgtgggagggatctccgggcaagttctggaatacgaccattgccgtgagcatggccaacatctttcggggctcctacctggctggggccggactcgcgttcagccttatgaaatccctgggcgggggacgcagaggcacaggggcccagggagagaccctgggcgaaaagtggaaacggcagctcaatcagctgtctaagagcgagttcaacacatataagagatccggcattatggaagttgaccgctctgaggctaaagaagggcttaagcggggagagaccacgaaacacgccgtcagcagaggcacagctaagctgcgctggtttgtggagcggaatctcgtgaaacccgaagggaaggtcatcgatctgggatgtggcagagggggatggtcctactattgcgccggcctgaagaaagttaccgaggtgaagggctacaccaaagggggacctggccacgaagaacccatccctatggcgacatacgggtggaacctcgtgaaacttcattctggaaaagacgtcttctttattccccctgaaaagtgtgataccctgctgtgcgacatcggcgagagctccccgaatcccacaattgaggaagggcgcacgctccgggtgctgaaaatggttgagccttggcttagaggaaaccaattctgtatcaagattctgaatccctatatgcctagcgtggtcgaaaccctcgagcagatgcagcgcaagcacggcggcatgctggtgcggaaccccctgtctagaaattccacacatgagatgtactgggttagctgcgggaccggaaacatcgtgtctgccgtcaatatgacatcccgcatgctcctgaaccggtttaccatggctcacagaaaaccgacgtatgaacgcgatgtggaccttggcgccgggaccagacacgtggctgtcgagcctgaagttgccaacctggatattatcggacagcggatcgagaatattaagcatgaacacaaaagcacatggcattacgacgaggataacccctataagacctgggcttaccacggctcttatgaggtgaaaccctccgggagcgcctccagcatggtgaatggagtcgtgaagctcctgacaaagccttgggacgttatccccatggtgacccaaattgcgatgacagataccacgcctttcggccagcagcgcgtctttaaagaaaaggtggacacaagaaccccgaaagccaagcggggcaccgctcaaatcatggaggttacagccaaatggctttgggggttcctgtctagaaacaagaagccccggatttgtacgcgcgaagagtttaccagaaaagtgcggagcaatgctgccatcggagccgtcttcgtggacgaaaaccagtggaactccgcgaaggaggctgttgaggatgaacgcttttgggacctcgtgcatagagagcgggaactgcacaaacagggcaagtgcgccacatgcgtctacaacatgatggggaaacgcgagaagaagctgggagagttcggcaaagccaaggggtctagagctatctggtacatgtggctcggcgcccggtttctggagttcgaggctcttggattcatgaatgaagatcactggtttagccgcgagaactccctgtctggcgtggaaggggagggactccataaactgggctatattcttagagacatcagcaagattcctgggggaaatatgtacgccgatgacaccgcgggctgggatacacggatcaccgaggacgatctgcagaacgaagcccgcattacagacatcatggagcccgaacacgctctcctggccaaatccatcttcaagctgacctatcaaaataaagtcgtgagagttcagcggcctgctaagaacgggacggtgatggatgtcatttctcgcagagaccagcggggcagcggacaggtgggcacctacgggctcaatacatttaccaacatggaggcccaactgatcagacagatggaatccgagggaattttcagcccctctgagcttgaaacaccgaacctggcggagcgcgtgctcgattggctggaaaagtatggcgttgagcggcttaaaagaatggccatctccggggacgactgtgtggtcaagcctattgatgaccgctttgctaccgccctgacggctctcaatgatatgggaaaagtgcggaaggacatcccccagtgggaacctagcaaaggctggaacgattggcagcaagttcccttctgctctcatcactttcaccagctgatcatgaaggacgggagagagattgtggtcccttgtcgcaatcaggatgagctggtgggccgggccagagtctcccagggagctggctggagcctccgcgaaacagcctgcctggggaagtcctacgcgcaaatgtggcagcttatgtatttccatcggagagacctgcgcctcgccgctaacgccatctgttctgccgtgcccgttgattggattccgaccagccggacaacctggtccatccacgctcatcaccagtggatgacgaccgaggacatgctgagcgtgtggaatagagtctggattgaagagaacccttggatggaagataaaacacatatctcttcctggggagacgtgccctaccttggcaagcgggaggaccaatggtgcgggagcctgattggactcaccgccagagcgacatgggctaccaatatccaggttgccatcaaccaggtgcgccggctgattggcaatgagaactacctggattatatgacatctatgaaaagatttaagaatgaaagcgaccccgagggggccctctggtga

SEQ ID NO: 19157 - RNA, 9879 nt, synthetic construct
  misc_feature 1..9879: note = derived and/or modified CDS sequence (opt5) from DENV-1__GU131710__SS-prME
  source 1..9879: mol_type = other RNA
agcgtgaccatgctgctcatgctgatgcccaccgctcttgctttccacctgacgacccggggcggggaacctcatatgatcgcttccaagcaggaacggggaaaatctctcctgtttaagaccagcgcgggcgtcaacatgtgcacccttattgctatggacctgggggaactctgtgaagataccatgacctacaaatgcccccgcatcacagaaaccgaacccgacgatgttgactgttggtgcaatgccacggatacctgggtgacatatggaacctgttcccaaacaggcgagcaccggcgggacaagcgctctgtggccctggctcctcatgtcgggctgggactcgagaccagaacggaaacatggatgagctccgagggcgcctggaaacagattcagcgggtggaaacctgggctctgcgccaccccggcttcacagttatcgccctttttctggcgcatgccattgggacctctatcacccagaagggaatcattttcatcctcctgatgcttgtgacacctagcatggctatgagatgcgtcggcattgggtcccgggattttgtggagggactgagcggcgccacgtgggttgacgtggtcctcgagcacgggtcttgtgtgaccacaatggctaaggataaacccaccctggacatcgaactgctcaagacagaggtgaccaaccctgccgtcctgcgcaaactttgcattgaagcgaagatctccaatacgacaaccgatagcagatgtccgacccaaggagaggccacactggttgaagaacaggacgctaacttcgtgtgccggcgcacctttgtggatagaggctggggcaatgggtgtggactcttcggcaaagggtctctgattacatgcgccaagtttaagtgcgtcacgaaacttgagggaaagatcgtgcagtacgaaaacctgaaatattccgttatcgtgaccgtccacacaggcgaccagcatcaagtggggaatgagagcaccgaacacggaacaaccgctacgattacaccccaggcccctacaaccgagatccagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcttccacatctcaagagacctggaatcgccaggacctgctcgtcaccttcaaaacagcgcacgccaagaagcaggaagtggtcgtgctgggaagccaagagggcgctatgcacacggccctgaccggggccacagaaattcagacctccggaacaaccacgatctttgctggccatctcaaatgcagactgaagatggataaacttacactgaaggggatgagctatgttatgtgtaccggctctttcaaactcgagaaggaagtggccgagacccagcacggaacagtcctggtgcagattaagtacgagggcaccgacgcgccgtgcaaaatccctttctccacacaagatgaaaagggggttacgcagaacggacggctgatcaccgctaatcccattgtgacagacaaagagaagcctgtcaacatcgaagccgagccgccctttggcgagagctatattgtgatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtgtttaccagcgttggcaaactggtccatcagattttcgggacggcttacggagtgctcttttccggcgtgagctggaccatgaagatcgggattggcgtcctgcttacatggctgggactcaattctagatccaccagcctgtctatgacatgtatcgccgtgggcctgattaccctttacctcggggttatggtgcaggctgattccggatgcgtcatcaactggaaaggccgcgaactgaagtgtgggagcggaattttcgtgacaaatgaggttcacacctggacggaacaatataagtttcaggccgactcccctaaacggctgtctgcggccatcggcaaggcttgggaggagggggtgtgcggcatcagaagcgccacacgcctcgaaaacattatgtggaaacagatctccaacgagctgaatcatattcttctggaaaacgacatgaagttcaccgtcgtggttggagatgtggctggcatcctcgcccaggggaaaaagatgattcggccgcaacccatggagtacaaatattcttggaaaagctggggaaaggccaagatcatcggcgctgacgtccagaataccacatttattatcgatgggcctaacacccccgaatgtcctgacgatcagagagcgtggaatatttgggaggtggaggactacggattcggcatctttacgacaaacatttggctgaagctgcgcgattcctatacccaggtgtgcgaccaccggcttatgagcgccgctatcaaagattctaaggccgtccacgccgacatgggctactggatcgaatccgagaaaaatgaaacatggaagctcgctagagccagcttcattgaggttaagacctgtatctggcccaaatctcatacactgtggtccaacggggtgctggaaagcgagatgattatcccgaagatttatggaggccctatctctcaacacaattaccgccccgggtacttcacccaggcggctggaccttggcatctcggcaaactggagcttgattttgacctgtgcgaagggacgaccgtggtcgtggatgagcactgcggaaaccggggccccagcctcagaacaaccacagttaccggcaagatcattcacgaatggtgttgccggtcctgtacgctgcctcccctgcgcttcagaggggaggacggatgctggtatggcatggagatccggccggtgaaagaaaaggaggaaaatcttgtcaagagcatggtgtctgccgggtccggagaggttgacagcttttccctcggcctgctgtgtatttctatcatgattgaagaggtgatgagaagccgctggtcccggagaatgctcatgacagggaccctggccgtcttctttcttctgatcatgggacagctcacatggaacgatctgattcgcctgtgcatcatggtgggcgctaatgcctctgacagaatgggcatggggaccacctaccttgcgctgatggctacattcaaaatgcggcctatgtttgccgttggactcctgttccgcagactcacgagccgggaggtgctgcttctgaccatcggcctctccctggtcgcctctgtggaactgcccaacagccttgaggaactgggggatggactcgctatgggcattatgatcctgaagctcctgacagactttcaatcccatcagctttgggccaccctgctcagcctgacattcattaaaaccacgttttctctgcactatgcttggaagacaatggccatggtgctttccatcgtcagcctgttccccctctgtctgtctaccacctcccagaaaacaacctggctccctgttctgcttgggagcctgggatgcaagccgctgacaatgtttctcattgcggagaataagatctggggccgcagatcttggcccctgaacgaaggcatcatggccgtggggattgtgtccatccttctgagctccctcctgaaaaacgatgtccctctcgctggacccctgattgccggcgggatgcttatcgcttgttacgtgattagcggatctagcgccgacctgtccctggagaaggccgctgaggtttcttgggaagaggaagcggagcatagcggcgcctcccacaatatcctcgtggaagtccaggatgacgggacgatgaaaatcaaggatgaggagcgggacgataccctgacaattcttctgaaagctaccctcctggccgtgtctggagtttatcctctcagcatccccgccacactgttcgtgtggtacttctggcaacgcaagaaacagagatccggcgtcctttgggacaccccttctcccccggaagtggagcgggctgtcctggatgacggcatttatcgcatcatgcagagagggctgctcggacggagccaggtgggcgttggggtgtttcaagaaaacgtcttccatacgatgtggcacgtgaccagaggagccgttctgatgtaccagggcaagcgccttgagccttcctgggcgagcgtgaagaaagacctgatttcttacgggggaggctggcggctccagggctcctggaatacaggggaggaagtccaggtgatcgctgtggagcccggaaagaaccctaaaaatgttcaaaccgcccccggcacatttaagaccccggaaggggaggtcggagccattgctctggatttcaaacctggcacaagcgggtctcccatcgtgaacagagaaggaaagatcgtgggcctctatggcaatggggtcgtgacgacctccggaacatacgttagcgccattgcgcaggctaaggcctcccaggagggccctctgcccgagatcgaagacgaggtgtttcgcaaacggaaccttaccattatggatctgcaccccgggtctggaaagaccagacgctatctgcctgccatcgtccgggaagctattaaaagaaagctccgcacactgatccttgccccgacgcgggtggttgctagcgagatggccgaagcgctgaaaggcatgcccatcagataccaaaccacagccgtgaagtccgagcataccgggaaggagattgtcgacctcatgtgccacgctacattcaccatgcggctgctgagccctgtgcgcgttcccaattataacatgatcattatggatgaagcccattttacggacccttcttccatcgctgccagaggctacattagcacacgggtgggaatgggcgaggccgctgcgatcttcatgaccgccacaccccctgggtctgtcgaggcttttccgcagagcaatgccgtgatccaggatgaggaacgcgacattcccgagagatcctggaactctggatatgagtggatcacagatttccctggcaaaaccgtgtggtttgtccccagcattaagtccgggaatgacatcgccaactgtctccggaaaaatggaaagagagttattcagctttctcgcaaaacattcgataccgaataccaaaagacgaagaacaacgactgggactacgtggtgacaaccgatatcagcgagatgggcgctaatttccgggccgacagagtcattgatcctcgccggtgcctgaaacccgtgatcctgaaggacgggccggaaagagttatcctcgcgggccctatgcccgtgacagtcgcttccgccgcccagcgccggggaagaattggccgcaaccacaataaagagggggatcagtatatctacatgggacagcccctgaacaatgacgaggatcatgctcactggaccgaagccaagatgcttctggacaacattaatacgcctgagggcatcattcccgcgctctttgaacctgagagagaaaagagcgccgctatcgatggggagtatcggctgcgcggagaggccagaaagaccttcgtggagctgatgcggcgcggcgacctcccggtttggctttcttacaaggtggcttccgaggggtttcaatatagcgatagacggtggtgcttcgacggcgaaagaaacaatcaggtcctggaggaaaacatggatgtggagatctggacaaaagagggagaacgcaagaaactgcggcccagatggctcgacgcccgcacctactccgaccctctggcccttcgggagtttaaggagttcgccgcgggcagacggtctgtcagcggggatctgattctcgagatcggaaaactgccccagcacctgacacagcgcgcccaaaatgctctcgacaaccttgtgatgctgcataattccgaacagggcgggagagcctatcggcacgctatggaggagctgcctgataccattgaaacactcatgctgcttgccctgatcgccgttctcaccggaggcgtgacgctgtttttcctgtctggccgcgggctcggaaagacaagcattggccttctgtgtgtgatggcttccagcgtcctgctctggatggcgtctgttgagccccattggatcgccgcttccatcattctggaatttttccttatggtgctgctcatcccggagcctgacagacagcggacaccccaggataaccaactggcctacgtggtcattgggctgctctttatgatccttaccgtggccgctaatgagatgggactgctggaaacaaccaaaaaggacctcggcattgggcacgttgccgtggagaaccaccatcacgcggccatgctggatgtcgaccttcatcctgctagcgcctggacactgtacgctgtggccacgaccatcattacacccatgatgcgccacaccatcgaaaacacaaccgcgaatatctctctcacggccattgctaaccaggccgctatcctgatgggactggataagggctggcctatttccaaaatggacatcggcgtccccctccttgccctggggtgctatagccaggtgaatccgctgaccctcacagctgccgttctgatgcttgtggcgcattacgccattatcggacctggcctgcaagctaaggccaccagagaggctcagaaacggacagccgccgggatcatgaagaaccccaccgtcgatggaattgtggcgatcgacctcgatcccgttgtgtatgacgctaaattcgaaaagcagctgggccagattatgctgctcatcctttgtacgtctcaaattctgctgatgcgcacaacctgggccctctgcgagagcatcacactggctaccgggcctcttaccacactgtgggagggatccccgggcaagttttggaatacgaccatcgccgtctctatggccaacattttcagaggcagctacctcgctggggccggactggcgttctccctgatgaaaagcctcggcgggggacggagaggcacaggggcccagggagaaacccttggcgagaagtggaaacgccagctgaatcagctgtccaagtctgaatttaacacatataaacggagcggcatcatggaggtggacagatccgaagctaaggaggggctcaagcgcggagagaccacgaaacacgccgtgtctcggggcacagctaagctgagatggttcgttgaacgcaatcttgtcaaacccgaggggaaggtgattgatctgggatgtggcagagggggatggagctactattgcgccggcctcaaaaaggtgaccgaagtcaagggctacaccaaagggggacctggccacgaggaacccatccctatggcgacatacgggtggaacctggttaagctgcattccggaaaagacgtgtttttcattccccctgagaagtgtgataccctcctttgcgacatcggcgagtctagcccgaatcccacaattgaagaggggagaacgctgcgcgtgctgaaaatggtcgaaccttggctccggggaaaccaattttgtatcaagatcctgaatccctatatgccttccgtggttgagacccttgagcagatgcagagaaaacacggcggcatgctggtgcgcaaccccctcagcagaaattctacacatgaaatgtactgggtctcctgcgggaccggaaacattgtgagcgccgttaatatgacatctagaatgctgctgaaccgcttcaccatggctcacagaaagccgacgtatgagcgggatgtggacctcggcgccgggacccgccacgtcgctgtggaacctgaggtggccaacctggatatcattggacagagaatcgaaaatattaagcatgagcacaaatccacatggcattacgacgaggataacccctataagacctgggcttaccacggcagctatgaagtcaaaccctctgggtccgccagctccatggttaatggagtggtgaaacttctgacaaaaccttgggacgtcatccccatggtgacccaaatcgcgatgacagataccacgccttttggccagcagcgggttttcaaggagaaggtggacacaagaaccccgaaagccaagcggggcaccgctcaaattatggaagtcacagccaaatggctctgggggtttctgagccgcaacaagaaacccagaatctgtacgcgggaggagttcacccgcaaggtgagatctaatgctgccattggagccgtttttgtggacgagaaccagtggaatagcgcgaaggaggctgtcgaagatgagcggttctgggaccttgtgcatcgcgaaagagagctgcacaaacagggcaagtgcgccacatgcgtttacaacatgatggggaaacgggaaaagaaactcggagagtttggcaaggccaaggggtcccgcgctatctggtacatgtggctgggcgccagattcctggagttcgaagctctcggatttatgaatgaggatcactggttctctcgggaaaacagcctgtccggcgtggagggggagggacttcataaactgggctatattctccgcgacatctctaagatccctgggggaaatatgtacgccgatgacaccgcgggctgggatacaagaattaccgaagacgatctgcagaacgaggcccggatcacagacattatggaacccgagcacgcccttctggccaaaagcatctttaagctcacctatcaaaataaagtcgtgcgcgtccagagacctgctaagaacgggacggtgatggatgttatttcccggagagaccagcgcggctctggacaggtgggcacctacgggctgaatacattcaccaacatggaagcccaactgatccggcagatggagagcgagggaatcttttcccccagcgaactcgagacaccgaacctggcggaaagagtccttgattggctggagaaatatggcgtggaacgcctcaagcggatggccatttctggggacgactgtgtggttaagcctatcgatgacagattcgctaccgccctgacggctcttaatgatatgggaaaagtgcgcaaggacattccccagtgggagccttccaaaggctggaacgattggcagcaagtccccttttgcagccatcacttccaccagctgatcatgaaggacgggcgggagattgtggttccttgtagaaatcaggatgaactcgtgggccgcgcccgggtctctcagggagctggctggtccctgagagagacagcctgcctggggaaaagctacgcgcaaatgtggcagctcatgtattttcatcgccgggacctgagacttgccgctaacgccatctgttccgccgtgcccgtcgattggattccgacctctcggacaacctggagcatccacgctcatcaccagtggatgacgaccgaagacatgctgtccgtgtggaatagagtttggatcgaggaaaacccttggatggaggataagacacatattagctcttggggagacgtgccctacctcggcaagcgcgaggaccaatggtgcgggtccctgatcggacttaccgcccgggcgacatgggctaccaatattcaggtcgccatcaaccaggtgagacgcctgattggcaatgaaaactacctcgattatatgacaagcatgaaaagattcaagaatgagtctgaccccgaaggggccctgtggtga

SEQ ID NO: 19158 - RNA, 9879 nt, synthetic construct
  misc_feature 1..9879: note = derived and/or modified CDS sequence (opt5) from DENV-1__GU131717__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcattgaagcgaagatctccaacaccacgacagacagcagatgtccgacccaaggagaggccacccttgtggaagagcaggatgctaattttgtgtgccggcgcacattcgtcgacagaggctggggcaacgggtgtggactgtttggcaaagggtctctcatgacctgcgccaagttcaagtgcgtgacaaaactggagggaaagattgttcagtacgaaaatcttaaatattccgtgatcgtcacggtgcacaccggcgaccagcatcaagttgggaacgagagcacagaacacggaaccacagctaccatcacgccccaggccccttctaccgagattcagctgacagattacggcgccctcaccctggactgttccccccggacaggcctggattttaatgaaatggtgctcctgaccatgaaggagaaaagctggcttgtccataagcagtggttcctggacctccctctgccctggacgtccggggcttctacaagccaagagacctggaaccgcaaagatcttctggtgacatttaagaccgcgcacgccaagaaacaggaagtcgtggttctcggatcccaggagggcgctatgcacaccgccctgacaggggccacggaaatccaaaccagcggaacaaccacaattttcgctggccatctgaagtgcagactcaaaatggacaagctgacccttaaagggatgtcttatgtgatgtgtacgggctccttcaagctggagaaggaagtcgccgagacacagcacggaaccgtgctcgttcagatcaaatacgagggcaccgatgcgccgtgcaagattccttttagcacacaggacgaaaaaggggtgacccaaaatggacggctgatcacagctaaccccatcgtcacggataaggagaaacctgtgaatattgaagccgagccccccttcggcgagtcttatatcgtgattggggccggagaaaagaccctgaagcttagctggtttaaaaagggctcctctatcgggaaaatgttcgaggctacagccagaggcgctcgccggatggccattctcggagacaccgcgtgggattttggcagcatcgggggagttttcacatccgtcggcaagctggtgcatcagatctttgggaccgcctacggagtgctgttcagcggcgtctcttggacgatgaaaattgggatcggcgtgctcctgacctggcttggactgaactccagaagcacatctctctccatgacctgtattgctgttggcctggtgacactgtaccttggggtcatggtgcaggccgacagcggatgcgttatcaattggaagggccgcgaactcaagtgtgggtccggaatttttgtgaccaacgaggtccacacatggaccgaacagtataaattccaagctgactctcctaagcggctgagcgccgcgatcggcaaagcctgggaggagggggtgtgcggcattagatccgctacgcgcctggaaaatatcatgtggaagcagatctctaacgagctcaaccatattctgcttgaaaatgatatgaaatttacagttgtggtcggagacgtggccggcatcctggctcaggggaagaaaatgattcggccgcagcccatggagtacaagtatagctggaagtcctggggaaaagccaagatcattggcgccgatgtgcaaaacaccaccttcatcatcgacgggcctaatacacccgaatgtcctgatgaccagagagcttggaacatttgggaggtcgaggattacggatttggcatcttcaccacgaatatttggctcaaactgcgcgacagctatacacaggtttgcgatcaccggctgatgtctgcggccatcaaggactccaaagctgtgcacgccgatatgggctactggattgaaagcgagaagaacgaaacctggaagcttgccagagcttctttcatcgaggtgaaaacatgtatctggcccaagtcccataccctctggagcaatggggtcctggaatctgagatgattatcccgaaaatttatggaggccctatcagccagcacaactaccgccccgggtactttacacaaaccgccggaccttggcatctgggcaagctcgagctggacttcgatctttgcgaagggacgaccgtggttgtggacgagcactgcggaaatcggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaacctggttaagtctatggtgtccgcggggagcggagaggtcgattccttctctcttggcctcctgtgtattagcatcatgattgaagaggtgatgcggtccagatggtctcgcaaaatgctgatgacagggaccctcgctgtttttttcctgcttatcatgggacagctgacatggaatgacctcattcggctgtgcatcatggtgggcgccaacgccagcgatagaatgggcatggggaccacctacctggctcttatggccacatttaagatgcgccctatgttcgcggtcggactgctctttagacggctgacgtcccgcgaggtgctcctgcttaccattggcctgtctctcgtggctagcgtcgaactgcccaattccctggaggaacttggggacggactggccatgggcatcatgatcctcaaactgctcacagatttccagagccatcaactgtgggccacccttctgtctctcacatttattaagaccacgttctccctgcactatgcttggaagacaatggccatggttctgagcatcgtgtctctttttcccctgtgtctctccaccaccagccagaaaacaacctggctgcctgtgctcctggggtctcttggatgcaagccgctgacaatgttcctgattgctgagaacaaaatctggggcagaaagtcctggcccctcaatgaaggcattatggccgtcgggatcgtgagcatcctgctttccgcgctgctcaaaaacgacgttcctctggccggacccctcattgctggcgggatgctgatcgcctgttacgtgattagcggatctagcgctgatctttccctggagaaggccgccgaggtctcttgggaagaggaagctgagcatagcggcgcgtcccacaacatcctggtggaagttcaggacgatgggacgatgaaaattaaggacgaggagcgggatgacaccctcacaatcctgcttaaggccaccctgctcgctgtgtctggagtctatcctctgagcatccccgccacactcttcgtgtggtacttttggcagaaaaagaaacaacgctccggcgtcctgtgggataccccttctcccccggaagtggagagagccgttcttgacgacggcatttatcggatcatgcagcgcgggctgctgggaagaagccaggtgggcgtcggggtgttccaggaaaatgtttttcatacgatgtggcacgtgacccggggagctgtcctcatgcaccaaggcaagcgcctggagccttcctgggccagcgtgaaaaaggatcttatttcttacgggggaggctggagactgcagggctcctggaacacaggggaggaagtgcaggttatcgcggtcgagcccggaaagaatcctaaaaacgtgcagaccgctcccggcacattcaagaccagcgaaggggaggtgggagccattgccctcgactttaaaccgggcacatctgggtcccctatcgtcaatcgggaaggaaagattgtgggcctgtacggcaacggggttgtgacgaccagcggaacatatgtctccgctatcgcccaagcgaaagcttctcaggagggccccctccctgagatcgaagatgaggtgttcagaaagcgcaatctgaccattatggaccttcatcccgggagcggaaagacccggagatacctgcccgccatcgttcgcgaagccattaaacggaagctgagaacactcatcctggctcctacgcgcgtggtcgcctccgagatggctgaagcccttaaaggcatgccgattcggtatcagaccacagcggtgaagagcgagcacaccgggaaagagatcgttgatctgatgtgccatgccacatttaccatgagactcctgtctcccgtgcgcgtccctaactacaatatgatcattatggacgaagctcacttcacggatccctccagcatcgccgctcggggctatatttctacaagagtgggaatgggcgaggccgccgctatctttatgaccgcgacccctcccgggagcgtggaagccttccctcaatccaacgctgtcattcaggacgaggaacgggatatcccggagcgctcttggaatagcggatacgagtggatcacagactttcccggcaagaccgtttggttcgtgccttccattaagtctgggaacgatatcgccaattgtctgagaaaaaacggaaagcgggtgattcagctcagccgcaaaacattcgacaccgaatatcagaagacgaaaaataacgactgggattacgtcgtgacaaccgacatctccgagatgggcgccaactttagagctgatcgggttattgaccccagacgctgccttaagcctgtgatcctgaaggatgggcccgaacgggtcattctggccggcccgatgcctgtgacagttgcgagcgctgcccaaagacgcggacggatcggcagaaatcataacaaagagggggaccagtacatctatatgggacagcccctcaataacgatgaggaccacgcccactggaccgaagctaagatgctgcttgataatattaacacgcccgagggcatcattcctgccctgttcgaacccgagcgcgaaaaatctgcggccatcgacggggagtaccggctcagaggagaggctcgcaagacctttgtggaactgatgagacggggcgatctgcctgtctggctctcctataaagtggccagcgaggggttccagtactccgaccgcagatggtgctttgatggcgaacggaataaccaagtccttgaggaaaatatggacgtggagatttggacaaaggagggagaacgcaaaaagctgagaccgcggtggctggacgctagaacctattctgatcccctcgccctgcgcgagttcaaggaatttgctgccggccggagaagcgtttccggggaccttatcctggagatcggaaaactccctcagcatctgacacagcgcgcgcagaacgccctggataatctcgtgatgcttcacaactctgaacaaggcgggcgggcttacagacatgccatggaggagctgcccgacaccattgaaacactgatgctcctggctcttatcgccgtgctgaccggaggcgtcacgctcttctttctgagcggccgggggctgggaaagacatccattggcctcctttgtgttatggccagctctgtgctgctgtggatggcttccgtggagcctcactggatcgcggccagcattatcctcgaattctttctgatggtccttctgatccccgagccggatcgccagagaacccctcaggacaatcagctcgcttatgtggttattgggctgctgttcatgatcctcaccgtggccgccaacgagatgggacttctggaaacaaccaaaaaggatctgggcattgggcacgtcgctgtggagaatcatcaccatgccgcgatgctcgacgtcgatctgcaccccgcctctgcttggacactttacgccgtggctacgaccatcattacacctatgatgcggcataccatcgaaaacacaaccgccaacatttccctgacggcgatcgccaatcaagctgccatcctcatgggactggacaaaggctggcccattagcaagatggatatcggcgttcctctgctcgctcttgggtgctactctcaggtgaaccccctgaccctgacagccgctgtcctcatgctggtggcccactatgcgattatcggaccgggccttcaggccaaggctacccgcgaggcccaaaaaagaacagctgccgggattatgaagaatcctaccgttgacggaatcgtggccatcgatctggaccccgtcgtgtacgacgcgaaatttgaaaagcagctcggccagattatgctgctgatcctctgtacgagccagattcttctgatgcggacaacctgggctctgtgcgagtccatcacactcgccaccgggcccctgaccacactttgggagggatctcctggcaaattctggaacacgaccattgctgtgagcatggccaatatcttccgcggctcctatctggccggggctggactcgcctttagcctgatgaagtccctgggcgggggaagacggggcacaggggcgcaaggagaaaccctcggcgagaagtggaaacgccagcttaaccagctgtctaagagcgaattcaatacatacaaaagatccggcatcatggaggttgatcggtctgaagccaaggaggggctgaaaagaggagagaccacgaagcacgctgtcagccgcggcacagccaagctccggtggtttgtggaaagaaacctggtgaaaccggaggggaaggtcattgaccttggatgtggccgcgggggatggtcctattactgcgctggcctgaaaaaggttaccgaagtgaaaggctataccaaggggggacccggccatgaggaacctatccccatggccacatacgggtggaatctcgtgaaactgcactctggaaaggatgtcttctttattcctcccgagaagtgtgacaccctgctctgcgatatcggcgagagctcccctaacccgacaattgaagaggggcggacgcttagagtgctgaaaatggttgaaccctggctgcgcggaaatcagttctgtatcaagattctcaacccttacatgcccagcgtggtcgagaccctggagcaaatgcagcggaaacatggcggcatgcttgtgagaaatcctctgtctcgcaactccacacacgaaatgtattgggttagctgcgggaccggaaatatcgtgtctgcggtcaacatgacatcccggatgctcctgaatagatttaccatggcccaccgcaagcccacgtacgagcgggacgtggatctgggcgctgggaccagacatgtggccgtcgaaccggaggttgctaacctcgacatcattggacagcgcatcgaaaacattaaacacgagcataagagcacatggcactatgatgaggacaatccttacaagacctgggcctatcatggctcttacgaagtgaaaccctccgggagcgcttccagcatggtgaacggagtcgtgaagctgcttacaaaaccctgggatgttatccctatggtgacccagattgccatgacagacaccacgcccttcggccaacagagagtctttaaggagaaagtggacacacggacccctaaggcgaagcgcggcaccgcccagatcatggaagttacagctaaatggctgtgggggttcctctctagaaataagaaaccgcggatctgtacgagagaggaatttacccggaaggtgcgcagcaacgccgctattggagccgtcttcgtggatgagaatcaatggaactccgccaaagaggcggttgaagacgagagattttgggatctggtgcaccgggaacgcgagcttcacaagcagggcaagtgcgctacatgcgtctataatatgatggggaaaagagaaaagaaactgggagagttcggcaaggccaaagggtctcgggccatctggtacatgtggctcggcgctcgcttcctggagtttgaagccctgggattcatgaacgaggaccattggtttagcagagaaaattccctctctggcgtggagggggagggactgcacaagcttggctacattctgcgggatatcagcaaaattcccgggggaaacatgtatgctgacgataccgccggctgggacacacgcatcaccgaagatgacctccagaatgaggcgaagatcacagatattatggaacctgagcatgccctgcttgctaagtccatcttcaaactgacctaccagaacaaggtcgtgagagttcaacggcccgccaaaaatgggacggtgatggacgtcatttctcgcagagatcagcggggcagcggacaggtgggcacctatgggctcaacacatttaccaatatggaagctcagctgatccgccaaatggagtccgagggaattttcagcccttctgaactggagacacccaacctcgccggcagagtgctggactggcttgaaaagcacggggttgagcggctgaaaagaatggcgatctccggagacgattgtgtggtcaagccgatcgacgatcgctttgccgctgccctcaccgctctgaacgacatgggcaaggtgcggaaagatattcctcagtgggaacccagcaaggggtggaatgactggcagcaggttcctttctgctctcaccattttcaccaacttatcatgaaagatggcagagagattgtggtcccctgtcgcaaccaggacgagctggtgggacgggccagagtctcccagggcgctgggtggagcctccgcgaaacggcctgcctgggaaagtcctacgcgcagatgtggcaactgatgtatttccatcggagagatctccgcctggccgctaatgccatctgttctgccgtgcctgttgactgggtgcccacaagccggaccacatggtccattcacgctcatcaccagtggatgaccacggaggatatgcttagcgtctggaacagagtgtggatcgaagagaatccgtggatggaagacaaaacccacatttcttcctggggcgacgttccttacctggggaagcgcgaggatcagtggtgcggaagcctcatcggcctgacagcccgggcgacctgggctacaaacatccaagtggccattaatcaggtcagacggcttatcgggaacgagaattatctggactacatgacctctatgaagagatttaaaaacgaaagcgatcccgagggcgccctctggtga

SEQ ID NO: 19159 - RNA, 9879 nt, synthetic construct
  misc_feature 1..9879: note = derived and/or modified CDS sequence (opt5) from DENV-1__GU131718__SS-prME
  source 1..9879: mol_type = other RNA
agcgtgaccatgctgctcatgctgatgcccaccgcccttgctttccacctgacgacccggggcggggagcctcatatgatcgtcacaaagcaggaacggggaaagtccctcctgtttaagacctctgccggcgttaacatgtgcacacttattgccatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccattgaacacggaaccacagctaccatcacgccccaggcccctaccagcgagattcagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaatccagacctccggaacaaccacaatttttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaatccctttctccacacaagatgaaaagggggttacccagaacggacggctgattacagctaatcccatcgtgattgacaaagagaagcctgtcaacatcgaagccgagccgccctttggcgagagctatattgtgatcggggccggagaaaaagctcttaagctctcttggttcaagaaaggcagctccatcgggaagatgtttgaggccacggctagaggcgcccgccggatggcgattctgggagataccgcctgggacttcggctctatcgggggagtgtttacaagcattggcaaactggttcatcagatcttcgggaccgcttacggagtcctcttttccggcgtgagctggacaatgaagattgggatcggcgtgctgcttacctggctgggactcaattctagatccacgagcctgtctatgacctgtattgccgtcggcctggtgacactttacctcggggttatggtgcaggctgattccggatgcgtcatcaactggaaaggccgcgaactgaagtgtgggagcggaatcttcgtgaccaatgaggttcacacatggaccgaacaatataagtttcaggccgactcccctaaacggctgtctgcggccattggcaaggcttgggaggagggggtgtgcggcatcagaagcgccacacgcctcgaaaacattatgtggaaacagatctccaacgagctgaatcatattcttctggaaaacgacatgaagttcaccgtcgtggttggagatgtggtcggcatcctcgctcaggggaaaaagatgatccggccgcaacccatggagcacaaatactcttggaaaagctggggaaaggccaagattatcggcgccgacgtgcagaatacgacatttattatcgatgggcctaacacccccgaatgtcctgacgatcagagagcttggaatatttgggaggtggaggactatggattcggcatctttaccacaaacatctggctgaagatgcgcgattcctacacccaggtctgcgaccaccggctgatgagcgcggccattaaagattctaaggctgttcatgccgacatgggctattggatcgaatccgagaaaaatgaaacgtggaaacttgccagagctagcttcattgaggtgaagacatgtatctggcccaaatctcacaccctctggtccaacggggtgctggaaagcgagatgattatcccgaagatctacggaggccctatttctcaacataattatcgccccgggtacttcacacagaccgccggaccttggcacctgggcaaactcgagctggattttgacctttgcgaagggacaaccgtcgtggttgatgagcactgcggaaaccggggccccagcctgagaacgaccacagtgaccggcaagatcattcatgaatggtgttgccggtcctgtacactccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgaccgggacgctcgctgtgttcctgcttctgatcatgggacagctcacatggaacgatctgatccggctgtgcattatggttggcgccaatgcctctgacagaatgggcatggggaccacatatcttgctctgatggccacctttaaaatgcgccctatgttcgcggtgggactcctgtttagacggctcaccagccgcgaggtcctgcttctgacaatcggcctctccctggtggcttctgtggaactgcccaacagccttgaggaactgggggatggactcgccatgggcattatgatcctgaagctcctgacggacttccaatcccaccagctttgggccaccctgctcagcctgacatttattaaaaccacactgtctcttcattacgcttggaagaccatggccatggtcctgtccatcgttagcctcatccccctgtgtctctctacgacatcccagaagaccacctggctgcctgtgcttctggggagcctgggatgcaaaccgctcacaatgttcctgattgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgttatgtgatcagcggatctagcgccgacctgtccctcgagaaagctgccgaggtctcttgggaagaggaagccgagcacagcggcgcttcccataatattctggtggaagttcaggatgacgggaccatgaagatcaaagatgaggagcgggacgatacacttacgattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacaatgtggcacgtgacccggggagccgtccttatgtatcagggcaaacgcctggagccttcctgggctagcgtgaagaaagacctcatttcttacgggggaggctggagactgcagggctcctggaatacgggggaggaagtgcaggttatcgccgtcgagcccggaaagaaccctaagaatgtgcaaaccgcgcccggcacattcaaaaccccggaaggggaggtgggagctatcgccctcgattttaagcctggcacaagcgggtctcccattgtcaaccgggaaggaaaaatcgtgggcctgtacggcaatggggttgtgaccacatccggaacgtatgtcagcgccattgctcaggccaaggcgtcccaggagggccctcttcccgagatcgaagacgaggtgttcagaaaacgcaacctgaccattatggatctgcatcccgggtctggaaagacacggagatacctccctgctatcgttcgcgaagccatcaagcggaaactgagaacccttattctggccccgacccgcgtggtcgctagcgagatggccgaagctctcaagggcatgcccatccggtatcaaacaacggccgtgaaatccgagcacaccgggaaggagattgttgacctgatgtgccatgcgacatttaccatgagactgctcagccctgtgcgcgtccccaattacaacatgatcattatggatgaagcccacttcacagacccttcttccatcgctgcccggggctatatcagcaccagagtgggaatgggcgaggctgccgccatttttatgacggctacaccccctgggtctgtggaagcgttcccgcagagcaatgccgtcatccaggatgaggaacgggacattcccgagcgctcctggaactctggatacgagtggatcaccgattttcctggcaaaaccgtttggttcgtgcccagcattaagtccgggaatgacatcgctaactgtcttagaaagaatggaaaacgggtgattcagctgtctcgcaagacatttgataccgaatatcagaagacaaagaacaacgactgggactacgtcgtgaccacggatatcagcgagatgggcgccaatttcagagccgaccgggttatcgatcctagacgctgcctgaaacccgtgattctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacacctgagggcatcatccccgctctgtttgaacctgagcgcgaaaagagcgccgcgattgatggggagtaccggctgagaggagaggcccgcaaaaccttcgtggaactcatgagacggggcgaccttccggtctggctgtcttataaggtggcttccgaggggttccaatacagcgatcgcagatggtgctttgacggcgaacggaacaatcaggtcctggaggaaaacatggatgtggagatctggacgaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacactgttctttctctctggccgggggcttggaaaaaccagcatcggcctgctgtgtgttatggcctccagcgtgctcctgtggatggcctctgtggagccccactggattgctgcgtccatcattcttgagttctttctgatggtcctcctgatcccggagcctgaccgccagagaacgccccaggataaccaactggcctatgtggttattgggctccttttcatgatcctgacagtggctgccaatgagatgggactgctcgaaaccaccaagaaagacctgggcattgggcacgtcgccgtggagaaccatcaccatgctacaatgcttgatgtcgacctgcaccctgccagcgcgtggaccctctacgccgtggctacaacgatcatcacccccatgatgcggcatacaattgaaaacaccacagccaatatctctctgaccgctattgccaaccaggcggccatcctgatgggactcgataagggctggcctatttccaaaatggacatcggcgttccccttctggctctggggtgctacagccaggtgaatccgctcacgctgaccgccgctgtccttatgctggtggcccactatgctatcattggacctggcctccaagccaaggcgacacgcgaggcccagaagagaaccgctgccgggatcatgaaaaaccccacagttgatggaattgtggctatcgacctggatcccgtcgtgtacgacgccaagtttgaaaaacagctgggccagattatgctccttatcctgtgtacctctcaaatcctgctcatgcggacgacatgggccctgtgcgagagcattacccttgcgacagggcctctgaccaccctctgggagggatccccgggcaagttctggaatacaacgatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatctacaagagaagcggcattatggaggttgaccggtccgaagccaaagaggggctgaagagaggagagaccacacgccacgcggtctctcggggcaccgccaaacttagatggttcgtggaacgcaatctggtgaagcccgaggggaaggtcatcgatctcggatgtggcagagggggatggagctattactgcgctggcctgaaaaaggttacggaagtgaaaggctatacaaaagggggacctggccatgaggaacccattcctatggccacctacgggtggaacctggtgaaactccactccggaaaggacgtcttctttacaccccctgagaaatgtgatacacttctgtgcgacatcggcgagtctagcccgaatcccaccatcgaagaggggagaacactgcgcgtgctcaagatggttgaaccttggctgcggggaaaccaattctgtattaagatccttaatccctacatgccttccgtggtcgagacgctggagcagatgcagagaaaacatggcggcatgctcgtgcgcaaccccctgagcagaaattctacccacgaaatgtattgggtttcctgcgggacaggaaacattgtgagcgctgtcaatatgacctctagaatgctgctcaaccgctttacaatggcccaccggaagccgacctacgagaaagatgtggacctgggcgcggggacgagacatgtggccgtcgaacctgaggttgctaaccttgatatcattggacagcgcatcgaaaatatcaagcacgagcataaatccacctggcactatgacgaggataacccctacaagacatgggcctatcatggcagctacgaagtgaagccctctgggtccgctagctccatggtgaatggagtcgtgaaactgctcaccaagccttgggacgttattcccatggtgacacaaatcgccatgaccgatacaacccctttcggccagcagagagtctttaaagagaaggtggacacgcggacaccgaaagctaagcgcggcaccgttcaaattatggaagtgaccgccagatggctgtgggggttccttagccggaacaagaaacccagaatctgtacacgggaggaatttacgcgcaaggtcagatctaatgcggccattggagctgtgttcgttgacgagaaccagtggaatagcgccaaagaggctgtggaagatgagcggttttgggacctggtcaagaaagaacgcgagctccacaagcagggcaagtgcgcgacctgcgtgtataacatgatggggaaaagagaaaagaaactgggagagttcggcaaggccaaagggtcccgggcgatctggtacatgtggctgggcgctcgctttctcgagttcgaagccctgggatttatgaatgaggatcactggttctctagagaaaacagcctttccggcgtcgagggggagggactgcataagctcggctacatcctgcgggacatttctaaaatccctgggggaaatatgtatgccgatgacacagctggctgggatacccgcattacagaagacgatcttcagaacgaggccaagatcaccgacattatggaacccgagcacgctctgctcgccacaagcatcttcaagctgacctaccaaaataaagtggttagagtgcagcggcctgcgaagaacgggacggtcatggatgtgatctcccgcagagaccagcggggctctggacaggtgggcacctatgggctgaatacatttaccaacatggaagcccaactcattcgccagatggagagcgagggaatcttcctgccctccgaacttgagacaccgaacctggctgaaagagttctcgattggctggagaaatacggcgtggaacggcttaagagaatggccattagcggggacgactgtgtcgtgaaacctatcgatgaccgctttgctaccgccctgacggcgctcaatgatatgggaaaggttcggaaggacattccccagtgggagccttctaaaggctggaacgattggcagcaagtgcccttctgctcccatcactttcaccagctgatcatgaaggacgggagagagattgtcgtgccttgtcgcaatcaggatgaactggtcggccgggccagagtgagccagggagctggctggtctctccgcgagacagcctgcctggggaaatcctatgctcaaatgtggcagcttatgtacttccatcggagagacctgcgcctcgccgctaacgccatctgtagcgcggttcccgtggattgggtcccgacctcccggacaacctggtctatccacgcccatcaccagtggatgacgaccgaagacatgctgagcgtgtggaatagagtttggattgaggaaaacccttggatggaggataagacacatgtgtccagctggggagacgtcccctatcttggcaaacgcgaggaccaatggtgcgggtctctgatcggactcaccgctcgggccacatgggcctccaatattcaggtggctatcaaccaggtgagacggctgattggcaatgaaaactacctggattacatgaccagcatgaagagatttaagaatgagggggaccccgaaggcgccctctggtga

SEQ ID NO: 19160 - RNA, 9879 nt, synthetic construct
  misc_feature 1..9879: note = derived and/or modified CDS sequence (opt5) from DENV-1__GU131720__SS-prME
  source 1..9879: mol_type = other RNA
agcgtgaccatgctgctcatgctgatgcccaccgcccttgctttccacctgacgacccggggcggggaacctcatatgatcgtgaccaagcaggaacggggaaaatccctcctgtttaagacctctgccggcgttaacatgtgcacccttattgccatggacctgggggagctctgtgaagataccatgacgtacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttgcgaccaacatttggctgaagctgcgcgattcctacacacaggtgtgcgaccaccggcttatgagcgccgctatcaaagattctaaggccgtgcatgccgacatgggctattggattgaatccgagaaaaatgaaacatggaagctcgctagagccagcttcatcgaggtcaagacctgtatctggcccaaatctcacacactgtggtccaacggggtgctggaaagcgagatgattatcccgaagatttacggaggccctatctctcaacataattatcgccccgggtacttcacccagacagcgggaccttggcacctcggcaaactggagcttgattttgacctgtgcgaagggaccacggttgtggtcgatgagcactgcggaaaccggggccccagcctcagaaccacaaccgtgacaggcaagattatccatgaatggtgttgccggtcctgtaccctgcctcccctgcgcttcaaaggggaggacggatgctggtacggcatggagatcagaccggttaaggaaaaggaggaaaatcttgtgaaaagcatggtctctgctgggtccggagaggtggacagcttttccctcggcctgctgtgtatttctatcatgattgaagaggttatgcggagcagatggtcccgcaagatgctcatgacggggacactggccgtgttccttctgctcatcatgggacagctgacctggaacgatctgattcggctttgcatcatggtcggcgccaatgcttctgacagaatgggcatggggacaacctatctggccctcatggcgacctttaaaatgcgccctatgttcgctgtgggactgctctttagacggctgacaagccgcgaggtgcttctgctcacgattggcctgtccctggtcgcctctgttgaacttcccaacagcctggaggaactcggggatggactggccatgggcatcatgatcctcaagctgcttaccgacttccaatcccaccagctgtgggctacactcctgagcctgacctttattaaaacaaccctttctctgcattacgcctggaagacgatggctatggtgctctccatcgtgagcctgttccccctctgtctgtctacaacctcccagaagaccacatggcttcctgtcctgctggggagctttggatgcaaaccgctcaccatgttcctgattacagagaataagatctggggcagaaaatcttggccccttaacgaaggcattatggccgtgggggttgtgtccatcctgctcagctccctgctcaagaacgatgtccctctggcgggaccccttatcgccggcgggatgctgattgcttgttatgtgatcagcggatctagcgccgacctgtccctcgagaaagctgccgaggtttcttgggaagaggaagccgagcacagcggcgcttcccataatattctggtggaagtccaggatgacgggacgatgaagatcaaagatgaggagcgggacgatacccttacaattctgctcaaggcgaccctgctcgccgtgtctggagtctaccctctgagcatccccgctacactttttgtgtggtatttctggcaaaagaaaaagcagcgctccggcgttctgtgggacaccccttctcccccggaagtggagagagccgtcctggatgacggcatctaccggattatgcagcgcgggctcctgggaagaagccaggtgggcgttggggtgttccaagaaaacgtctttcacacgatgtggcacgtgacccggggagccgtgcttatgtatcagggcaaacgcctggagccttcctgggctagcgttaagaaagacctcatctcttacgggggaggctggagactgcagggctcctggaatacaggggaggaagtccaggtgattgccgtggagcccggaaagaaccctaagaatgtccaaaccgcgcccggcacattcaaaaccccggaaggggaggtgggagctatcgccctcgattttaagcctggcacaagcgggtctcccattgttaaccgggaaggaaaaatcgtgggcctgtacggcaatggggtcgtgacgacctccggaacatatgttagcgccattgctcaggccaaggcgtcccaggagggccctcttcccgagatcgaagacgaggtgttcagaaaacgcaacctgaccatcatggatctgcatcccgggtctggaaagacccggagatacctccctgctattgtccgcgaagccatcaagcggaaactgagaacacttattctggccccgacgcgcgtggttgctagcgagatggccgaagctctcaagggcatgcccatccggtatcaaaccacagccgtgaaatccgagcacaccgggaaggagattgtcgacctgatgtgccatgcgacatttaccatgagactgctcagccctgtgcgcgtgcccaattacaacatgatcatcatggatgaagcccacttcacggacccttcttccattgctgcccggggctatatcagcacaagagtcggaatgggcgaggctgccgccatttttatgaccgctacaccccctgggtctgttgaagcgttcccgcagagcaatgccgtgatccaggatgaggaacgggacattcccgagcgctcctggaactctggatacgagtggatcacagattttcctggcaaaaccgtgtggttcgtccccagcatcaagtccgggaatgacattgctaactgtcttagaaagaatggaaaacgggtgatccagctgtctcgcaagacatttgataccgaatatcagaagacgaagaacaacgactgggactacgttgtgacaaccgatattagcgagatgggcgccaatttcagagccgaccgggtcatcgatcctagacgctgcctgaaacccgtgattctcaaggacgggccggaacgggttatcctggctggccctatgcccgtgacagtcgcctccgcggctcagagacgcggacggattggcagaaaccataataaggagggggatcagtacatctatatgggacagccccttaacaatgacgaggatcacgcccactggaccgaagccaaaatgctgctcgacaacatcaatacgcctgagggcattatccccgctctgttcgaacctgagcgcgaaaagagcgccgcgattgatggggagtaccggctgagaggagaggcccgcaaaacctttgtggaactcatgagacggggcgaccttccggtctggctgtcttataaggtggcttccgaggggttccaatacagcgatcgcagatggtgctttgacggcgaacggaacaatcaggttctggaggaaaacatggatgtggagatctggacaaaagagggagaacgcaagaaactcagaccccggtggctggacgccagaacctattccgaccctcttgctctgcgcgagttcaaggaatttgccgctggccggagatctgtgagcggggatctcattctggagatcggaaagctgccccagcatctcacacagcgcgcccaaaatgcgcttgacaacctggtcatgctgcacaattccgaacagggcgggcgggcctacagacatgctatggaggagctccctgataccatcgaaacactgatgcttctggccctcattgctgttctgaccggaggcgtgacgctgttctttctctctggccgggggcttggaaaaacaagcatcggcctgctgtgtgtgatggcctccagcgtcctcctgtggatggcctctgtggagccccactggattgctgcgtccatcattcttgagttctttctgatggttctcctgatcccggagcctgaccgccagagaacaccccaggataaccaactggcctatgtggtcatcgggctccttttcatgattctgaccgtggctgccaatgagatgggactgctcgaaacaaccaagaaagacctgggcatcgggcacgtcgccgtggagaaccatcaccatgctacaatgcttgatgttgacctgcaccctgccagcgcgtggacgctctacgccgtggctaccacaattatcacccccatgatgcggcatacaattgaaaacaccacggccaatatctctctgaccgctattgccaaccaggcggccatcctgatgggactcgataagggctggcctatctccaaaatggacattggcgtcccccttctggctctggggtgctacagccaggtgaatccgctcacactgaccgccgctgttcttatgctggtggcccactatgctatcattggacctggcctccaagccaaggcgacacgcgaggcccagaagagaaccgctgccgggatcatgaaaaaccccacggtcgatggaattgtggctatcgacctggatcccgtggtttacgacgccaagtttgaaaaacagctgggccagatcatgctccttattctgtgtacatctcaaatcctgctcatgcggaccacatgggccctgtgcgagagcattacccttgcgaccgggcctctgacaacgctctgggagggatccccgggcaagttctggaataccacaatcgctgtctctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgagttcaacatctacaagagaagcggcatcatggaggtggaccggtccgaagccaaagaggggctgaagagaggagagaccacgcgccacgcggtgtctcggggcacagccaaacttagatggtttgtcgaacgcaatctggttaagcccgaggggaaggtgattgatctcggatgtggcagagggggatggagctattactgcgctggcctgaaaaaggtgaccgaagtcaaaggctataccaaagggggacctggccatgaggaacccatccctatggccacatacgggtggaacctggtgaaactccactccggaaaggacgttttctttacaccccctgagaaatgtgatacacttctgtgcgacattggcgagtctagcccgaatcccacgatcgaagaggggagaaccctgcgcgtgctcaagatggtcgaaccttggctgcggggaaaccaattctgtattaagatccttaatccctacatgccttccgtggttgagacactggagcagatgcagagaaaacatggcggcatgctcgtgcgcaaccccctgagcagaaattctacccacgaaatgtattgggtctcctgcgggacaggaaacattgtgagcgctgtgaatatgacctctagaatgctgctcaaccgctttacgatggcccaccggaagccgacctacgagagagatgtcgacctgggcgcggggacacgccatgttgccgtggaacctgaggtggctaaccttgatatcatcggacagagaattgaaaatatcaaacacgagcataagtccacctggcactatgacgaggataacccctacaaaacatgggcctatcatggcagctacgaagtcaagccctctgggtccgctagctccatggtgaatggagttgtgaagctgctcaccaaaccttgggacgtcattcccatggtgacacaaatcgccatgaccgatacgacacctttcggccagcagcgggtttttaaggagaaagtggacacccgcaccccgaaggctaaaagaggcacagcccaaattatggaagtcacggcgcggtggctgtgggggttccttagcagaaacaagaagccccggatctgtacccgcgaggaatttacaagaaaagtgcggtctaatgccgctatcggagccgttttcgtggacgagaaccagtggaatagcgctaaggaggccgtcgaagatgagcgcttttgggacctggtgcagaaagaaagagagctccacaagcagggcaaatgcgcgacctgcgtctataacatgatggggaagcgggaaaagaaactgggagagttcggcaaggcgaaagggtcccgcgctatttggtacatgtggctgggcgccagatttctcgagttcgaagccctgggattcatgaatgaggatcactggttttctcgggaaaacagcctttccggcgtggagggggagggactgcataagctcggctacatcctgcgcgacatttctaaaatccctgggggaaatatgtatgctgatgacacagccggctgggataccagaattacagaagacgatcttcaaaacgaggctaagatcaccgacatcatgaaacccgaacacgccctgctcgcgacgagcattttcaagctgacctaccagaataaggttgtgcgggtccagcgccctgccaaaaacgggacagtgatggatgtgatctccagacgggaccagcgcggctctggacaagttggcacctatgggctgaatacatttaccaacatggaggctcagctcattagacagatggaaagcgagggaatcttcctgccctccgagcttgaaacgccgaacctggccgagcgggtgctcgattggctggaaaagtacggcgtcgagagacttaaacgcatggctattagcggggacgactgtgtggttaagcctatcgatgaccggtttgccacagcgctgaccgccctcaatgatatgggaaaagtgagaaaggacatcccccagtgggaaccttctaagggctggaacgattggcaacaggtccccttctgctcccatcactttcaccagctgattatgaaagacgggcgcgagatcgtggtcccttgtcggaatcaggatgagctggtgggcagagctcgcgttagccaaggagccggctggtctctccgggaaacagcttgcctggggaagtcctatgcccagatgtggcagcttatgtacttccatagacgcgacctgcggctcgctgccaacgcgatttgtagcgccgtgcccatcgattgggtcccgacctccagaacgacctggtctattcacgctcatcaccaatggatgacaaccgaggacatgctgagcgtgtggaatcgcgtttggatcgaagagaacccttggatggaagataaaacacatgtgtccagctggggagacgtcccctatcttggcaagcgggaggaccagtggtgcgggtctctgattggactcaccgccagagccacatgggcttccaatatccaggtggccatcaaccaggtgcggagactgattggcaatgagaactacctggattacatgaccagcatgaaacgctttaagaatgaaggggaccccgagggcgcgctctggtga

SEQ ID NO: 19161 - RNA, 9879 nt, synthetic construct
  misc_feature 1..9879: note = derived and/or modified CDS sequence (opt5) from DENV-1__HM181960__SS-prME
  source 1..9879: mol_type = other RNA
agcgtgaccatgctgctcatgctgatgcccacagcccttgctttccacctgacgaccagaggaggggagcctcatatgatcgtctccaagcaggaacggggaaaatctctcctgtttaagacaagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccctggagaaagctgccgaggtctcttgggaagaggaagccgagcatagcggcgcttcccacaatattctcgtggaagttcaggatgacgggaccatgaagatcaaagatgaggagagagacgatacactgaccatccttctgaaggcgacactcctggccgtgtctggagtctatcctctcagcattcccgctaccctgttcgtgtggtacttctggcagaaaaagaagcagcggtccggcgtcctttgggacacgccttctcccccggaagtgggccgcgccgttctggatgacgggatctatagaattatgcagcggggactgctcggccgcagccaggtgggggtcggagtgtttcaagagaacgttttccataccatgtggcacgtgacaagaggcgccgtcctgatgtaccaggggaaacggcttgaaccttcctgggctagcgtgaagaaagacctgatctcttacggaggcggctggagactccaggggtcctggaataccggagaggaggtgcaggttattgccgtcgaacccggcaagaaccctaaaaatgtgcaaacagcgcccgggacctttaagacaccggagggagaagtgggcgctatcgccctggatttcaagcctgggacgagcggatctcccattgtcaaccgcgagggcaaaatcgtgggcctctatgggaatggagttgtgaccacatccggcacctacgtcagcgccatcgctcaggccaaggcgtcccaggaagggcctctgcccgagattgaggacgaagtgtttcggaaaagaaaccttaccatcatggatctgcaccccggatctggcaagacacgccggtatctgcctgctattgttagagaggccatcaaacgcaagctccggacgctgattcttgccccgaccagagtggtcgctagcgaaatggccgaggctctgaaggggatgcccatccgctaccaaacaaccgccgtgaaatccgaacatacaggcaaggagatcgttgacctcatgtgccacgcgaccttcacgatgcggctgctgagccctgtgagagtccccaattataacatgattatcatggatgaggcccattttacagacccttcttccattgctgcccggggatacatcagcacccgcgtgggcatgggggaagctgccgccattttcatgaccgctacaccccctggatctgtggaggcgtttccgcagagcaatgccgtcatccaggatgaagagagagacatccccgaacggtcctggaactctggctatgagtggattaccgatttccctgggaaaacagtttggtttgtgcccagcatcaagtccggaaatgacattgctaactgtctccgcaaaaatggcaagagagtgatccagctttctcggaagaccttcgatacggagtaccagaaaaccaagaacaacgactgggactacgtcgtgaccacagatattagcgaaatgggggccaatttcagagccgaccgcgttatcgatcctcggagatgcctgaaacccgtgattctgaaggacggcccggagcgcgtcatcctcgctggacctatgcccgtgaccgttgcctccgcggctcagcggagaggccgcatcgggcggaaccacaataaagaaggagatcagtatatttacatgggccagcccctgaacaatgacgaggatcatgcccactggacggaggccaagatgcttctggacaacatcaatacccctgaagggattatccccgctctctttgagcctgaaagagaaaagagcgccgcgattgatggagaatatcgcctgagaggcgaggcccggaaaacattcgtggagctgatgcgcagaggggacctcccggtctggctttcttacaaggtggcttccgaaggctttcaatatagcgatcggcgctggtgcttcgacggagagagaaacaatcaggtcctggaagagaacatggatgtggaaatctggaccaaagagggcgagcggaagaaactgagaccccgctggctcgacgcccggacatactccgaccctctggctcttagagaatttaaggagttcgccgctgggcgccggtctgttagcggagatctgatcctcgaaattggcaaactgccccagcacctgacccagagagcccaaaatgcgctcgacaaccttgtgatgctgcataattccgagcaagggggacgggcctatcgccacgctatggaggaactgcctgatacaatcgagaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggaaccccattggattgctgcgtccatcatcctggagtttttccttatggtcctgctcattccggaacctgaccggcagcgcacaccccaggataaccaactggcctacgtggttatcggactgctctttatgattcttacagtggctgccaatgagatgggcctgctggagaccacaaagaaagacctcgggatcggacacgtcgccgtggaaaaccaccatcacgctgccatgctggatgtcgaccttcatcctgcgagcgcctggacgctgtacgctgtggccaccacaattatcacccccatgatgagacacacaattgagaacaccacggctaatatctctctcaccgccatcgcgaaccaggccgctattctgatgggcctggataagggctggcctatctccaaaatggacattggggttcccctccttgccctgggatgctatagccaggtgaatccgctgacactcaccgctgccgtcctgatgcttgtggctcattacgccatcattggccctgggctgcaagcgaaggccacacgggaagctcagaaacgcaccgccgctggaatcatgaagaaccccacggttgatggcatcgtggccattgacctcgatcccgtcgtgtatgacgccaagttcgagaaacagctggggcagatcatgctgctcattctttgtacatctcaaatcctgctgatgagaaccacatgggcgctctgcgaaagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgagacacttggcgaaaagtggaaacggcagctgaatcagctgtccaagtctgagtttaacacctataagagaagcgggattatggaagttgaccgctccgaggcgaaagaaggactcaagcggggcgagacgacaaaacacgccgtctctagagggaccgctaagctgcgctggttcgtggagcggaatcttgtgaaacccgaaggaagagtcatcgatctgggctgtgggcgcggaggctggagctactattgcgccggcctcaagaaggttaccgaggtgaaagggtacacaaagggaggccctgggcacgaggagcccattcctatggctacctacggatggaacctggtgaaactgcattccggcaaggacgtctttttcattccccctgaaaaatgtgatacactcctttgcgacattggggagtctagcccgaatcccacgatcgaggaaggacggaccctgagagtgctgaagatggttgagccttggctccgcggcaaccaattttgtattaaaatcctgaatccctatatgccttccgtggtcgaaacacttgagcagatgcagcggaagcacggcgggatgctggtgagaaaccccctcagccgcaattctacccatgagatgtactgggtttcctgcggaacaggcaacatcgtgagcgccgtcaatatgacctctcggatgctgctgaacagattcacgatggcgcaccgcaagccgacctatgaaagagatgtggacctcggggccggaacacggcacgtggctgtcgagcctgaagttgccaacctggatattatcggccagcgcattgagaatatcaaacatgaacacaagtccacctggcattacgacgaggataacccctataaaacatgggcttaccacgggagctatgaggtgaagccctctggatccgccagctccatggtgaatggcgtcgtgaaacttctgaccaagccttgggacgttattcccatggtgacacaaatcgctatgaccgatacgacaccttttggccagcagagagtcttcaaggaaaaagtggacacccggaccccgaaggccaaaagagggacagcgcaaatcatggaggttacggccaagtggctctggggatttctgagccggaacaaaaagccccgcatttgtaccagagaagagttcacacggaaggtgcgctctaatgctgccatcggcgctgtctttgtggacgaaaaccagtggaatagcgccaaagaggccgttgaggatgaaagattctgggaccttgtgcatcgggagcgcgaactgcacaagcaggggaaatgcgcgacctgcgtctacaacatgatgggaaagagagagaaaaagctcggcgaatttgggaaggctaaaggctcccgggccatttggtacatgtggctgggagcccgcttcctggagttcgaggctctcggctttatgaatgaagatcactggttctctagagagaacagcctgtccggggtggaaggagagggccttcataagctggggtatatcctccgggacatttctaaaatccctggaggcaatatgtacgccgatgacacagctgggtgggatacccgcatcacagaggacgatctgcagaacgaagccagaattaccgacatcatggagcccgaacacgcgcttctggccaagagcatttttaaactcacgtatcaaaataaggtcgtgcgggttcagcgccctgctaaaaacggcaccgtgatggatgtcatctccagacgggaccagagaggatctggccaggtggggacatacggactgaataccttcacaaacatggaggcccaactgattcgccagatggaaagcgagggcatcttttcccccagcgagctcgaaaccccgaacctggctgagcgggtgcttgattggctggaaaagtatggggttgagagactcaagcgcatggccatctctggagacgactgtgtggtcaaacctattgatgaccggttcgcgacggccctgacagctcttaatgatatgggcaaggtgagaaaagacatcccccagtgggaaccttccaaggggtggaacgattggcagcaagttcccttttgcagccatcacttccaccagctgattatgaaagacggccgcgagatcgtggtcccttgtcggaatcaggatgagctcgtgggcagagcccgcgtctctcagggcgctgggtggtccctgcgggaaaccgcctgcctgggaaagagctacgctcaaatgtggcagctcatgtattttcatagacgcgacctgcggcttgccgcgaacgccatttgttccgctgtgcccgttgattggatcccgacatctagaaccacgtggagcattcacgcccatcaccagtggatgaccacagaggacatgctgtccgtgtggaatcgggtctggatcgaagagaacccttggatggaagataagacccatatcagctcttggggcgacgtgccctacctcgggaaaagagaggaccaatggtgcggatccctgattggccttacagcccgcgctacctgggccacaaatatccaggttgcgattaaccaggtgcggagactgatcgggaatgagaactacctcgattatatgaccagcatgaagcgcttcaaaaatgaatctgaccccgagggcgctctgtggtga

SEQ ID NO: 19162 - RNA, 9879 nt, synthetic construct
  misc_feature 1..9879: note = derived and/or modified CDS sequence (opt5) from DENV-1__HM181963__SS-prME
  source 1..9879: mol_type = other RNA
agcgtgaccatgctgctgatgctgatgcccacagcccttgctttccacctgacgacccggggaggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaattggcgagcacagacgggacaagcgctctgtcgccctcgctcctcatgtggggctgggactggagaccagaacagaaacctggatgagctccgagggcgcctggaaacagatccagcgggttgaaacgtgggctctccgccaccccggctttacagtgattgccctgttccttgcgcatgccatcgggacctctatcacacagaagggaattatctttattctgctcatgctggtcacccctagcatggctatgagatgcgtgggcatcgggtcccgggatttcgttgagggacttagcggcgccacctgggtggacgtcgtgctggagcacgggtcttgtgtgacaacgatggctaaggataaacccaccctcgacattgaactgctgaagacagaggtcaccaaccctgccgttctccgcaaactgtgcatcgaagcgaagatttccaatacaaccacggatagcagatgtccgacacaaggagaggccacccttgtggaggaacaggacgctaactttgtgtgccggcgcaccttcgtcgatagaggctggggcaatgggtgtggactgtttggcaaagggtctctcatcacatgcgccaagttcaagtgcgtgaccaaactggagggaaagatcgttcagtacgaaaaccttaaatattccgtgattgtcacagtgcacacgggcgaccagcatcaagttgggaatgagagcaccgaacacggaacaaccgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgccaggaccttctggtgacctttaaaacagcgcacgccaagaagcaggaagtcgtggttctcggatcccaagagggcgctatgcacaccgccctgaccggggccacagaaatccagacgagcggaaccacaaccattttcgctggccatctgaaatgcagactcaagatggataaactgacacttaaggggatgtcttatgtgatgtgtaccggctccttcaaactggagaaggaagtcgccgagacgcagcacggaacagtgctcgttcagatcaagtacgagggcaccgacgcgccgtgcaaaatcccttttagcacccaagatgaaaagggggtgacacagaacggacggctgattaccgctaatcccatcgtcacagacaaagagaagcctgtgaacattgaagccgagccgcccttcggcgagtcttatatcgtgattggggttggagaaaaagccctgaaacttagctggtttaagaaaggctcctctatcgggaagatgttcgaggctacggccagaggcgctcgccggatggccatcctcggagataccgcgtgggactttggcagcattgggggagtcttcacatccgtgggcaaactggtgcatcagatctttgggaccgcctacggagtcctgttcagcggcgtgtcttggacaatgaagattgggatcggcgttctcctgacctggcttggactcaattccagaagcacgtctctctccatgacctgtattgctgtgggcctggtcacactgtaccttggggtgatggttcaggccgatagcggatgcgtgatcaactggaaaggccgcgaactcaagtgtgggtccggaatttttgtcaccaatgaggtgcacacatggaccgaacaatataagttccaggctgactctcctaaacggctgagcgccgcgatcggcaaggcctgggaggagggggtttgcggcatcagatccgctacacgcctggaaaacattatgtggaaacagatctctaacgagctcaatcatattctgcttgaaaacgacatgaagctgaccgtggtcgtgggagatgtggccggcatcctcgctcaggggaaaaagatgattcggccgcaacccatggagtacaaatatagctggaagtcctggggaaaggccaaaatcatcggcgccgacgtccagaatacgacatttattatcgatgggcctaacacccccgaatgtcctgacgatcagagagcttggaatatttgggaggttgaggactacggattcggcatctttaccacaaacatttggctgaagctgcgcgatagctatacccaggtgtgcgaccaccggcttatgtctgcggccatcaaagattccaaggctgtgcacgccgacatgggctactggatcgaaagcgagaaaaatgaaacgtggaagctcgccagagcttctttcattgaggtcaagacatgtatctggcccaaatcccataccctgtggagcaacggggtgctggaatctgagatgattatcccgaagatttatggaggccctatcagccaacacaattaccgccccgggtacttcacacagaccgccggaccttggcatctcggcaaactggagcttgattttgacctgtgcgaagggacaaccgttgtggtcgatgagcactgcggaaaccggggcccctccctcagaacgaccacagtgaccggcaagatcattcacgaatggtgttgccggagctgtacactgcctcccctgcgcttcaaaggggaggacggatgctggtatggcatggagatcagaccggttaaggaaaaggaggaaaatcttgtgaaatctatggtctccgcggggagcggagaggtggactccttttctctcggcctgctgtgtattagcatcatgattgaagaggttatgcggtccagatggtctcgcaagatgctcatgaccgggacgctggctgtgttctttcttctgatcatgggacagctcacatggaacgatctgattcggctgtgcatcatggtcggcgccaatgccagcgacagaatgggcatggggaccacataccttgctctgatggccaccttcaaaatgcgccctatgtttgcggtgggactcctgttcagacggctcacctcccgcgaggtgctgcttctgacaatcggcctctctctggtcgctagcgttgaactgcccaactcccttgaggaactgggggatggactcgccatgggcattatgatcctgaagctcctgacggactttcaaagccatcagctttgggccaccctgctctctatgacattcattagaaccacattttccctgcactatgcttggaaaaccatggccatggtgctgagcatcgtgtctcttttccccctgtgtctctccacgacaagccagaagaccacctggctgcctgtcctcctggggtctcttggatgcaagccgctgacaatgtttctgattgctgagaataaaatctggggccggaagtcctggcccctcaacgaaggcatcatggccgtggggattgttagcatcctgctttccagcctgctcaaaaacgatgtgcctctggcgggacccctcattgccggcgggatgctgatcgcttgttacgtcatttctggaagctccgccgacctttctctggagaaggctgccgtggttagctgggaggaagaggccgaacattccggcgcttctcacaatatcctggtggaggtccaggatgacgggaccatgaaaatcaaggatgaagaaagagacgatacactcacgattctgcttaaagcgaccctgctcgccgtgagcggagtctatcctctgtccatccccgctacactcttcgtgtggtacttctggcaaaagaagaaacagagatctggcgttctgtgggacaccccttcccctcccgaggtggaacgggccgtccttgatgacggcatttatcgcatcatgcagagagggctgctgggacggtcccaggtgggcgttggggtgtttcaagagaacgtcttccatacaatgtggcacgtgacccgcggagccgtgctcatgtaccagggcaagagactggaacccagctgggcttctgttaaaaaggaccttatttcctacgggggaggctggcggctgcagggcagctggaatacgggggaggaggtccaggtgatcgccgtggaacccggcaagaatcctaagaatgtccaaaccgcgcccggcacatttaagacctctgagggggaagtgggagctattgccctcgatttcaaaccgggcacatccgggagccctatcgttaacagagagggaaaggtggtcggcctgtatggcaatggggtggttaccacatccggaacgtacgtgtctgccatcgctcaggccaaagcgagccaggaaggccccctccctgagattgaggacgaagtctttcgcaagcggaacctgaccatcatggatcttcaccccgggtccggaaaaacaagacgctatctgcccgctattgtgcgggaggccatcaagagaaagctgcgcaccctcattctggcccctacccgggttgtggctagcgaaatggccgaggctcttaaaggcatgccgatcagataccaaacaacggccgtcaagtctgaacataccgggaaagagatcgtggacctgatgtgccacgcgacattcaccatgcgcctcctgtcccccgtgcgggtccctaattataacatgattatcatggatgaggcccattttacagaccccagctctattgctgccagaggctacatcagcacccgggttggaatgggcgaagctgccgccattttcatgacggctacacctcccgggtccgtggaggcgtttcctcagtctaatgccgtgatccaggatgaggaacgcgacatcccggaaagaagctggaactccggatatgagtggattaccgatttccccggcaagaccgtctggtttgtgccttctatcaaaagcgggaatgacattgctaactgtctgcggaagaatggaaagcgcgttatccagctctccagaaaaacattcgataccgagtaccaaaagaccaagaacaacgactgggactacgtggtcaccacggatattagcgaaatgggcgccaatttccgggccgacagagtgatcgatccccgccggtgccttaagcctgttattctgaaagacgggcccgagagagtgatcctggctggcccgatgcctgtcacagtggcctctgcggctcagcgccggggaagaatcggccgcaaccacaataaggaaggggatcagtatatttacatgggacagcccctcaacaatgacgaggatcatgcccactggaccgaggccaagatgctgcttgacaacatcaatacacccgaaggcattatccctgctctgtttgagcccgaacgggagaaatccgccgcgattgatggggaatatagactccgcggagaggccagaaagaccttcgtcgagctgatgcggcgcggcgacctgcctgtgtggctcagctacaaagttgcttccgaagggtttcaatattctgatagacggtggtgcttcgacggcgagcgcaacaatcaggtgcttgaagagaacatggatgtggaaatctggacgaaggagggagagcgcaagaagctgcggccgagatggctggacgcccgcacctacagcgaccccctcgctctgcgggaatttaaagagttcgccgctggcagacgctccgtctctggggatcttatcctggaaattggaaagctccctcagcacctgacacagcgggcccaaaatgcgctggacaacctcgttatgcttcataatagcgagcagggcgggagagcctatcggcacgctatggaggaactgcccgataccatcgagacactgatgctcctggcccttattgctgtgctgaccggaggcgtgacactctttttcctgtccggccgcgggctgggaaagaccagcatcggcctcctttgtgtcatggcctcttccgtgctgctgtggatggccagcgttgaacctcattggattgctgcgtctatcatcctcgagtttttcctgatggtgcttctgattcccgaaccggacagacagcggacgcctcaggataaccaactcgcctacgtcgtgatcgggctgctgtttatgattctcacagtcgctgccaatgagatgggacttctggagaccaccaaaaaggacctgggcatcgggcacgtggccgttgaaaaccaccatcacgctgccatgctcgatgtggacctgcatcccgcgtccgcctggacactttacgctgtcgccaccacaattatcacgcctatgatgcgccacaccattgagaacacaaccgctaatatcagcctgacagccatcgcgaaccaggccgctattctcatgggactggataaaggctggcccatctctaagatggacattggcgtgcctctgctcgcccttgggtgctatagccaggttaatcccctgaccctgacggctgccgtgctcatgctggtcgctcattacgccatcattggaccgggccttcaagcgaaagccaccagagaagctcagaagcggacagccgctgggatcatgaagaaccctaccgtggatggaatcgtggccattgacctggatcccgttgtctatgacgccaaattcgagaagcagctcggccagatcatgctgctgattctctgtacatcccaaatccttctgatgcgcaccacgtgggcgctgtgcgaatctattacactcgctaccgggcccctgacaaccctttgggagggaagccctggcaaattttggaataccacaatcgccgtgtccatggctaacatcttcagaggcagctacctggccggggccggactcgctttctccctgatgaagtctctgggcgggggacggcgcggcacgggggcccagggagagaccctcggcgaaaaatggaagagacagcttaatcagctgagcaagtccgagtttaacacatataaacggtctggcattatggaagtggacagaagcgaggcgaaggaagggctgaaacgcggagagaccacaaagcacgccgtctcccggggcaccgctaaactcagatggttcgttgagcgcaatctggtgaagccggaagggaaggtgatcgatcttggatgtggcagagggggatggtcttactattgcgccggcctgaaaaaggtcacggaggtgaaaggctacacaaaagggggacccggccacgaggagcctattcccatggctacctacgggtggaacctcgttaaactgcatagcggaaaggacgtgtttttcatccctcccgaaaaatgtgataccctgctctgcgacattggcgagtccagccctaatccgacaatcgaggaagggagaacccttcgcgtcctgaagatggtggagccctggctgcggggaaaccaattttgtattaagatcctcaatccttatatgccctctgttgtggaaacactggagcagatgcagagaaaacacggcggcatgcttgtccgcaaccctctgtcccggaatagcacgcatgagatgtactgggtgtcttgcgggaccggaaacatcgtgtccgccgtcaatatgacaagcagaatgctcctgaaccgcttcaccatggcgcaccggaagcccacatatgaaagagatgttgacctgggcgccgggacccgccacgtggctgtggagccggaagtcgccaacctcgatattatcggacagagaattgagaatatcaaacatgaacacaagtctacgtggcattacgacgaggataacccttataaaacctgggcttaccacggctcctatgaggtgaagcccagcgggtccgccagctctatggttaatggagtggtcaagctgcttacaaaaccctgggacgtgattcctatggttacccaaatcgctatgacagataccacaccctttggccagcagcgggtgttcaaggaaaaagtcgacacccgcacgcctaaggccaaaagaggcacagcgcaaatcatggaggtgaccgccaagtggctgtgggggtttctcagccggaacaagaaaccgagaatttgtacccgggaagagttcacacgcaaggttagatccaatgctgccatcggagctgtgtttgtcgacgaaaaccagtggaactctgccaaagaggccgtggaggatgaacggttctgggacctggtccatcgcgagagagaacttcacaagcagggcaaatgcgcgacgtgcgtgtacaacatgatggggaagcgggagaagaaactgggagaatttggcaaggctaaagggagccgcgccatttggtacatgtggctcggcgccagattcctggagttcgaggctctgggatttatgaatgaagatcactggttctcccgggagaactctctcagcggcgttgaaggggagggactgcataaacttggctatatcctgcgcgacatttccaaaatccccgggggaaatatgtacgccgatgacaccgctggctgggatacaagaatcaccgaggacgatctccagaacgaagccaagattacagacatcatggagcctgaacacgcgctgcttgccaaatctatttttaagctgacctatcaaaataaggtggtccgggtgcagcgccccgctaaaaacgggacagtgatggatgttatcagcagacgggaccagcgcggctccggacaggtgggcacctacgggctcaatacgttcaccaacatggaggcccaactgattagacagatggaaagcgagggaatcttttctccttccgagctggaaacacccaacctcgctggccgggccctggattggcttgagaagcatggggtcgaaagactgaaacgcatggcgatcagcggagacgactgtgtggttaagccgattgatgaccggttcgccaccgctctcacagccctgaatgatatgggcaaagtgagaaaggacatccctcagtgggagccctctaaggggtggaacgattggcagcaagtccctttttgctcccaccacttccatcagcttattatgaaagacggccgcgaaatcgtggtcccctgtcggaatcaggatgagctggtgggcagagctcgcgttagccagggagccgggtggtccctccgggagaccgcttgcctgggaaagtcttatgcccaaatgtggcagctgatgtactttcacagacgcgacctccggctggcggccaacgctatttgtagcgccgtgcctgtcgattgggtgcccacgtccagaacaacctggagcatccatgcccaccatcagtggatgacaaccgaagacatgctttctgtttggaatcgcgtgtggattgaggaaaacccgtggatggaggataaaacgcacatctccagctggggcgacgtcccttatctggggaagcgggaagaccaatggtgcggatctctcatcggcctgaccgctagagccacatgggcgaccaatattcaggtggctatcaaccaggtgcggagacttctggggaatgagaactacctcgattacatgacaagcatgaaacgcttcaagaatgagtccgaccccgaaggcgccctgtggtga

SEQ ID NO: 19163 - RNA, 9879 nt, synthetic construct
  misc_feature 1..9879: note = derived and/or modified CDS sequence (opt5) from DENV-1__HM181964__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagagcaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattaccccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagcccccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattccggggggaggacggatgctggtatggcatggagattagaccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcatcatgattctgaagctcctgaccgactttcaatcccatcagctttgggccacactgctcagcctgaccttcatcaaaacgacattttctctgcactgtgcttggaagaccatggccatggttctttccattgtgagcctgttccccctctgcctgtctaccacatcccagaaaaccacatggctccctgtgctgcttgggagcctgggatgtaagccgctgacgatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgctatgtgatcagcggatctagcgccgacctgtccctggagaaggctgccgaggtctcttgggaagaggaagccgagcatagcggcgcttcccacaatattctcgtggaagttcaggatgacgggaccatgaaaatcaaggatgaggagcgggacgatacactgaccatccttctgaaagcgacactcctggccgtgtctggagtctaccctctcagcattcccgctaccctgttcgtgtggtatttctggcaaaagaaaaagcagcgctccggcgtcctttgggacacgccttctcccccggaagtggagagagccgttctggatgacggcatctaccggattatgcagcgcgggctgctcggaagaagccaggtgggcgtcggggtgtttcaagaaaacgttttccataccatgtggcacgtgacacggggagccgtcctgatgtatcagggcaagagacttgagccttcctgggctagcgtgaaaaaggacctgatctcttacgggggaggctggcgcctccagggctcctggaataccggggaggaagtgcaggttattgccgtcgagcccggaaaaaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctacggcaatggggttgtgaccacatccggaacctatgtcagcgccatcgctcaggccaaagcgtcccaggagggccctctgcccgagattgaagacgaggtgtttagaaagcgcaaccttaccatcatggatctgcaccccgggtctggaaaaacacggagatacctgcctgctattgttcgcgaagccatcaagcggaaactcagaacgctgattcttgccccgacccgcgtggtcgctagcgagatggccgaagctctgaagggcatgcccatccggtatcaaacaaccgccgtgaagtccgagcatacagggaaagagatcgttgacctcatgtgtcacgcgaccttcacgatgagactgctgagccctgtgcgggtccccaattacaacatgattatcatggatgaagcccattttacagacccttcttccattgctgcccgcggctatatcagcaccagagtgggaatgggcgaggctgccgccattttcatgaccgctacaccccctgggtctgtggaagcgtttccgctcagcaatgccgtcatccaggatgaggaacgggacatccccgagcgctcctggaactctggatacgagtggattaccgatttccctggcaagacagtttggtttgtgcccagcatcaaatccgggaatgacattgctaactgccttagaaagaatggaaaacgggtgatccagctgtctagaaagaccttcgatacggaatatcagaagacaaaaaacaacgactgggactacgtcgtgaccacagatattagcgagatgggcgccaatttccgcgccgaccgggttatcgatcctagacgctgcctgaagcccgtgattctcaaagacgggccggaacgggtcatcctggctggccctatgcccgtgaccgttgcctccgcggctcaaagacgcggacggatcggcagaaaccacaataaggagggggatcagtacatttatatgggacagccccttaacaatgacgaggatcatgcccactggacggaagccaaaatgctgctcgacaacatcaatacccctgagggcattatccccgctctgtttgaacctgagcgcgaaaagagcgccgcgattgatggggagtacagactgcggggagaggcccgcaagacattcgtggaactcatgagacggggcgaccttccggtctggctgtcttataaagtggcttccgaggggtttcagtacagcgatcgcagatggtgtttcgacggcgaacggaacaatcaagtcctggaggaaaacatggatgtggagatctggaccaaggagggagaaagaaaaaagctccgcccccggtggctggacgccagaacatattccgaccctcttgctctgcgcgagtttaaagaattcgccgctggccggagatctgttagcggggatctcatcctggagattggaaagctgccccagcacctcacccagcgggcccagaatgcgcttgacaacctggtgatgctgcataattccgaacaaggcgggcgcgcctacagacacgctatggaggagctccctgatacaatcgaaaccctgatgcttctggccctcattgctgtgctgacgggaggcgtcacactgtttttcctctctggccgggggcttggaaaaaccagcatcggcctgctgtgcgttatggcctccagcgtgctcctgtggatggcctctgtggagccccattggattgctgcgtccatcatccttgaatttttcctgatggtcctcctgattccggagcctgacaagcagcgcaccccccaggataaccagctggcctatgtggttatcgggctcctttttatgattctgacagtggctgccaatgagatgggactgctcgaaaccacaaagaaagacctgggcatcgggcacgtcgccgtggagaaccaccatcacgctgccatgcttgatgtcgacctgcatcctgcgagcgcctggacgctctacgctgtggccaccacaattatcacccccatgatgagacacacaattgaaaacaccacggctaatatctctctgaccgccatcgcgaaccaagccgctattctgatgggactcgataagggctggcctatctccaaaatggacattggcgttccccttctggccctggggtgttacagccaggtgaatccgctcacactgaccgctgccgtccttatgctggtggctcattatgccatcattggacctggcctccaggcgaaggccacacgggaggctcaaaaacgcaccgccgctgggatcatgaagaaccccacggttgatggaatcgtggccattgacctggatcccgtcgtgtacgacgccaagttcgaaaaacagctgggccagatcatgctccttattctgtgcacatctcagatcctgctcatgagaaccacatgggcgctgtgtgagagcattacccttgctaccgggcctctgacaacgctctgggagggatccccgggcaagttttggaataccacaatcgccgtgtctatggctaacatcttccggggcagctatctggccggggccggactggctttctccctcatgaaaagccttggcgggggacgcagaggcaccggggcccaaggagaaacactgggcgagaagtggaaacggcagctgaatcagctctccaagtctgaatttaacacctacaagagaagcggcattatggaggttgaccgctccgaagcgaaagaggggctgaagcggggagagacgacaaaacacgccgtctctagaggcaccgctaagcttcgctggttcgtggaacggaatctggtgaaacccgaggggaaggtcatcgatctcggatgcggcagagggggatggagctattactgtgccggcctgaagaaagttaccgaagtgaagggctatacaaaagggggacctggccacgaggaacccattcctatggctacctacgggtggaacctggtgaagctccattccggaaaagacgtctttttcatcccccctgagaagtgcgatacacttctgtgtgacattggcgagtctagcccgaatcccacgatcgaagaggggcgcaccctgcgggtgctcaaaatggttgaaccttggctgagaggaaaccagttttgcattaagatccttaatccctacatgccttccgtggtcgagacactggagcaaatgcagcgcaagcacggcggcatgctcgtgcggaaccccctgagcagaaattctacccatgaaatgtattgggtttcctgtgggacaggaaacatcgtgagcgccgtcaatatgacctctcgcatgctgctcaaccggttcacgatggcgcacagaaaaccgacctacgagcgcgatgtggacctgggcgccgggacaagacacgtggctgtcgaacctgaggttgccaaccttgatattatcggacagcggattgaaaatatcaagcatgagcacaaatccacctggcattatgacgaggataacccctacaagacatgggcttatcacggcagctacgaagtgaaaccctctgggtccgccagctccatggtgaatggagtcgtgaagctgctcaccaagccttgggacgttattcccatggtgacacagatcgctatgaccgatacgacaccttttggccaacagcgcgtcttcaaagagaaggtggacaccagaaccccgaaagccaagcggggcacagcgcagatcatggaagttacggccaaatggctgtgggggtttcttagcagaaacaagaagccccggatttgcacccgcgaggaattcacaagaaaagtgcggtctaatgctgccatcggagctgtctttgtggacgagaaccaatggaatagcgccaaggaggccgttgaagatgagcgcttctgggacctggtgcatagagaacgggagctccacaaacagggcaagtgcgcgacctgtgtctataacatgatggggaaacgcgaaaagaagctgggagagtttggcaaagctaaggggtccagagccatttggtacatgtggctgggcgcccggttcctcgagttcgaagctctgggatttatgaatgaggatcactggttctctcgcgaaaacagcctttccggcgtggagggggagggactgcataaactcggctacatcctgagagacatttctaagatccctgggggaaatatgtatgccgatgacacagctggctgggatacccggatcacagaagacgatcttcagaacgaggcccgcattaccgacatcatggaacccgagcacgcgctgctcgccaaaagcatttttaagctgacgtaccagaataaagtcgtgagagttcaacggcctgctaagaacgggaccgtgatggatgtcatctcccgcagagaccagcggggctctggacaggtgggcacatatgggctgaataccttcacaaacatggaagcccagctcattagacaaatggagagcgagggaatcttttcccccagcgaactggagaccccgaaccttgctgaacgcgtgctggattggctcgagaagtacggcgttgaacggctgaaaagaatggccatctctggggacgactgcgtggtcaagcctattgatgaccgcttcgcgacggcccttacagctctgaatgatatgggaaaagtgcggaaggacatcccccagtgggagccttccaaaggctggaacgattggcagcaggttcccttttgtagccatcacttccaccaactcattatgaaggacgggagagagatcgtggtcccttgccgcaatcaggatgaactggtgggccgggccagagtctctcagggagctggctggtccctgcgcgagaccgcctgtctcgggaagagctatgctcagatgtggcaactgatgtactttcatcggagagaccttcgcctggccgcgaacgccatttgctccgctgtgcccgttgattggatcccgacatctcggaccacgtggagcattcacgcccatcaccagtggatgaccacagaagacatgctctccgtgtggaatagagtctggatcgaggaaaacccttggatggaggataaaacccatatcagctcttggggagacgtgccctatctgggcaagcgggaggaccagtggtgtgggtcccttattggactgacagccagagctacctgggccacaaatatccaagttgcgattaaccaggtgcgccggctcatcggcaatgaaaactacctggattacatgaccagcatgaaaagattcaagaatgagtctgaccccgaaggggctctgtggtga

SEQ ID NO: 19164 - RNA, 9879 nt, synthetic construct
  misc_feature 1..9879: note = derived and/or modified CDS sequence (opt5) from DENV-1__HM181966__SS-prME
  source 1..9879: mol_type = other RNA
agcgtgaccatgctgctcatgctgatgcccaccgcccttgctttccacctgacgacccggggcggggagcctcatatgatcgtgacaaagcaggaacggggaaagtccctcctgtttaagacctctgttggcgtgaatatgtgcacacttattgccatggacctgggggagctctgtgaagataccatgacatacaagtgccccagaatcaccgaggccgaacccgacgatgtggactgttggtgcaatgctacggatacctgggtcacatatggaacctgtagccaaacaggcgagcacagacgggacaagcgctccgtggccctggcccctcatgttgggctgggactcgagaccagaacggaaacatggatgtctagcgagggcgcttggaaacagattcagcgggtggaaacctgggccctgcgccaccccggcttcacagtcatcgctctttttctggcccatgcgattgggacctccatcacccagaagggaatcattttcatcctcctgatgcttgtgacaccttctatggccatgagatgcgttggcattgggagccgggattttgtggagggactgtccggcgctacgtgggtcgacgtggtgctcgagcacgggagctgtgtcaccacaatggccaaggataaacccaccctggacatcgaactgctcaagacagaggttaccaaccctgctgtgctgcgcaaactttgcattgaagccaagatctctaatacgacaaccgattccagatgtccgacccaaggagaggcgacactgatggaagaacaagacgccaacttcgtgtgccggcgcacctttgtcgatagaggctggggcaatgggtgtggactcttcggcaaagggagcctgattacatgcgctaagtttaagtgcgtgacgaaacttgagggaaagatcgttcagtacgaaaacctgaaatattctgtgatcgtcaccgtgcacacaggcgaccagcatcaagttgggaatgagtccaccgaacacggaacaaccgccacgattacaccccaggctcctacaagcgagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaagtcgctgagacccagcacggaaccgtgctggttcagattaagtacgagggcacagacgccccgtgcaaaatccctttctccaccctggatgaaaagggggtgacacaaaacggacggcttatcacggcgaatcccattgtcaccgacaaagagaagcctgtgaacatcgaagctgagccgccctttggcgagagctatattgtgatcggggccggagaaaaagccctcaagctgtcttggttcaagaaaggcagctccattgggaagatgtttgaggctacagccagaggcgctcgccggatggccatcctgggagataccgcgtgggacttcggctctatcgggggagtttttacaagcgtcggcaaactcgtgcatcagattttcgggaccgcctacggagtgctgttttccggcgtcagctggacgatgaagatcgggattggcgtgcttctgacctggctcggactcaattctagatccacaagcctgtctatgacctgtatcgctgttggccttgtgacactctacctgggggtcatggtgcaggccgattccggatgcgttattaactggaaaggccgcgaactgaagtgtgggagcggaatcttcgtgaccaatgaggtccacacatggaccgaacagtataagtttcaagctgactcccctaaacggctctctgccgcgattggcaaggcctgggaggagggggtgtgcggcatcagaagcgctacgcgcctggaaaacatcatgtggaaacagatttccaacgagcttaatcatatcctgctcgaaaacgacatgaagttcacagttgtggtcggagatgtggtgggcattctggcccaggggaaaaagatgatccggccgcagcccatggagcacaaatactcttggaaaagctggggaaaggctaagattatcggcgccgacgtccaaaataccacctttatcattgatgggcctaacacacccgaatgtcctgacgatcagagagcctggaatatctgggaggttgaggactatggattcggcatttttaccacgaacatctggctgaaacttcgcgattcctacacacaggtgtgcgaccaccggctcatgagcgctgcgattaaagattctaaggccgtgcatgctgacatgggctattggatcgaatccgagaaaaatgaaacctggaagctggccagagccagcttcatcgaggtcaagacatgtatttggcccaaatctcacaccctgtggtccaacggggtgctcgaaagcgagatgatcattccgaagatctacggaggccctatttctcagcataattatcgccccgggtacttcacacaaaccgctggaccttggcacctgggcaaacttgagctggattttgacctctgcgaagggacgaccgttgtggtcgatgagcactgcggaaaccggggccccagcctgagaacaaccacagtgaccggcaagatcatccatgaatggtgttgccggtcctgtacgctgcctccccttcgcttcaaaggggaggacggatgctggtacggcatggagattagaccggttaaggaaaaggaggaaaatctcgtgaaaagcatggtctctgccgggtccggagaggtggacagcttttccctgggcctgctctgtatctctattatgatcgaagaggttatgcggagcagatggtcccgcaagatgctgatgacagggacccttgcggtgttcctgctcctgattatgggacagctgacatggaacgatcttatccggctgtgcattatggtcggcgctaatgcctctgacagaatgggcatggggaccacctatctcgccctgatcgctacatttaaaatgcgccctatgttcgccgtgggactcctgtttagacggcttacgagccgcgaggtgctgctcctgaccatcggcctgtcccttgtcgcgtctgttgaactgcccaacagcctcgaggaactgggggatggactcgctatgggcattatgatcctgaaacttctgacagacttccagtcccaccaactctgggccaccctgctgagctttacattcattaaaaccacgctttctctgcattacgcctggaagacaatggctatggtgctctccatcgtgagcctgtttcccctctgtctgtctaccacctcccagaagacaacctggcttcctgtcctgctggggagcctcggatgcaaaccgctgacaatgttccttattgccgagaataagatctggggcagaaaatcttggcccctgaacgaaggcatcatggctgtgggggttgtgtccattctcctgagctccctcctgaagaacgatgtccctcttgccggacccctgatcgcgggcgggatgctgattgcctgttatgtgatcagcggatctagcgctgacctctccctggagaaagccgctgaggtttcttgggaagaggaagccgagcacagcggcgcctcccataatattcttgtggaagtccaggatgacgggacgatgaagatcaaagatgaggagcgggacgataccctgacaatcctcctgaaggctaccctcctggcggtgtctggagtctaccctcttagcattcccgccacactgtttgtgtggtatttctggcagaagaaaaagcaacgctccggcgttctgtgggacaccccttctcccccgaaagtggaaagagctgtcctcgatgacggcatctaccggattatgcagcgcgggctgcttggaagaagccaggtgggcgttggggtgttccaggagaacgtctttcacacgatgtggcacgtgacccggggagccgtgctgatgtatcaaggcaagcgcctcgaaccttcctgggccagcgttaaaaaggacctgatctcttacgggggaggctggagactccagggctcctggaatacaggggaggaggtccaggtgattgctgtggaacccggaaagaaccctaaaaatgtccagaccgcccccggcacattcaagaccagcgagggggaagtgggagcgatcgctctggattttaaaccgggcacatctgggtcccctattgttaaccgggagggaaagatcgtgggcctttacggcaatggggtcgtgacgaccagcggaacatatgtttccgccatcgcccaagctaaagcctctcaggaaggccccctgcctgagattgaggacgaagtgttcagaaagcgcaacctgaccatcatggatctccatcccgggagcggaaagacccggagatacctgcccgcgattgtccgcgaggctatcaaacggaaacttagaacactgattctcgcccctacgcgcgtggttgcctccgaaatggctgaggccctgaaaggcatgccgatccggtatcagaccacagctgtcaagagcgaacacaccgggaaagagatcgtcgacctgatgtgccatgccacatttaccatgagactcctttctcccgtgcgcgtgcctaattacaacatgattatcatggatgaggcgcacttcacggacccctccagcattgccgctcggggctatatctctacaagagtcggaatgggcgaagccgctgccatttttatgaccgccacccctcccgggagcgttgaggctttccctcaatccaatgcggtgatccaggatgaagaacgggacatcccggaacgctcttggaacagcggatacgagtggattacagattttcccggcaagaccgtgtggttcgtcccttccatcaagtctgggaatgacattgccaactgtctgcgcaagaatggaaagcgggtgatccagctgagccgcaaaacatttgataccgagtatcagaagacgaaaaacaacgactgggactacgttgtgacaaccgatatttccgaaatgggcgctaatttcagagccgaccgggtcatcgatcccagacgctgcctcaagcctgtgattctgaaggacgggcccgagcgggttatccttgccggcccgatgcctgtgacagtcgctagcgccgcgcaaagacgcggacggatcggcagaaaccataataaagaaggggatcagtacatttatatgggacagcccctgaacaatgacgaggatcacgctcactggaccgaggccaagatgctcctggacaacatcaatacgcccgaaggcattatccctgccctgttcgagcccgaacgcgagaaatctgctgccattgatggggaataccggctcagaggagaggcgcgcaagacctttgtggagcttatgagacggggcgacctgcctgtctggctgtcctataaagtggccagcgaagggttccagtactccgatcgcagatggtgctttgacggcgagcggaacaatcaagttctcgaagagaacatggatgtggaaatctggacaaaggagggagagcgcaaaaagctgagaccgcggtggcttgacgctagaacctattctgaccccctggccctccgcgagttcaaggagtttgctgccggccggagaagcgtgtccggggatctgatcctggaaattggaaaactccctcagcatcttacacagcgcgctcagaatgccctggacaacctggtcatgctccacaattctgagcaaggcgggcgggcgtacagacatgccatggaggaactgcccgataccatcgagacacttatgctgctcgctctgattgccgttctgaccggaggcgtgacgctgttctttcttagcggccgggggctgggaaagacatccatcggcctgctctgtgtgatggctagctctgccctgctttggatggcctccgtcgaacctcactggattgctgcgagcatcatcctggagttctttctcatggtgctgctgattcccgaaccggaccgccagagaacccctcaggataaccagctcgcctatgttgtgatcgggcttctgttcatgattctgaccgtcgctgccaatgagatgggactcctggagacaaccaaaaaggaccttggcatcgggcacgtggccgtcgaaaaccatcaccatgctacaatgctggatgtggacctccaccccgcctctgcgtggacgctgtacgccgttgctaccacaattatcacccctatgatgcggcatacaattgagaacaccacggccaatatctccctgaccgctatcgccaaccaagcggccattctcatgggacttgataaaggctggcccatcagcaagatggacattggcgtgcctctgctggctctcgggtgctactctcaggtcaatcccctgacacttaccgccgctgtgctgatgctcgttgcccactatgctatcattggaccgggcctgcaggccaaggcgacacgcgaagcccagaagcggaccgctgccgggatcatgaagaaccctacggtggatggaatcgtcgctattgacctggatcccgtggtgtacgacgccaaatttgagaagcagctcggccagatcatgcttctgattctgtgtacaagccagatcctcctgatgcggaccacatgggccctttgcgaatccattaccctggcgaccgggcccctcacaacgctgtgggagggatctcctggcaaattctggaataccacaatcgctgttagcatggccaacatctttcgcggctcctatctggctggggccggactcgccttcagccttatgaagtccctgggcgggggaagacggggcaccggggctcaaggagagacactgggcgaaaagtggaaacgccagctcaatcagctgtctaagagcgagttcaacatttacaaaagatccggcatcatggaagtcgaccggtctgaggccaaggaagggcttaaaagaggagagaccacgcgccacgcggtgagccggggcacagccaagctgagatggtttgtggagcgcaatctcgtcaagccggaagggaaagttattgatctgggatgtggcagaggcgggtggtcctattactgcgctgggctgaagaaagtgaccgaggtgaagggctataccaaagggggacccggccatgaggaacctatccccatggccacatacgggtggaacctcgtcaaacttcactctggaaaagacgtgttctttacccctcccgaaaagtgtgatacactgctgtgcgacattggcgagagctcccctaatccgacgatcgaggaagggagaaccctccgcgttctgaagatggtggagccctggcttcggggaaaccagttctgtattaaaatcctgaatccttacatgcccagcgtcgtggaaacactcgagcaaatgcagagaaagcatggcggcatgctggttcgcaaccctctgtctagaaattccacccacgagatgtattgggtgagctgcgggacaggaaacatcgtctctgctgtgaatatgacctccagaatgctcctgaaccgctttacgatggcccaccggaaacccacctacgaaagagatgtggaccttggcgcggggacacgccatgtcgccgttgagccggaagtggctaacctggatattatcggacagagaattgagaatatcaagcacgaacataaaagcacctggcactatgacgaggataacccttacaagacatgggcctatcatggctcttacgaggtgaagccctccgggagcgcttccagcatggtcaatggagtggttaaactcctgaccaagccctgggacgtgattcctatggtcacacagatcgccatgaccgatacgacacccttcggccaacagcgggtgtttaaagaaaaggttgacacccgcacccctaaagctaagagaggcacagcccagatcatggaggtgacggcgcggtggctttgggggttcctgtctagaaacaagaaaccgcggatttgtacccgcgaagagtttacaagaaaggtccggagcaatgccgctatcggagccgtgttcgttgacgaaaaccaatggaactccgctaaagaggccgtggaggatgaacgcttttgggacctcgtccagaaggagagagaactgcacaaacagggcaagtgcgcgacctgcgtgtataacatgatggggaagcgggagaaaaagctgggagagttcggcaaagcgaaggggtctcgcgctatttggtacatgtggctcggcgccagatttctggagttcgaggcccttggattcatgaatgaagatcactggtttagccgggagaactccctgtctggcgtcgaaggggagggactccataaactgggctacatccttcgcgacattagcaagatccccgggggaaatatgtatgctgatgacacagccggctgggataccagaatcacagaggacgatctgcagaacgaagctaaaattaccgacatcatggagcctgaacacgccctcctggcgacgtccattttcaagctgacctaccaaaataaggtggttcgggtgcagcgccccgccaaaaacgggacagtcatggatgtgatctctagacgggaccagcgcggcagcggacaggtgggcacctatgggctcaatacatttaccaacatggaggctcaactgattagacagatggaatccgagggaatcttccttcctagcgagctggaaacgcccaacctcgccgagcgggttctggattggcttgaaaagtacggcgtggagagactgaaacgcatggctatctctggggacgactgtgtcgtgaagccgattgatgaccggtttgccacagcgctcaccgccctgaatgatatgggaaaagttagaaaggacatccctcagtgggaaccctccaagggctggaacgattggcagcaagtgcctttctgcagccatcactttcaccagctggtcatgaaagacgggcgcgagattgtggtcccctgtcggaatcaggatgagctcgtgggcagagctcgcgtttctcagggagccggctggtccctgcgggaaacagcttgccttggaaagagctatgcccaaatgtggcagctgatgtacttccatagacgcgacctccggctggctgccaacgcgatctgttccgccgtgcctgtcgattgggtgcccacctctagaacgacctggagcattcacgctcatcaccagtggatgacaaccgaggacatgctttccgtttggaatcgcgtgtggatcgaagagaacccgtggatggaagataaaacacatgtcagctcttggggagacgtgccttatctgggcaagcgggaggaccaatggtgcgggtccctcattggactgaccgccagagccacatgggctagcaatatccaggtggccatcaaccaggttcggagactgattggcaatgagaactacctcgattacatgacctctatgaaacgctttaagaatgaaggggaccccgagggcgcgctgtggtga

SEQ ID NO: 19165 - RNA, 9879 nt, synthetic construct
  misc_feature 1..9879: note = derived and/or modified CDS sequence (opt5) from DENV-1__GU131721__SS-prME
  source 1..9879: mol_type = other RNA
tccgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttcctgacacaagatgaaaagggggtgacgcagaacggacggcttatcaccgcgaatcccattgtcacagacaaagagaagcctgtgaacatcgaagctgagccgccctttggcgagtcctatattatcattggggccggagaaaaagccctcaagctgagctggttcaagaaaggctctagcatcgggaagatgtttgaggctaccgccagaggcgctcgccggatggccatcctgggagatacagcgtgggacttcggctccattgggggagtgtttacctctgccggcaaactcgttcatcagatcttcgggacggcttacggagtcctgtttagcggcgtgtcctggaccatgaagattgggatcggcgtgcttctgacatggctcggactgaatagcagatctacctccctgagcatgacatgtattgccgtcggccttgtgaccctctacctgggggttatggtgcaggctgattctggatgcgtcatcaactggaaaggccgcgaactgaagtgtgggtccggaattttcgtgacaaatgaggttcacacctggacggaacaatataagtttcaggccgacagccctaaacggctctccgcggccatcggcaaggcttgggaggagggggtgtgcggcatcagatctgccacacgcctggaaaacattatgtggaaacagatcagcaacgagcttaatcatattctgctcgaaaacgacatgaagttcaccgtcgtggttggagatgtggctggcatcctggcccaggggaaaaagatgattcggccgcaacccatggagtacaaatattcctggaagtcttggggaaaggccaaaatcatcggcgctgacgtccagaataccacatttattatcgatgggcctaacacccccgaatgtcctgacgatcagagagcgtggaatatttgggaggtggaggactacggattcggcatctttacgacaaacatttggctgaaacttcgcgatagctatacccaggtgtgcgaccaccggctcatgtccgccgctatcaaagatagcaaggccgtccacgccgacatgggctactggatcgaatctgagaaaaatgaaacatggaagctggctagagcctccttcattgaggttaagacctgtatctggcccaaaagccatacactgtggtctaacggggtgctcgaatccgagatgattgtgccgaagatctatggaggccctattagccaacacaattaccgccccgggtacttcacccagacggcgggaccttggcatctgggcaaacttgagctggattttgacctctgcgaagggaccacagtcgtggttgatgagcactgcggaaaccggggcccctctctgagaaccacaaccgtgacgggcaagatcatccacgaatggtgttgccggagctgtacactgcctccccttcgcttcagaggggaggacggatgctggtatggcatggagattcggccggtcaaagaaaaggaggaaaatctcgtgaagtccatggttagcgctgggtctggagaggtggactcctttagcctgggcctgctctgtatctccattatcattgaagaggtcatgagatctcgctggagccggaaaatgctgatgaccgggacacttgccgtgttctttctgctcatcatgggacagctgacctggaacgatctgattagactttgcatcatggttggcgccaatgcttccgaccgcatgggcatggggaccacatacctggccctcatggcgacgttcaagatgagacctatgtttgctgtgggactcctgttccggcgcctgacctctagagaggtccttctgctcacaatcggcctgagcctggtggcctccgtggaacttcccaactctctggaggaactcggggatggactggccatgggcattatgatcctcaaactgcttaccgactttcaaagccatcagctgtgggctacactcctgtccctgaccttcattaagacgacatttagccttcactatgcctggaaaaccatggctatggtcctgtctatcgtttccctcttccccctgtgtctcagcaccacatctcagaagaccacatggctgcctgtgcttctggggtccctgggatgcaagccgctcacgatgtttctgattgccgagaataaaatctggggccggcgcagctggccccttaacgaaggcatcatggcggtggggattgtctctatcctgctctccagcctgctcaagaacgatgtgcctctggccggaccccttattgctggcgggatgctgatcgcctgttacgttatttccggaagctctgctgacctgagcctcgagaaagccgccgaggtgtcctgggaagaggaagctgagcattctggcgcgagccacaatatcctggtcgaagtgcaggatgacgggaccatgaagatcaaagatgaggagagagacgatacacttaccattctgctcaaggccacactgctcgctgtttccggagtgtatcctctgtctatccccgccacccttttcgtctggtacttctggcagaagaagaagcagcggagcggcgtgctgtgggacacgcctagccctcccgaagtcgagcgcgccgtgctggatgacggcatttatagaatcatgcagcgggggctcctgggacgctctcaggttggcgtgggggtctttcaagaaaacgtgttccataccatgtggcacgttacaagaggagctgtgcttatgtaccagggcaaacggctggagcccagctgggcctccgtcaagaaagacctcattagctacgggggaggctggagactgcagggctcttggaataccggggaggaagtccaggtgatcgcggttgagcccggaaagaaccctaaaaatgtccaaacagctcccggcacctttaagacaccggaaggggaggtgggagccattgccctcgatttcaagcctggcacgtccgggagccccatcgtgaaccgcgaaggaaaaatcgtcggcctgtatggcaatggggtggttaccacatctggaacctacgtgtccgctattgcccaggcgaaggctagccaggagggccctcttcccgagatcgaagacgaggtctttcggaaaagaaacctgaccattatggatctgcaccccgggtccggaaagacacgccggtatctccctgccatcgtgagagaagccattaaacgcaagctgcggacgcttatcctggctccgaccagagttgtggcctctgagatggctgaagccctcaagggcatgcccatccgctaccaaacaaccgcggtcaaaagcgagcatacagggaaggagattgtggacctgatgtgccacgccaccttcacgatgcggctgctctcccctgttagagtgcccaattataacatgatcattatggatgaagctcattttacagaccctagctctatcgccgctcggggctacatttccacccgcgtcggaatgggcgaggccgccgctatcttcatgaccgcgacaccccctgggagcgtggaagcctttccgcagtctaatgctgtgatccaggatgaggaaagagacattcccgagcggagctggaactccggatatgagtggatcaccgatttccctggcaaaacagtctggtttgttccctctattaagagcgggaatgacatcgccaactgtcttcgcaaaaatggaaagagagtgattcagctgtcccggaagaccttcgatacggaataccagaagaccaagaacaacgactgggactacgtggtcaccacagatatctctgagatgggcgccaatttcagagctgaccgcgtgattgatcctcggagatgcctgaaacccgttatcctcaaggacgggccggaacgcgtgatcctggccggccctatgcccgtcaccgtggcgagcgctgcccagcggagaggacgcattggccggaaccacaataaagagggggatcagtatatctacatgggacagccccttaacaatgacgaggatcatgcccactggacggaagctaagatgctgctcgacaacattaatacccctgagggcatcattcccgccctgtttgaacctgagagagaaaagtccgcggccatcgatggggagtatcgcctgagaggagaggctcggaaaacattcgttgaactcatgcgcagaggcgaccttccggtgtggctgagctacaaggtcgcctctgaggggtttcaatattccgatcggcgctggtgcttcgacggcgaaagaaacaatcaggtgctggaggaaaacatggatgtcgagatctggaccaaagagggagaacggaagaaactcagaccccgctggctggacgctcggacatacagcgaccctcttgccctgagagagtttaaggagttcgctgccggccgccggtccgtgtctggggatctcattctggagatcggaaaactgccccagcacctcacccagagagcgcaaaatgcccttgacaacctggttatgctgcataatagcgaacagggcgggcgggcttatcgccacgccatggaggagctccctgatacaattgaaaccctgatgcttctggctctcatcgccgtgctgacgggaggcgtgacactgtttttcctctccggcagagggcttggaaagacctctattggcctgctgtgtgtcatggccagctccgttctcctgtggatggctagcgtggagccccattggatcgcggcctctatcattcttgaatttttcctgatggtgctcctgatcccggagcctgaccggcagcgcacaccccaggataaccaactggcttacgtcgtgattgggctcctttttatgatcctgacagttgccgccaatgagatgggactgctcgaaaccacaaagaaagacctgggcattgggcacgtggctgtcgagaaccaccatcacgccgcgatgcttgatgtggacctgagacctgcctccgcttggacgctctacgccgtcgctaccacaatcattacccccatgatgcggcatacaatcgaaaacaccacggccaatatcagcctgaccgcgattgccaaccaggctgccatcctgatgggactcgataagggctggcctatttctaaaatggacatcggcgtgccccttctggctctggggtgctattcccaggttaatccgctcacactgaccgccgctgtgcttatgctggtcgcccactacgcgattatcggacctggcctccaagccaaggctacacgcgaggcccagaaaagaaccgctgccgggatcatgaagaaccccacggtggatggaattgttgccatcgacctggatcccgtggtctatgacgcgaagttcgaaaaacagctgggccagattatgctccttatcctgtgtacaagccaaattctgctcatgcggaccacatgggctctgtgcgagtctatcacccttgccaccgggcctctgacaacgctctgggagggaagcccgggcaagttttggaataccacaatcgctgtgtccatggccaacattttccgcggctcttacctggccggggctggactggccttcagcctcatgaaatcccttggcgggggaagacggggcaccggggcgcagggagaaacactgggcgagaagtggaaaagacagctgaatcagctcagcaagtccgaatttaacacctataagcgctctggcatcatggaggtggaccggagcgaagccaaagaggggctgaagagaggagagacgacaaaacatgctgtttcccgcggcaccgccaaacttcggtggttcgtcgaaagaaatctggtgaaacccgaggggaaggtgattgatctcggatgtggccgcgggggatggtcttactattgcgctggcctgaagaaagtcaccgaagttaagggctacacaaaagggggacctggccacgaggaacccatccctatggccacctacgggtggaacctggtgaagctccacagcggaaaagacgtgtttttcattccccctgagaagtgtgatacacttctgtgcgacatcggcgagtcctctccgaatcccacgattgaagaggggcggaccctgagagtcctcaaaatggtggaaccttggctgcgcggaaaccaattttgtatcaagatccttaatccctatatgcctagcgttgtggagacactggagcagatgcagcggaagcatggcggcatgctcgtcagaaaccccctgtcccgcaatagcacccacgaaatgtactgggtgtcttgcgggacaggaaacattgtttccgcggtgaatatgaccagccggatgctgctcaacagattcacgatggcccatcgcaaaccgacctatgagagagatgtcgacctgggcgctgggacacggcacgtggccgtggaacctgaggtcgctaaccttgatatcattggacagcgcatcgaaaatattaagcacgagcataaatctacctggcactacgacgaggataacccctataagacatgggcctaccatggctcctatgaagttaaacccagcgggtctgcttccagcatggtgaatggagtggtcaagctgctcaccaagccttgggacgtgatccccatggttacacaaatcgccatgaccgatacgacaccttttggccagcagagagtgttcaaagagaaggtcgacacccggaccccgaaagcgaagagaggcacagcccaaattatggaagtgacggctaaatggctgtgggggtttctttcccggaacaagaagccccgcatctgtaccagagaggagttcacacggaaagttcgcagcaatgccgctattggagccgtgtttgtcgacgagaaccagtggaactctgccaaggaggcggtggaagatgagagattctgggacctggttcaccgggaacgcgagctccataaacagggcaagtgcgctacctgcgtgtacaacatgatggggaaaagagaaaagaagctgggagagtttggcaaagccaaggggagccgggccatctggtacatgtggctgggcgctcgcttcctcgagttcgaagccctgggatttatgaatgaggatcactggttctccagagaaaactctcttagcggcgtcgagggggagggactgcacaaactcggctatattctgcgggacatctccaagatccctgggggaaatatgtacgctgatgacacagccggctgggatacccgcattacagaagacgatcttcagaacgaggcgagaatcaccgacattatggaacccgagcatgccctgctcgctaaatctatctttaagctgacgtatcaaaataaagtggtccgggtgcagcgccctgccaagaacgggaccgttatggatgtgattagcagacgggaccagagaggctccggacaggtcggcacatacgggctgaataccttcacaaacatggaagctcaactcatccgccagatggagtctgagggaatctttagcccctccgaactggagaccccgaaccttgccgaacgggtgctggattggctcgagaagtatggcgtggaaagactgaaacgcatggcgattagcggggacgactgtgttgtgaagcctatcgatgaccggttcgccacggctcttacagccctgaatgatatgggaaaagtcagaaaggacattccccagtgggagccttctaaaggctggaacgattggcagcaagtgcccttttgctcccaccatttccaccagctcatcatgaaggacgggcgcgagattgttgtgccttgtcggaatcaggatgaactggtcggcagagctcgcgtgagccagggagccggctggtctctgcgggagaccgcttgcctcgggaagtcctacgcccaaatgtggcagctgatgtattttcacagacgcgaccttcggctggcggccaacgctatctgtagcgccgtccccgtggattggattccgacatccagaaccacgtggtctatccatgcccaccatcagtggatgaccacagaagacatgctcagcgtttggaatcgggtgtggatcgaggaaaacccttggatggaggataaaacccacatttccagctggggagacgtcccctacctgggcaagagagaggaccaatggtgcgggtctcttatcggactgacagctcgcgccacctgggcgacaaatattcaggtggctatcaaccaggttcggagactcattggcaatgaaaactacctggattatatgacctccatgaaacgcttcaagaatgagggggaacccgagggcgccctgtggtga

SEQ ID NO: 19166 - RNA, 9879 nt, synthetic construct
  misc_feature 1..9879: note = derived and/or modified CDS sequence (opt5) from DENV-1__GU131723__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagcacaaatactcttggaaaagctggggaaaggccaagattatcggcgccgacgtgcagaataccacatttatcattgatgggcctaacacccccgaatgtcctgacgatcagagagcttggaatatctgggaggtggaggactatggattcggcatttttacgacaaacatctggctgaaacttcgcgattcctacacccaggtctgcgaccaccggctcatgagcgcggccattaaagattctaaggctgttcatgccgacatgggctattggatcgaatccgagaaaaatgaaacatggaagctggccagagctagcttcatcgaggtgaagacctgtatttggcccaaatctcacacactgtggtccaacggggtgctcgaaagcgagatgatcattccgaagatctacggaggccctatttctcaacataattatcgccccgggtacttcacccagacggccggaccttggcacctgggcaaacttgagctggattttgacctctgcgaagggaccacagtcgtggttgatgagcactgcggaaaccggggccccagcctgagaaccacaaccgtgacgggcaagatcatccatgaatggtgttgccggtcctgtacactgcctccccttcgcttcagaggggaggacggatgctggtacggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattgttggacagctgacctggaacgatctgatcagactttgcattatggtgggcgccaatgcctctgaccgcatgggcatggggaccacatatctggctctcatggccacgttcaagatgagacctatgtttgcggtcggactgctgttccggcgcctgaccagcagagaggtgcttctgctcacaatcggcctgtccctggtggcttctgtcgaacttcccaacagcctggaggaactcggggatggactggccatgggcatcatgattctcaaactgcttaccgactttcaatcccaccagctgtgggccacactcctgagcctgaccttcatcaagacgacattttctcttcattacgcttggaaaaccatggccatggttctgtccgtggtgagcctcttccccctgtgtctctctaccacatcccagaagaccacatggctgcctgtccttctggggagcctgggatgcaagccgctcacgatgtttctgattgctgagaataaaatctggggccggcgctcttggccccttaacgaaggcattatggccgtggggatcgtttccatcctgctcagctccctgctcaagaacgatgtgcctctggcgggaccccttattgccggcgggatgctgatcgcttgttatgtcattagcggatctagcgccgacctgtccctcgagaaagctgccgaggtgtcttgggaagaggaagccgagcacagcggcgcttcccataatatcctggttgaagtgcaggatgacgggaccatgaagattaaagatgaggagagagacgatacacttaccatcctgctcaaggcgacactgctcgccgtctctggagtgtaccctctgagcatccccgctacccttttcgtctggtatttctggcagaagaagaagcagcggtccggcgtgctgtgggacacgccttctcccccggaagttgagcgcgccgtgctggatgacggcatttacagaatcatgcagcgggggctcctgggacgcagccaggtcggcgtgggggtttttcaagaaaacgtgttccacaccatgtggcacgtcacaagaggagccgtgcttatgtatcagggcaaacggctggagccttcctgggctagcgtgaagaaagacctcatttcttacgggggaggctggagactgcagggctcctggaataccggggaggaagttcaggtcatcgccgtggagcccggaaagaaccctaaaaatgtgcaaacagcgcccggcacctttaagacaccggaaggggaggtcggagctattgccctcgatttcaagcctggcacgagcgggtctcccatcgtgaaccgcgaaggaaaaattgttggcctgtacggcaatggggtggtcaccacatccggaacctatgtgagcgccatcgctcaggccaaggcgtcccaggagggccctcttcccgagatcgaagacgaggtttttcggaaaagaaacctgaccattatggatctgcatcccgggtctggaaagacacgccggtacctccctgctatcgtgagagaagccattaaacgcaagctgcggacgcttatcctggccccgaccagagtcgtggctagcgagatggccgaagctctcaagggcatgcccattcgctatcaaacaaccgccgttaaatccgagcacacagggaaggagatcgtggacctgatgtgccatgcgaccttcacgatgcggctgctcagccctgtcagagtgcccaattacaacatgatcattatggatgaagcccactttacagacccttcttccatcgctgcccggggctatattagcacccgcgtgggaatgggcgaggctgccgccatcttcatgaccgctacaccccctgggtctgtcgaagcgtttccgcagagcaatgccgttattcaggatgaggaaagagacatccccgagcggtcctggaactctggatacgagtggatcaccgatttccctggcaaaacagtgtggtttgtgcccagcattaagtccgggaatgacatcgctaactgtcttcgcaaaaatggaaagagagtcattcagctgtctcggaagaccttcgatacggaatatcagaagaccaagaacaacgactgggactacgtggttaccacagatatcagcgagatgggcgccaatttcagagccgaccgcgtgattgatcctcggagatgcctgaaacccgtcatcctcaaggacgggccggaacgcgtgattctggctggccctatgcccgttaccgtggcctccgcggctcagcggagaggacgcgtcggccggaaccataataaagagggggatcagtacatctatatgggacagccccttaacaatgacgaggatcacgcccactggacggaagccaagatgctgctcgacaacatcaatacccctgagggcattatccccgctctgtttgaacctgagagagaaaagagcgccgcgattgatggggagtaccgcctgagaggagaggcccggaaaacattcgtggaactcatgcgcagaggcgaccttccggtctggctgtcttataaggtggcttccgaggggtttcaatacagcgatcggcgctggtgcttcgacggcgaaagaaacaatcaggttctggaggaaaacatggatgtggagatctggaccaaagagggagaacggaagaaactcagaccccgctggctggacgcccggacatattccgaccctcttgctctgagagagtttaaggagttcgccgctggccgccggtctgtgagcggggatctcattctggagatcggaaaactgccccagcatctcacccagagagcccaaaatgcgcttgacaacctggtcatgctgcacaattccgaacagggcgggcgggcctaccgccatgctatggaggagctccctgatacaatcgaaaccctgatgcttctggccctcattgctgttctgacgggaggcgtgacactgtttttcctctctggcagagggcttggaaagaccagcatcggcctgctgtgtgtgatggcctccagcgtcctcctgtggatggcctctgtggagccccactggattgctgcgtccatcattcttgaatttttcctgatggttctcctgatcccggagcctgaccggcagcgcacaccccaggataaccaactggcctatgtggtcatcgggctcctttttatgattctgacagtggctgccaatgagatgggactgctcgaaaccacaaagaaagacctgggcatcgggcacgtcgccgtggagaaccatcaccatgctgccatgcttgatgttgacctgcaccctgcgagcgcctggacgctctacgctgtggccaccacaattatcacccccatgatgagacatacaattgaaaacaccacggctaatatctctctgaccgccattgcgaaccaggccgctatcctgatgggactcgataagggctggcctatctccaaaatggacattggcgtcccccttctggccctggggtgctacagccaggtgaatccgctcacactgaccgctgccgttcttatgctggtggctcactatgccatcattggacctggcctccaagcgaaggccacacgggaggctcagaaacgcaccgccgctgggatcatgaagaaccccacggtcgatggaattgtggccatcgacctggatcccgtggtttacgacgccaagttcgaaaaacagctgggccagatcatgctccttattctgtgtacatctcaaatcctgctcatgagaaccacatgggcgctgtgcgagagcattacccttgctaccgggcctctgacaacgctctgggagggatccccgggcaagttttggaataccacaatcgccgtctctatggctaacattttccggggcagctatctggccggggccggactggctttctccctcatgaaaagccttggcgggggacgcagaggcaccggggcccagggagaaacactgggcgagaagtggaaacggcagctgaatcagctctccaagtctgaatttaacacctacaagagaagcggcatcatggaggtggaccgctccgaagcgaaagaggggctgaagcggggagagacgacaaaacacgccgtgtctagaggcaccgctaaacttcgctggttcgtcgaacggaatctggttaaacccgaggggaaggtgatcgatctcggatgtggcagagggggatggagctattactgcgccggcctgaagaaagtgaccgaagtcaagggctatacaaaagggggacctggccatgaggaacccattcctatggctacctacgggtggaacctggtgaagctccactccggaaaagacgtgtttttcattccccctgagaagtgtgatacacttctgtgcgacatcggcgagtctagcccgaatcccacgatcgaagaggggcgcaccctgcgggttctcaaaatggtcgaaccttggctgagaggaaaccaattttgtattaagatccttaatccctacatgccttccgtggttgagacactggagcagatgcagcgcaagcatggcggcatgctcgtgcggaaccccctgagcagaaattctacccacgaaatgtattgggtctcctgcgggacaggaaacattgtgagcgccgtgaatatgacctctcgcatgctgctcaaccggttcacgatggcgcacagaaaaccgacctacgagcgcgatgtcgacctgggcgccgggacaagacatgttgctgtggaacctgaggtggccaaccttgatatcatcggacagcggattgaaaatatcaagcacgagcataaatccacctggcactatgacgaggataacccctacaagacatgggcttatcatggcagctacgaagtcaaaccctctgggtccgccagctccatggtgaatggagttgtgaagctgctcaccaagccttgggacgtcattcccatggtgacacaaatcgctatgaccgatacgacaccttttggccagcagcgcgttttcaaagagaaggtggacaccagaaccccgaaagccaagcggggcacagcgcaaattatggaagtcacggccaaatggctgtgggggtttcttagcagaaacaagaagccccggatctgtacccgcgaggagttcacaagaaaagtgcggtctaatgctgccatcggagctgtttttgtggacgagaaccagtggaatagcgccaaggaggccgtcgaagatgagcgcttctgggacctggtgcacagagaacgggagctccacaaacagggcaagtgcgcgacctgcgtctataacatgatggggaaacgcgaaaagaagctgggagagtttggcaaagctaaggggtccagagccatttggtacatgtggctgggcgcccggttcctcgagttcgaagctctgggatttatgaatgaggatcattggttctctcgcgaaaacagcctttccggcgtggagggggagggactgcacaaactcggctacatcctgagagacatttctaagatccctgggggaaatatgtatgccgatgacacagctggctgggatacccggattacagaagacgatcttcagaacgaggcccgcatcaccgacatcatggaacccgagcatgcgctgctcgccaaaagcatttttaagctgacgtaccaaaataaagttgtgagagtccagcggcctgctaagaacgggaccgtgatggatgtgatctcccgcagagaccagcggggctctggacaggttggcacatatgggctgaataccttcacaaacatggaagcccaactcattagacagatggagagcgagggaatcttttcccccagcgaactggagaccccgaaccttgctgaacgcgtgctggattggctcgagaagtacggcgtcgaacggctgaaaagaatggccatttctggggacgactgtgtggttaagcctatcgatgaccgcttcgcgacggcccttacagctctgaatgatatgggaaaagtgcggaaggacatcccccagtgggagccttccaaaggctggaacgattggcagcaagtccccttttgcagccaccacttccatcagctcattatgaaggacgggagagagatcgtggtcccttgtcgcaatcaggatgaactggtgggccgggccagagtttctcagggagctggctggtccctgcgcgagaccgcctgcctcggaaagagctatgctcaaatgtggcagctgatgtactttcaccggagagaccttcgcctggccgcgaacgccatttgttccgctgtgcccgtcgattggatcccgacatctcggaccacgtggagcattcatgcccaccatcagtggatgaccacagaagacatgctctccgtgtggaatagagtttggatcgaggaaaacccttggatggaggataaaacccacattagctcttggggagacgtgccctatctgggcaagcgggaggaccaatggtgcgggtcccttatcggactgacagccagagctacctgggccacaaatatccaggtcgcgattaaccaggtgcgccggctcatcggcaatgaaaactacctggattacatgaccagcatgaaaagattcaagaatgagtctgaccccgaaggggctctgtggtga

SEQ ID NO: 19167 - RNA, 9879 nt, synthetic construct
  misc_feature 1..9879: note = derived and/or modified CDS sequence (opt5) from DENV-1__GU131725__SS-prME
  source 1..9879: mol_type = other RNA
agcgtgaccatgctgctcatgctgatgcccaccgcccttgctttccacctgacgacccggggaggggaacctcatatgatcgtgtccaagcaggaacgggggaaatctctcctgtttaagaccagcgccggcgttaatatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctggctcctcatgtggggctgggactcgagacaagaaccgaaacgtggatgagctccgagggcgcctggaaacagattcagcgggttgaaacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggattttgttgagggactgagcggcgccacatgggtggacgtcgtgctcgagcacgggtcttgtgtgacgaccatggctaaggataaacccacactggacatcgaactgctcaagaccgaggtcacaaaccctgccgttctgcgcaaactttgcattgaagcgaagatctccaataccacgacagatagcagatgtccgacccaaggagaggccaccctggtggaagaacaggacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttctccgaaatggtgctgcttacgatgaaggagaaaagctggctggtccataagcagtggtttctcgatctgcctcttccctggacatccggggcttctaccagccaagagacatggaaccgccaggacctgctcgtgaccttcaaaaccgcgcacgccaagaagcaggaagtcgtggttctgggatcccaagagggcgctatgcacacagccctgacgggggccaccgaaattcagacaagcggaaccacaaccatctttgctggccatctcaaatgcagactgaagatggataaacttacgctgaaggggatgtcttatgtgatgtgtacaggctccttcaaactcgagaaggaagtcgccgagacccagcacggaaccgtgctggttcagattaagtacgagggcacagacgcgccgtgcaaaatccctttcagcacccaagatgaaaagggggtgacacagaatggacggctgatcacggctaaccccattgtcaccgacaaagagaagcctgtgaatatcgaagccgagccgccctttggcgagtcttatattgtgatcggggccggagaaaaagctcttaagctcagctggttcaagaaaggctcctctattgggaagatgtttgaggccacagctagaggcgcccgccggatggcgatcctgggagataccgcctgggacttcggcagcatcgggggagtttttacatccgtcggcaaactggtgcatcagattttcgggaccgcttacggagtgctctttagcggcgtctcttggacgatgaagatcgggattggcgtgctgcttacctggctgggactcaactccagaagcacatctctgtccatgacctgtatcgccgttggcctggtgacactttacctcggggtcatggtgcaggctgatagcggatgcgttattaattggaaaggccgcgaactgaagtgtgggtccggaatcttcgtgaccaacgaggtccacacatggaccgaacaatataagtttcaggccgactctcctaaacggctgagcgcggccattggcaaggcttgggaggagggggtgtgcggcatcagatccgccacgcgcctcgaaaatatcatgtggaaacagatttctaacgagctgaaccatatccttctggaaaatgacatgaagctcacagttgtggtcggagatgtggctggcattctggggcagggcaagaaaatgatccggccgcaacccatggagtacaaatatagctggaagtcctggggcaaggccaaaattatcggggccgacgctcagaacaccaccttcatcattgatggacctaatacacccgaatgtcctgacgatcagagagcgtggaacatctgggaggtggaggactacggctttggcattttcaccacgaatatctggctgaaacttcgcgatagctatacacaggtctgcgaccaccggctcatgtctgccgctattaaagattccaaggccgttcacgccgacatggggtactggatcgaaagcgagaaaaacgaaacctggaagctggctagagcctcttttatcgaggtgaagacatgtatttggcccaaatcccataccctgtggagcaatggagtgctcgaatctgagatgatcattccgaagatctatggcgggcctattagccaacacaactaccgccccggatacttcacacagaccgcgggcccttggcatctggggaaacttgagctggatttcgacctctgcgaaggaacgaccgtcgtggttgatgagcactgcggcaatcggggcccctccctgagaacaaccacagtgaccgggaagatcatccacgaatggtgttgccggagctgtacgctgcctccccttcgctttagaggagaggacggctgctggtatgggatggagattcggccggtcaaagaaaaggaggaaaacctcgtgaagtctatggtttccgctggaagcggcgaggtggactccttctctctggggctgctctgtatcagcattatgatcgaagaggtcatgagatcccgctggtctcggaaaatgctgatgacaggaacccttgccgtgtttttcctgctcattatgggccagctgacatggaatgatctgatcagactttgcattatggttggcgccaacgctagcgaccgcatggggatgggaaccacctacctggccctcatggcgacatttaagatgagacctatgttcgctgtgggcctgctctttcggcgcctgacgtccagagaggtccttctgctcaccatcgggctgtctctggtggccagcgtggaacttcccaattccctggaggaactcggagatggcctggccatggggatcatgattctcaaactgcttacagacttccaaagctatcagctgtgggctaccctcctgtctctgacatttatcaagaccacgttctcccttcattacgcctggaaaacaatggctatggtcctgagcattgtttctctctttcccctgtgtctctccaccaccagccagaagacaacctggctgcctgtgcttctgggatctctgggctgcaagccgctcacaatgttcctgatcgccgagaacaaaatttggggccggaagtcctggccccttaatgaagggatcatggcggtgggaatcgtcagcattctgctctccagcctgctcaaaaacgatgtgcctctggccggcccccttatcgctgggggaatgctgattgcctgttatgttatctctggcagctccgctgacctgtctctcgagaaggccgccgaggtgagctgggaagaggaagctgagcactccggggcgtctcataacattctggtcgaagtgcaggatgacggaacgatgaaaatcaaggatgaggagcgcgacgatacccttacaatcctgctcaaagccaccctgctcgctgttagcggcgtgtaccctctgtccattcccgccacactttttgtctggtatttctggcaaaagaagaaacagagatctggcgtgctgtgggacacccctagccctcccgaagtcgagcgggccgtgctggatgacgggatctaccgcattatgcagagaggactcctgggccggtcccaggttggggtgggagtcttccaagaaaatgtgtttcacacgatgtggcatgttacccgcggcgctgtgcttatgtaccaggggaagagactggagcccagctgggcctctgtcaaaaaggacctcatctcctatggaggcggctggcggctgagagggagctggaacacaggagaggaagtccaggtgattgcggttgagcccggcaaaaatcctaagaacgtccagaccgctcccgggacattcaagaccccggaaggagaggtgggcgccatcgccctcgattttaaacctgggacatctggatcccccattgtgaatcgcgaaggcaagatcgtcggcctgtacgggaacggagtggttacgaccagcggcacatatgtgtccgctatcgcccaagcgaaggcttctcaggaggggcctcttcccgagattgaagacgaggtcttccggaagagaaatctgaccatcatggatctgcaccccggaagcggcaaaacccgccggtacctccctgccattgtgagagaagccatcaagcgcaagctgcggacacttattctggctccgacgagagttgtggcctccgagatggctgaagccctcaaagggatgcccatccgctatcagaccacagcggtcaagggcgagcacaccggaaaagagatcgtggacctgatgtgccatgccacatttaccatgcggctgctcagccctgttagagtgcccaactacaatatgattatcatggatgaagctcacttcacggacccttcttccattgccgctcggggctatatcagcacacgcgtcgggatgggagaggccgccgctatttttatgaccgcgacaccccctggctctgtggaagccttcccgcaaagcaacgctgtgatccaggatgaggaaagagacatccccgagcggtcctggaactctgggtacgagtggattacagattttcctggaaagaccgtctggttcgttcccagcatcaaatccggcaacgacattgccaattgtcttcgcaagaacgggaagagagtgatccagctgtctcggaaaacatttgataccgaataccagaagacgaaaaataacgactgggactatgtggtcacaaccgatattagcgagatgggcgccaacttcagagctgaccgcgtgatcgatcctcggagatgcctgaagcccgttattctcaaagacggaccggaacgcgtgatcctggccggccctatgcccgtcacagtggcgtccgctgcccaacggagagggcgcatcggacggaatcataacaaggagggcgatcagtacatttatatggggcagccccttaataacgacgaggatcacgcccattggaccgaagctaagatgctgctcgacaatatcaacacgcctgagggaattatccccgccctgttcgaacctgagagagaaaagagcgcggccgttgatggcgagtaccgcctgagaggggaggctcggaagacctttgtggagctcatgcgcagaggcgaccttccggtctggctgtcttataaagtggcctccgagggattccagtacagcgatcggcgctggtgctttgacggcgaaagaaataaccaagtcctggaggaaaatatggatgtggagatttggacaaaggagggggaacggaaaaagctcagaccccgctggctggacgctcggacctattccgaccctcttgccctgagagagttcaaagaatttgctgccggacgccggtctgttagcggcgatctcatcctggagatcgggaagctgccccagcacctcacacagagagcgcagaacgcccttgacaatctggtgatgctgcacaactccgaacaaggaggccgggcttaccgccatgccatggaggagctccctgataccattgaaacactgatgcttctggctctcatcgccgtgctgaccggcggggtcacgctgttctttctctctggaagaggccttgggaagacaagcattggactgctgtgtgttatggcctccagcgtgctcctgtggatggcttctgtggagccccactggatcgcggcctccattatccttgagttctttctgatggtcctcctgatcccggagcctgaccggcagcgcacaccccaggataatcagctggcttacgtggttattggcctccttttcatgatcctgaccgtggccgccaacgagatggggctgctcgaaacaaccaaaaaggacctgggaattggccatgtcgctgtggagaatcaccaccatgccgcgatgcttgatgtcgacctgcaccctgccagcgcttggacactctatgccgtggctacgaccatcattacacccatgatgagacataccatcgaaaacacaaccgccaacatttctctgacggcgatcgccaatcaagctgccatcctgatgggcctcgataaagggtggcctatttccaagatggacatcggagttccccttctggctctgggctgctacagccaggtgaacccgctcaccctgacagccgctgtccttatgctggtggcccactatgcgattatcgggcctggactccaggccaaagctacccgggaggcccaaaagcgcacagctgccggcattatgaagaatcccaccgttgatgggatcgtggccatcgacctggatcccgtcgtgtacgacgcgaaatttgaaaagcagctgggacagattatgctccttatcctgtgtacgtctcagattctgctcatgagaacaacctgggctctgtgcgagagcatcacacttgccaccggccctctgaccacactctgggagggctccccggggaaattctggaacacgaccattgctgtgtctatggccaatatctttcggggaagctatctggccggcgctgggctggccttctccctcatgaaaagccttggaggcgggcgcagaggaacaggcgcgcaaggcgaaaccctgggggagaaatggaagcggcagctgaaccagctctccaagtctgagttcaatacatacaaaagaagcggaatcatggaggttgaccgctccgaagccaaggagggcctgaaaagaggggaaaccacgaagcatgctgtctctagaggaacagccaaacttcgctggtttgtggaacggaacctggtgaagcccgagggcaaggtcattgatctcgggtgtggaagaggcggctggagctattactgcgctgggctgaaaaaggttaccgaagtgaaaggatacaccaagggcgggcctggacacgaggaacccatccctatggccacatatggctggaatctggtgaaactccactccgggaaggacgtcttctttattccccctgagaaatgtgatacccttctgtgcgacatcggagagtctagcccgaaccccacaattgaagagggccgcacgctgcgggtgctcaagatggttgaaccttggctgagaggcaatcagttctgtatcaagattcttaacccctacatgccttccgtggtcgagaccctggagcaaatgcagcgcaaacatgggggaatgctcgtgcggaatcccctgagcagaaactctacacacgaaatgtattgggtttcctgcggcaccgggaatatcgtgagcgcggtcaacatgacatctcgcatgctgctcaatcggtttaccatggcccatagaaagccgacgtacgagcgcgatgtggacctgggaaccggcacaagacacgtggctgtcgaacctgaggttgccaaccttgatatcattgggcagcggatcgaaaacattaaacacgagcataagtccacctggcactatgacgaggataatccctacaaaacatgggcttatcatggaagctacgaagtgaagccctctggctccgccagctccatggtgaacggcgtcgtgaagctgctcaccaaaccttgggacgttatccccatggtgacacagattgctatgaccgatacgacacctttcgggcaacagcgcgtctttaaggagaaagtggacaccagaaccccgaaggccaaacggggaacagcgcagatcatggaagttacggccagatggctgtggggcttccttagccggaataagaagccccgcatctgtaccagagaggaatttacacggaaagtgcgctctaacgctgccattggggctgtcttcgtggacgagaatcaatggaacagcgccaaggaggccgttgaagatgagagattttgggacctggtgcaccgggaacgcgagctccataaacagggaaagtgcgcgacctgcgtctacaatatgatgggcaaaagagaaaagaagctgggggagttcggcaaagctaagggatcccgggccatctggtatatgtggctgggcgcccgctttctcgagttcgaagctctggggttcatgaacgaggatcactggttttctagagaaaatagcctttccggagtggagggcgaggggctgcacaaactcggatacattctgcgggacatctctaagattcctggcgggaacatgtatgccgatgacacagctggctgggatacccgcatcacagaagacgatcttcagaatgaggccaaaatcaccgacattatggaacccgagcatgcgctgctcgccaaggctatcttcaaactgacgtaccagaacaaggtcgtgagagttcaacggcctgccaagaatggaaccgtgatggatgtcattagccgcagagaccagcggggctccggacaggtgggaacatatggcctgaacacctttacaaatatggaagctcagctcatcagacaaatggagtctgaggggattttcagcccctccgaactggagaccccgaaccttgccgaacgcgcgctggattggctcgagaaatacggagtggaacggctgaagagaatggccatcagcggcgacgactgtgttgtgaaacctatcgatgaccgctttgctacggcccttacagctctgaacgatatggggaaggtccggaaagacattccccagtgggagccttctagaggctggaatgattggcaacaggtgcccttctgctcccaccattttcaccaactcatcatgaaggacggacgcgagattgttgtgccttgtcggaaccaggatgaactggtcggcagagcccgcgtgagccagggggctggatggtctctgcgggagaccgcctgcctcggcaagtcctatgcgcagatgtggcaactgatgtacttccacagacgcgaccttcggctggccgctaatgccatctgtagcgccgtccccgtggattgggttccgacatccagaaccacgtggtctattcatgctcaccatcagtggatgaccacagaagacatgctcagcgtgtggaaccgggtctggatcgaggaaaatccttggatggaggataaaacccacatttccagctgggaggacgtgccctacctggggaagagagaagaccagtggtgcggatctcttatcggcctgacagcccgcgcgacctgggctacaaacatccaagttgccattaatcaggtgcggagactcatcgggaacgagaattatctggattacatgacctccatgaaacgctttaagaacgaaagcgaccccgagggcgccctgtggtga

SEQ ID NO: 19168 - RNA, 9879 nt, synthetic construct
  misc_feature 1..9879: note = derived and/or modified CDS sequence (opt5) from DENV-1__GU131726__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaagtccctcctgtttaagacctctgccggcgttaacatgtgcacacttattgccatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggctacacagaacggacggctgatcacggccaatcccattgttaccgacaaagagaagcctgtgaacatcgaagccgagccgccctttggcgagagctatattgtcatcggggctggagaaaaagcccttaagctctcttggttcaagaaaggcagctccattgggaagatgtttgaggctacagccagaggcgcgcgccggatggccatcctgggagataccgcttgggacttcggctctgtcgggggagtgtttacaagcgttggcaaactggtccatcagatcttcgggaccgcctacggagtgctcttttccggcgtgagctggacgatgaagattgggatcggcgtcctgcttacctggctgggactcaattctagatccacaagcctgtctatgacctgtattgctgtgggcctggttacactttacctcggggtgatggtccaggccgattccggatgcgtgatcaactggaaaggccgcgaactgaagtgtgggagcggaattttcgttaccaatgaggtgcacacatggaccgaacaatataagtttcaggcggactcccctaaacggctgtctgccgctatcggcaaggcctgggaggagggggtctgcggcattagaagcgctacgcgcctcgaaaacatcatgtggaaacagatctccaacgagctgaatcatattcttctggaaaacgacatgaagttcacagtggttgtgggagatgtcgtgggcatcctcgcccaggggaaaaagatgattcggccgcaacccatggagcacaaatactcttggaaaagctggggaaaggccaagatcattggcgctgacgtgcagaataccacctttatcatcgatgggcctaacacacccgaatgtcctgacgatcagagagcgtggaatatttgggaggtcgaggactatggattcggcatctttgccaccaacatttggctgaagctgcgcgattcctacacgcaggtttgcgaccaccggcttatgagcgctgccatcaaagattctaaggccgtgcatgctgacatgggctattggattgaatccgagaaaaatgaaacatggaagctcgccagagcgagcttcatcgaggtgaagacctgtatctggcccaaatctcacacactgtggtccaacggggtcctggaaagcgagatgattatcccgaagatttacggaggccctatctctcaacataattatcgccccgggtacttcacccagacagctggaccttggcacctcggcaaactggagcttgattttgacctgtgcgaagggaccacggtggttgtggatgagcactgcggaaaccggggccccagcctcagaaccacaaccgtcacaggcaagattatccatgaatggtgttgccggtcctgtaccctgcctcccctgcgcttcaaaggggaggacggatgctggtacggcatggagatcagaccggtgaaggaaaaggaggaaaatcttgttaaaagcatggtgtctgccgggtccggagaggtcgacagcttttccctcggcctgctgtgtatttctatcatgattgaagaggtgatgcggagcagatggtcccgcaagatgctcatgacggggacactggccgttttccttctgctcatcatgggacagctgacctggaacgatctgattcggctttgcatcatggtgggcgctaatgcctctgacagaatgggcatggggacaacctatctggcgctcatggctacctttaaaatgcgccctatgttcgccgtcggactgctcctgagacggcttacaagccgcgaggtgctgctcctgacgattggcctgtcccttgtggcctctgtcgaactgcccaacagcctcgaggaactgggggatggactcgctatgggcatcatgatcctgaaacttctgaccgactttcaatcccaccagctctgggccacactgctgagccttaccttcattaaaacaaccctgtctctccattacgcttggaagacgatggccatggttctgtccatcgtgagcctctttcccctgtgtctttctacaacctcccagaagaccacatggctgcctgtgctgctcgggagcttcggatgcaaaccgctgaccatgtttcttattacagagaataagatctggggcagaaaatcttggcccctgaacgaaggcattatggcggtcggggtggtttccatcctcctgagctccctcctgaagaacgatgtgcctcttgccggacccctgatcgctggcgggatgctgattgcctgttatgtcatcagcggatctagccctgacctctccctggagaaagctgccgaggtgtcttgggaagaggaagccgagcacagcggcgcttcccataatattcttgttgaagtgcaggatgacgggacgatgaagatcaaagatgaggagcgggacgataccctgacaattctcctgaaggcgaccctcctggccgtctctggagtgtacccccttagcatccctgctacactgttcgtctggtatttttggcaaaagaaaaagcagcgctccggcgtgctgtgggacaccccctctccgcctgaagttgagagagccgtgctcgatgacggcatctaccggattatgcagcgcgggctgcttggaagaagccaggtcggcgtgggggttttccaagaaaacgtgttccacacgatgtggcacgtcacccggggagccgtgctgatgtatcagggcaaacgcctcgagccctcctgggctagcgtgaagaaagacctgatctcttacgggggaggctggagactccagggctcctggaatacaggggaggaagttcaggtcattgccgtggagcctggaaagaaccccaagaatgtgcaaaccgcgccgggcacatttaaaacccctgaaggggaggtcggagctatcgccctggatttcaagcccggcacaagcgggtctcctattgtgaaccgggaaggaaaaatcgttggcctttacggcaatggggtggtcacgacctccggaacatatgtgagcgccattgctcaggccaaggcgtcccaggagggccccctgcccgagatcgaagacgaggtttttagaaaacgcaacctgaccatcatggatctccatcctgggtctggaaagacccggagatacctgccggctattgtgcgcgaagccatcaagcggaaacttagaacactgattctcgcccccacgcgcgtcgtggctagcgagatggccgaagctctgaagggcatgcctatccggtatcaaaccacagccgttaaatccgagcacaccgggaaggagattgtggacctgatgtgccatgcgacattcaccatgagactccttagccccgtccgcgtgcctaattacaacatgatcatcatggatgaagcccactttacggacccctcttccattgctgcccggggctatatcagcacaagagtgggaatgggcgaggctgccgccattttcatgaccgctacccctccggggtctgtcgaagcgtttccccagagcaatgccgttatccaggatgaggaacgggacattcctgagcgctcctggaactctggatacgagtggatcacagatttccccggcaaaaccgtgtggtttgtgcctagcatcaagtccgggaatgacattgctaactgtctgagaaagaatggaaaacgggtcatccagctgtctcgcaagacattcgataccgaatatcagaagacgaagaacaacgactgggactacgtggttacaaccgatattagcgagatgggcgccaattttagagccgaccgggtgatcgatcccagacgctgcctcaaaccggtcattctgaaggacgggcctgaacgggtgatccttgctggccccatgcccgttacagtggcctccgcggctcagagacgcggacggattggcagaaaccataataaggagggggatcagtacatctatatgggacagcctctgaacaatgacgaggatcacgcccactggaccgaagccaaaatgctcctggacaacatcaatacgcccgagggcattatccctgctctgttcgaaccggagcgcgaaaagagcgccgcgattgatggggagtaccggctcagaggagaggcccgcaaaaccttcgtcgaacttatgagacggggcgacctgcccgtgtggctgtcttataaggtcgcttccgaggggtttcaatacagcgatcgcagatggtgcttcgacggcgaacggaacaatcaggtgctcgaggaaaacatggatgttgagatctggacaaaagagggagaacgcaagaaactgagacctcggtggcttgacgccagaacctattccgaccccctggctctccgcgagtttaaggagttcgccgctggccggagatctgtgagcggggatctgattctggagatcggaaagctccctcagcatcttacacagcgcgcccaaaatgcgctggacaacctggtgatgctccacaattccgaacagggcgggcgggcctacagacatgctatggaggagctgcccgataccatcgaaacacttatgctgctcgccctgattgctgtcctgaccggaggcgttacgctctttttcctttctggccgggggctgggaaaaacaagcatcggcctgctctgtgtgatggcctccagcgtgctgctttggatggcctctgtcgagccgcactggattgctgcgtccatcattctggaatttttcctcatggtgctgctgatccctgagcccgaccgccagagaacccctcaggataaccaactcgcctatgttgtgatcgggcttctgtttatgattctgaccgtcgctgccaatgagatgggactcctggaaacaaccaagaaagaccttggcatcgggcacgtggccgtcgagaaccatcaccatgctacaatgctggatgtggacctccaccccgccagcgcgtggacgctgtacgccgttgctaccacaattatcacccctatgatgcggcatacaattgaaaacaccacggccaatatctctctgaccgctattgccaaccaggcggccatcctcatgggacttgataagggctggcccatctccaaaatggacattggcgtgccgctgctggctctcgggtgctacagccaggtcaatcctctgacacttaccgccgctgtgctgatgctcgttgcccactatgctatcattggacccggcctgcaagccaaggcgacacgcgaggcccagaagagaaccgctgccgggatcatgaaaaaccccacggtggatggaattgtcgctatcgacctggatcctgtggtgtacgacgccaagttcgaaaaacagctcggccagatcatgcttctgattctgtgtacatctcaaatcctcctgatgcggaccacatgggccctttgcgagagcattaccctggcgaccgggccgctcacaacgctgtgggagggatcccccggcaagttttggaataccacaatcgctgtttctatggccaacattttccgcggcagctatctggctggggccggactcgccttttcccttatgaaaagcctgggcgggggaagacggggcaccggggctcagggagaaacactgggcgagaagtggaagcgccagctcaatcagctgtccaaatctgagttcaacatctacaagagaagcggcatcatggaggtcgaccggtccgaagccaaagaggggcttaagagaggagagaccacgcgccacgcggtgtctcggggcacagccaaactgagatggttcgtggaacgcaatctcgtcaagcctgaggggaaggttattgatctgggatgtggcagagggggatggagctattactgcgctggcctgaaaaaggtgaccgaagtgaaaggctataccaaagggggacccggccatgaggaacctatccccatggccacatacgggtggaacctcgtcaaacttcactccggaaaggacgtgtttttcacccctccggagaaatgtgatacactgctgtgcgacattggcgagtctagccccaatcctacgatcgaagaggggagaaccctccgcgttctgaagatggtggaaccctggcttcggggaaaccaattttgtattaagatcctgaatccttacatgccctccgtcgtggagacactcgagcagatgcagagaaaacatggcggcatgctggttcgcaacccgctgagcagaaattctacccacgaaatgtattgggtgtcctgcgggacaggaaacattgtcagcgctgtgaatatgacctctagaatgctcctgaaccgcttcacgatggcccaccggaagcctacctacgagagagatgtggaccttggcgcggggacacgccatgtcgccgttgaacccgaggtggctaacctggatatcatcggacagagaattgaaaatatcaaacacgagcataagtccacctggcactatgacgaggataacccctacaaaacatgggcctatcatggcagctacgaagtgaagccttctgggtccgctagctccatggtcaatggagtggttaagctcctgaccaaaccctgggacgtgattcctatggtcacacaaatcgccatgaccgatacgacaccgtttggccagcagcgggtgttcaaggagaaagttgacacccgcacccccaaggctaaaagaggcacagcccaaattatggaagtgacggcgcggtggctttgggggtttctgagcagaaacaagaagcctcggatctgtacccgcgaggagttcacaagaaaagtccggtctaatgccgctatcggagccgtgtttgttgacgagaaccagtggaatagcgctaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggcgaaagggtcccgcgctatttggtacatgtggctcggcgccagattcctggagtttgaagcccttggattcatgaatgaggatcactggttctctcgggaaaacagcctgtccggcgtcgagggggagggactccataagctgggctacatccttcgcgacatttctaaaatccccgggggaaatatgtatgctgatgacacagccggctgggataccagaattacagaagacgatctgcaaaacgaggctaagatcaccgacatcatggaacctgagcacgccctcctggcgacgagcatttttaaactgacctaccagaataaggtggttcgggtgcagcgccccgccaagaacgggacagtcatggatgtgatctccagacgggaccagcgcggctctggacaagtgggcacctatgggctcaatacattcaccaacatggaagctcagctgattagacagatggagagcgagggaatctttcttccgtccgaactggagacgcctaacctcgccgaacgggttctggattggcttgagaaatacggcgtggaaagactgaagcgcatggctattagcggggacgactgtgtcgtgaaacccatcgatgaccggttcgccacagcgctcaccgccctgaatgatatgggaaaggttagaaaagacatccctcagtgggagccctctaagggctggaacgattggcaacaggtgcctttttgctcccatcacttccaccagctgattatgaaggacgggcgcgagatcgtcgtgccctgtcggaatcaggatgaactcgtcggcagagctcgcgtgagccaaggagccggctggtctctgcgggagacagcttgccttgggaaatcctatgcccagatgtggcagctgatgtactttcatagacgcgacctccggctggctgccaacgcgatttgtagcgccgttccgatcgattgggtgcctacctccagaacgacctggtctattcacgctcatcaccaatggatgacaaccgaagacatgcttagcgtctggaatcgcgtgtggatcgaggaaaacccctggatggaggataagacacatgtttccagctggggagacgtgccctatctgggcaaacgggaggaccagtggtgcgggtctctcattggactgaccgccagagccacatgggcttccaatatccaggtcgccatcaaccaggtgcggagactgattggcaatgaaaactacctcgattacatgaccagcatgaagcgcttcaaaaatgagggggaccctgaaggcgcgctgtggtga

SEQ ID NO: 19169 - RNA, 9879 nt, synthetic construct
  misc_feature 1..9879: note = derived and/or modified CDS sequence (opt5) from DENV-1__GU131727__SS-prME
  source 1..9879: mol_type = other RNA
agcgtgaccatgctgctcatgctgatgcccaccgcccttgctttccacctgacgacccggggcggggaacctcatatgatcgtgacaaagcaggaacggggaaaatccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctggggagcctcggatgcaaaccgctgacaatgtatcttattacggagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttacgtgatcagcggatctagcgctgacctctccctggagaaagccgctgaggtttcttgggaagaggaagccgagcacagcggcgcctcccataatattcttgtggaagtccaggatgacgggaccatgaagatcaaagatgaggagcgggacgatacactgaccattctcctgaaggctacactcctggcggtgtctggagtctatcctcttagcatccccgccaccctgtttgtgtggtacttctggcaaaagaaaaagcagcgctccggcgttctgtgggacacgccttctcccccggaagtggagagagctgtcctcgatgacggcatctatcggattatgcagcgcgggctgcttggaagaagccaggtgggcgttggggtgtttcaagaaaacgtcttccacaccatgtggcacgtgacacggggagccgtgctgatgtaccagggcaaacgcctcgagccttcctgggccagcgttaagaaagacctgatctcttacgggggaggctggagactccagggctcctggaataccggggaggaagtccaggtgattgctgtggagcccggaaagaaccctaagaatgtccaaacagcccccggcaccttcaaaacaccggaaggggaggtgggagcgatcgctctggattttaagcctggcacgagcgggtctcccattgttaaccgggaaggaaaaatcgtgggcctttatggcaatggggtcgtgaccacatccggaacctacgttagcgccattgcccaggctaaggcctcccaggagggccctctgcccgagatcgaagacgaggtgttcagaaaacgcaacctgaccatcatggatctccatcccgggtctggaaagacacggagatatctgcctgcgattgtccgcgaagctatcaagcggaaacttagaacgctgattctcgccccgacccgcgtggttgccagcgagatggctgaagccctgaagggcatgcccatccggtaccaaacaaccgctgtgaaatccgagcacacagggaaggagattgtcgacctgatgtgccatgccacctttacgatgagactccttagccctgtgcgcgtgcccaattataacatgatcatcatggatgaagcgcacttcacagacccttcttccattgccgctcggggctacatcagcaccagagtcggaatgggcgaggccgctgccatttttatgaccgccacaccccctgggtctgttgaggctttcccgcagagcaatgcggtgatccaggatgaggaacgggacattcccgagcgctcctggaactctggatatgagtggatcaccgattttcctggcaaaacagtgtggttcgtccccagcatcaagtccgggaatgacattgccaactgtctgagaaagaatggaaaacgggtgatccagctgtctcgcaagacctttgatacggaataccagaagaccaagaacaacgactgggactacgttgtgaccacagatattagcgagatgggcgctaatttcagagccgaccgggtcatcgatcctagacgctgcctcaaacccgtgattctgaaggacgggccggaacgggttatccttgccggccctatgcccgtgaccgtcgcttccgccgcgcagagacgcggacggattggcagaaaccataataaggagggggatcagtatatctacatgggacagcccctgaacaatgacgaggatcacgctcactggacggaagccaaaatgctcctggacaacatcaatacccctgagggcattatccccgccctgtttgaacctgagcgcgaaaagagcgctgccattgatggggagtatcggctcagaggagaggcgcgcaaaacattcgtggaacttatgagacggggcgacctgccggtctggctgtcttacaaggtggcctccgaggggttccaatatagcgatcgcagatggtgctttgacggcgaacggaacaatcaggttctcgaggaaaacatggatgtggagatctggaccaaagagggagaacgcaagaaactgagaccccggtggcttgacgctagaacatactccgaccctctggccctccgcgagttcaaggaatttgctgccggccggagatctgtgagcggggatctgattctggagatcggaaagctcccccagcatcttacccagcgcgctcaaaatgccctggacaacctggtcatgctccacaattccgaacagggcgggcgggcgtatagacatgccatggaggagctgcctgatacaatcgaaacccttatgctgctcgctctgattgccgttctgacgggaggcgtgacactcttctttctttctggccgggggctgggaaaaaccagcatcggcctgctctgtgtgatggcttccagcgtcctgctttggatggcctctgtggagccccactggattgccgcttccatcattctggagttctttctcatggttctgctgatcccggagcctgaccgccagagaacaccccaggataaccaactcgcgtacgtggtcatcgggcttctgttcatgattctgacagtggccgctaatgagatgggactcctggaaaccacaaagaaagaccttggcatcgggcacgtcgccgtggagaaccatcaccatgccacgatgctggatgttgacctccaccctgctagcgcctggaccctgtacgcggtggccacaaccattatcacacccatgatgcggcataccattgaaaacacgaccgctaatatctctctgacagccattgctaaccaggccgcgatcctcatgggacttgataagggctggcctatctccaaaatggacattggcgtccccctgctggccctcgggtgctatagccaggtgaatccgctgacccttacagctgccgttctgatgctcgtggctcactacgccatcattggacctggcctgcaagctaaggccacccgcgaggcgcagaagagaacggccgctgggatcatgaaaaaccccacagtcgatggaattgtggccatcgacctggatcccgtggtttatgacgctaagtttgaaaaacagctcggccagatcatgcttctgattctgtgtacctctcaaatcctcctgatgcggacaacctgggccctttgcgagagcattaccctggccacagggcctctcacgaccctgtgggagggatccccgggcaagttctggaatacaaccatcgcggtctctatggctaacatttttcgcggcagctacctggccggggctggactcgccttctcccttatgaaaagcctgggcgggggaagacggggcacaggggcccagggagaaaccctgggcgagaagtggaagcgccagctcaatcagctgtccaaatctgaatttaacatctataagagaagcggcatcatggaggtggaccggtccgaagctaaagaggggcttaagagaggagagacgacacgccacgccgtgtctcggggcaccgcgaaactgagatggttcgtcgaacgcaatctcgttaagcccgaggggaaggtgattgatctgggatgtggcagagggggatggagctactattgcgccggcctgaaaaaggtgaccgaagtcaaaggctacacaaaagggggacctggccatgaggaacccatccctatggctacctacgggtggaacctcgtgaaacttcactccggaaaggacgttttctttacaccccctgagaaatgtgatacgctgctgtgcgacattggcgagtctagcccgaatcccaccatcgaagaggggagaacactccgcgtgctgaagatggtcgaaccttggcttcggggaaaccaattctgtattaagatcctgaatccctatatgccttccgtggttgagaccctcgagcagatgcagagaaaacatggcggcatgctggtgcgcaaccccctgagcagaaattctacacacgaaatgtactgggtctcctgcgggaccggaaacattgtgagcgccgtgaatatgacgtctagaatgctcctgaaccgctttaccatggctcaccggaagccgacatatgagagagatgtcgaccttggcgccgggacccgccatgttgcggtggaacctgaggtggccaacctggatatcatcggacagagaattgaaaatatcaaacacgagcataagtccacatggcactacgacgaggataacccctataaaacctgggcttaccatggcagctatgaagtcaagccctctgggtccgccagctccatggtgaatggagttgtgaagctcctgacaaaaccttgggacgtcattcccatggtgacccaaatcgctatgacggatacaacccctttcggccagcagcgggtttttaaggagaaagtggacacccgcacaccgaaggccaaaagaggcacggctcaaattatggaagtcaccgcccggtggctttgggggttcctgagcagaaacaagaagccccggatctgtacacgcgaggaatttaccagaaaagtgcggtctaatgcggccatcggagctgttttcgtggacgagaaccagtggaatagcgccaaggaggctgtcgaagatgagcgcttttgggacctcgtgcagaaagaaagagagctgcacaagcagggcaaatgcgccacatgcgtctacaacatgatggggaagcgggaaaagaaactgggagagttcggcaaggccaaagggtcccgcgcgatttggtacatgtggctcggcgctagatttctggagttcgaagcccttggatttatgaatgaggatcactggttctctcgggaaaacagcctgtccggcgtggagggggagggactccataagctgggctatatccttcgcgacatttctaaaatccctgggggaaatatgtacgccgatgacaccgctggctgggatacaagaattaccgaagacgatctgcaaaacgaggccaagatcacggacatcatggaacccgagcacgctctcctggccaccagcattttcaaactgacatatcagaataaggttgtgcgggtccagcgccctgcgaagaacgggaccgtgatggatgtgatctccagacgggaccagcgcggctctggacaagttggcacatacgggctcaatacctttacgaacatggaagcccagctgattagacagatggagagcgagggaatcttccttccctccgaactggagacaccgaacctcgctgaacgggtgctggattggcttgagaaatatggcgtcgaaagactgaagcgcatggccattagcggggacgactgtgtggttaaacctatcgatgaccggtttgctaccgccctcacagcgctgaatgatatgggaaaggtgagaaaagacatcccccagtgggagccttctaagggctggaacgattggcaacaggtccccttctgctcccatcactttcaccagctgattatgaaggacgggcgcgagatcgtggtcccttgtcggaatcaggatgaactcgtgggcagagcccgcgttagccaaggagctggctggtctctgcgggagaccgcctgccttgggaaatcctacgctcagatgtggcagctgatgtatttccatagacgcgacctccggctggccgctaacgccatttgtagcgcggtgcccgtcgattgggtgccgacgtccagaaccacatggtctatccacgcccatcaccaatggatgaccacagaagacatgcttagcgtttggaatcgcgtgtggattgaggaaaacccttggatggaggataagacccatgtctccagctggggagacgtgccctacctgggcaaacgggaggaccagtggtgcgggtctctcatcggactgacagctagagccacctgggcctccaatattcaggtggctatcaaccaggttcggagactgatcggcaatgaaaactacctcgattatatgacgagcatgaagcgctttaaaaatgagggggaccccgaaggcgccctgtggtga

SEQ ID NO: 19170 - RNA, 9879 nt, synthetic construct
  misc_feature 1..9879: note = derived and/or modified CDS sequence (opt5) from DENV-1__HM631850__SS-prME
  source 1..9879: mol_type = other RNA
tccgtgaccatgctgctcatgctgatgcccaccgcccttgctttccacctgacgaccagaggcggggaacctcatatgatcgtctccaagcaggaacggggaaaatctctcctgtttaagaccagcgccggcgttaatatgtgcacccttattgcgatggacctgggggagttctgtgaagataccatgacctacaaatgccccagaatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcactatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttacgtgatttctggaagctcccctgacctttctctggagaaggctgccgaggtcagctgggaagaggaagccgagcattccggcgcttctcacaatatcctggtggaagttcaggatgacgggacgatgaaaattaaggatgaggagcgggacgataccctcacaatcctgcttaaggcgaccctgctcgccgtgagcggagtctatcccctgtccatccctgctacactcttcgtgtggtacttttggcagaaaaagaaacaacgctctggcgtcctgtgggacacccccagcccgcctgaagtggagagagccgttcttgatgacggcatttatcggatcatgcagcgcgggctgctgggaagatcccaggtgggcgtcggggtgttccaggaaaacgtttttcatacgatgtggcacgtgacccggggagccgtcctcatgtaccaaggcaagcgcctggagcccagctgggcttctgtgaaaaaggaccttatttcctacgggggaggctggagactgcagggcagctggaatacaggggaggaagtgcaggttatcgccgtcgagcctggaaagaaccccaaaaatgtgcagaccgcgccgggcacattcaagacctctgaaggggaggtgggagctattgccctcgattttaaacctggcacatccgggagccccatcgtcaaccgggaaggaaagattgtgggcctgtatggcaatggggttgtgacgacctccggaacatacgtctctgccatcgctcaagccaaagcgagccaggagggccctctccccgagatcgaagacgaggtgttcagaaagcgcaacctgaccattatggatcttcaccccgggtccggaaagacccggagatatctgcctgctatcgttcgcgaagccattaaacggaagctgagaacactcatcctggccccgacgcgcgtggtcgctagcgagatggccgaagctcttaaaggcatgcccattcggtaccagaccacagccgtgaagtctgagcataccgggaaagagatcgttgacctgatgtgccacgcgacatttaccatgagactcctgtcccctgtgcgcgtccccaattataacatgatcattatggatgaagcccatttcacggaccctagctctatcgctgcccggggctacattagcacaagagtgggaatgggcgaggctgccgccatctttatgaccgctacaccccctgggtccgtggaagcgttcccgcaatctaatgccgtcattcaggatgaggaacgggacatccccgagcgcagctggaactccggatatgagtggatcacagattttcctggcaagaccgtttggttcgtgccctctattaagagcgggaatgacatcgctaactgtctgcgcaagaatggaaagcgggtgattcagctctcccgcaaaacattcgataccgaataccagaagacgaaaaacaacgactgggactacgtcgtgacaaccgatatcagcgagatgggcgccaattttagagccgaccgggttattgatcctagacgctgccttaagcccgtgatcctgaaggacgggccggaacgggtcattctggctggccctatgcccgtgacagttgcctctgcggctcaaagacgcggacggatcggcagaaaccacaataaagagggggatcagtatatctacatgggacagcccctcaacaatgacgaggatcatgcccactggaccgaagccaagatgctgcttgacaacattaatacgcctgagggcatcattcccgctctgttcgaacctgagcgcgaaaaatccgccgcgatcgatggggagtatcggctcagaggagaggcccgcaagacctttgtggaactgatgagacggggcgacctgccggtctggctcagctacaaagtggcttccgaggggttccagtattctgatcgcagatggtgctttgacggcgaacggaacaatcaagtccttgaggaaaacatggatgtggagatttggacaaaggagggagaacgcaaaaagctgagaccccggtggctggacgccagaacctacagcgaccctctcgctctgcgcgagttcaaggaatttgccgctggccggagatccgtttctggggatcttatcctggagatcggaaaactcccccagcacctgacacagaaggcccagaatgcgctggacaacctcgtgatgcttcataatagcgaacaaggcgggcgcgcctatcggcacgctatggaggagctgcctgataccattgaaacactgatgctcctggcccttatcgctgtgctgaccggaggcgtcacgctgttctttctgtccggcagagggctgggaaaaacaagcattggcctcctttgtgttatggcctcttccgtgctgctgtggatggccagcgtggagccccattggatcgctgcgtctattatcctcgagttctttctgatggtccttctgatcccggagcctgaccggcagcgcacaccccaggataaccagctcgcctacgtggttattgggctgctgttcatgatcctcaccgtggctgccaatgagatgggacttctggaaacaaccaagaaagacctgggcattgggcacgtcgccgtggagaaccaccatcacgctgccatgctcgatgtcgacctgcatcctgcgtccgcctggacactttacgctgtggccacgaccatcattacacccatgatgagacacaccatcgaaaacacaaccgctaatattagcctgacggccatcgcgaaccaagccgctatcctcatgggactggataagggctggcctatttctaagatggacatcggcgttcccctgctcgcccttgggtgctatagccaggtgaatccgctgaccctgacagctgccgtcctcatgctggtggctcattacgccattatcggacctggccttcaggcgaaagccacccgggaggctcaaaagcgcacagccgctgggattatgaaaaaccccaccgttgatggaatcgtggccatcgacctggatcccgtcgtgtatgacgccaagtttgaaaaacagctcggccagattatgctgctgatcctctgtacgtcccagattcttctgatgagaacaacctgggcgctgtgcgagtctatcacactcgctaccgggcctctgaccacactttgggagggaagcccgggcaagttctggaatacgaccattgccgtgtccatggctaacatcttccggggcagctacctggccggggccggactcgctttttccctgatgaagtctctgggcgggggacgcagaggcacaggggcccaaggagaaaccctcggcgagaaatggaagcggcagcttaatcagctgagcaaatccgagttcaacacatataagcgctctggcatcatggaggttgacagaagcgaagcgaaagaggggctgaagcggggagagaccacgaagcacgccgtctccagaggcacagctaaactccgctggtttgtggaacggaatctggtgaagcccgaggggaaagtcattgatcttggatgtggcagagggggatggtcttactattgcgccggcctgaagaaagttaccgaagtgaagggctacaccaaagggggacctggccacgaggaacccatccctatggctacatacgggtggaacctcgtgaagctgcatagcggaaaggacgtcttctttattccccctgagaaatgtgataccctgctctgcgacatcggcgagtccagcccgaatcccacaattgaagaggggcgcacgcttcgggtgctgaagatggttgaaccttggctgagaggaaaccagttctgtatcaaaattctcaatccctatatgccttctgtggtcgagaccctggagcaaatgcagcgcaagcacggcggcatgcttgtgcggaaccccctgtccagaaatagcacacatgaaatgtactgggtttcttgcgggaccggaaacatcgtgtccgccgtcaatatgacaagccgcatgctcctgaaccggtttaccatggcgcacagaaaaccgacgtatgagcgcgatgtggacctgggcgccgggacccggcacgtggctgtcgaacctgaggttgccaacctcgatatcattggacagagaatcgaaaatattaagcatgagcacaagtctacatggcattacgacgaggataacccctataaaacctgggcttaccacggctcctatgaagtgaagcccagcgggtccgccagctctatggtgaatggagtcgtgaaactgcttacaaagccttgggacgttatccccatggtgacccagattgctatgacagataccacgcctttcggccaacagcgcgtctttaaagagaaggtggacacaagaaccccgaaggccaaacggggcaccgcgcagatcatggaagttacagccaagtggctgtgggggttcctcagccgcaacaaaaagcccagaatctgtacgcgggaggaatttaccagaaaagtgcggtccaatgctgccattggagctgtcttcgtggacgagaaccaatggaactctgccaaggaggccgttgaagatgagcgcttttgggacctggtgcatagagaacgggagcttcacaagcagggcaaatgcgcgacatgcgtctacaacatgatggggaagcgcgagaaaaagctgggagagttcggcaaagctaaggggagcagagccatctggtacatgtggctcggcgcccggttcctggagtttgaagctctgggattcatgaatgaggatcactggttttcccgcgaaaactctctcagcggcgtggagggggagggactgcataaacttggctatattctgagagacatctccaagattcctgggggaaatatgtacgccgatgacaccgctggctgggatacacggatcaccgaagacgatctccagaacgaggccaagatcacagacattatggaacccgagcacgcgctgcttgccaaatctatcttcaagctgacctatcagaataaagtcgtgcgcgttcaaagacctgctaagaacgggacggtgatggatgtcattagccggcgcgaccagagaggctccggacaggtgggcacctacgggctcaatacatttaccaacatggaagcccagctgatccggcaaatggagagcgagggaattttctctccctccgaactggagacaccgaacctcgctggccgcgtgctggattggcttgaaaaacatggggttgagagactgaagcggatggccatcagcggagacgactgtgtggtcaagcctatcgatgacagatttgcgaccgccctcacggctctgaatgatatgggcaaagtgcgcaaggacattccccagtgggaaccttctaaagggtggaacgattggcagcaggttcccttctgctcccaccactttcatcaacttatcatgaaggacggccgggagattgtggtcccttgtagaaatcaggatgagctggtgggacgcgcccgggtcagccagggcgctgggtggtccctcagagaaacagcctgcctgggaaaatcttatgctcagatgtggcaactgatgtacttccaccgccgggacctcagactggccgcgaacgccatctgtagcgctgtgcccgttgattgggtgccgacctcccgcacaacctggagcattcatgcccaccatcagtggatgacgaccgaggacatgctttctgtctggaatcgggtgtggatcgaagagaacccttggatggaagataagacacacatttccaattggggcgacgttccctatctggggaagagagaggaccagtggtgcggaagcctcatcggcctgaccgcccgcgctacatgggccaccaacatccaagtggcgattaatcaggtccggagacttatcgggaacgagaattacctggattacatgacatctatgaaacggtttaagaacgaaagcgaccccgagggcgctctctggtga

SEQ ID NO: 19171 - RNA, 9879 nt, synthetic construct
  misc_feature 1..9879: note = derived and/or modified CDS sequence (opt5) from DENV-1__KF955446__SS-prME
  source 1..9879: mol_type = other RNA
agcgtgaccatgttcctgatgctcatgcccacagccctggctttccaccttacgaccagaggcggggaacctcatatgatcgtgtccaagcaggaacggggaaaatctctgctgttcaagacaagcgccggcgttaacatgtgcaccctgattgcgatggaccttggggaactgtgtgaagatacaatgacctacaaatgcccccgcatcacagaaaccgaacccgacgatgtggactgttggtgcaatgctacggatacctgggtgacatatggaacctgttcccaaacaggcgaacacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtgacacctagcatggccatgagatgcgtgggcattgggtcccgggatttcgttgagggacttagcggcgctacgtgggtggacgtggtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatccctttttccacacaagatgaaaagggggttacgcagaacggacggctgatcaccgcgaatcccattgtgacagacaaagagaagcctgtcaacatcgaagctgagccgcccttcggcgagagctatattgtgatcggggccggagaaaaagcccttaagctctcttggtttaagaaaggcagctccattgggaagatgttcgaggctaccgccagaggcgctcgccggatggccatcctgggagatacagcgtgggactttggctctatcgggggagtgttcaccagcgttggcaaactggtccatcagatttttgggacggcctacggagtcctcttctccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagtttaccgtggttgtgggagatgtcgccggcattctcgctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggctgaagctgcgcgattcctatacccaggtctgcgaccaccggcttatgagcgcggccattaaagattctaaggctgttcacgccgacatgggctactggatcgaatccgagaaaaatgaaacatggaagctcgccagagctagcttcatcgaggtgaagacctgtatttggcccaaatctcatacactgtggtccaacggggtgctggaaagcgagatgatcattccgaagatctatggaggccctatttctcaacacaattaccgccccgggtactttacccagacggccggaccttggcatctcggcaaactggagcttgatttcgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgctttagaggggaggacggatgctggtatggcatggagattcggccggtcaaagaaaaggaggaaaatcttgtcaagagcatggtttctgcggggtccggagaggtggacagcttctccctcggcctgctgtgtatctctattatgatcgaagaggtcatgagaagccgctggtcccggaaaatgctcatgaccgggacactggctgtgtttttccttctgattatgggacagctcacctggaacgatctgatcagactgtgcattatggttggcgccaatgcctctgaccgcatgggcatggggaccacataccttgctctgatggccacgtttaagatgagacctatgttcgcggtgggactcctgtttcggcgcctcaccagcagagaggtcctgcttctgacaatcggcctctccctggtggcttctgtggaactgcccaacagccttgaggaactgggggatggactcgccatgggcatcatgattctgaaactcctgaccgacttccaatcccatcagctttgggccacactgctcagcctgacctttatcaagacgacattctctctgcactatgcttggaaaaccatggccatggtcctttccattgttagcctgtttcccctctgtctgtctaccacatcccagaagaccacatggctccctgtgctgcttgggagcctgggatgcaagccgctgacgatgttcctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggaccatgaagatcaaagatgaggagagagacgatacactgaccatccttctgaaggcgacactcctggccgtttctggagtgtatcctctcagcattcccgctaccctgttcgtctggtacttttggcagaaaaagaagcagcggtccggcgtgctttgggacacgccttctcccccggaagtcgagcgcgccgtgctggatgacggcatctatagaattatgcagcgggggctgctcggacgcagccaggttggcgtgggggtcttccaagaaaacgtgtttcataccatgtggcacgttacaagaggagccgtgctgatgtaccagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctctatggcaatggggtggttaccacatccggaacctacgtgagcgccatcgctcaggcccgggcgtcccaggagggccctctgcccgagattgaagctgaggtcttcagaaagcgcaaccttaccatcatggacctgcaccccgggtctggaaaaacacggagatatctgcctgccattgtgcgcgaagccatcaagcggaaactcagaacgctgattcttgctccgacccgcgttggcgccagcgagatggctgaagccctgaaggggatgcccatccggtaccaaacaaccgcggtgaagtccgagcatacaggcaaagagatcgtcgatctcatgggacacgccacctttacgatgggcctgctggctcctgggagagtgcccaattataacatggttattatggacgaagcccatttcacagatcctagccggatcgctgcccgcggatacatttctaccagagtgggcatgggggaggccgctgcgatctttatgaccgccacaccccctggatccgtcgaggctttcccgcagagcaatgccgtgattcaggacgaggaacgggatatccccgagcgctcttggaacagcggctatgagtggatcaccgactttcctgggaagacagtgtggttcgtcccctccattaaatctggcaatgatatcgccaactgcctcagaaagaatggaaaacgggttattcagcttagcagaaagaccttcgacacggaataccaaaagaccaaaaacaacgattgggactacgtggtgaccacagacatctccgagatgggcgctaattttcgcgccgatcgggtcattgaccctagacgctgtctgaaccccgtgatcctgaaggatgggccggaacgggttattctcgcgggacctatgcccgtgaccgtcgcttctgccgcccagagacgcggccggatcgggagaaatcacaacaaagagggagaccagtatatctacatgggccagcccctgaataacgatgaggaccatgctccttggacggaagccaagatgcttctggataatattaacacccccgaggggatcattcctgcgctctttgaaccggagcgcgagaaaagcgccgctatcgacggcgagtccagactgcggggagaggcccgcaagacatttgtggaactgatgagacggggcgatctccccgtttggcttagctataaggtggcttctgaggggttccaatactccgaccgcagatggtgctttgatggagaacggaccaatcaggtcctggaggaaaacatggccgtggagatttggcctaaagagggcgaaagaaagaaactgcgcccccggtgcctcgacgctagaacatatagcgatcctctggcccttcgcgagttcaaggaatttcccccggggcggagatccgtctctggagacctgatcctcgagatcggcaaactgcctcaccccctgacccagcggcctcagaatgcgctcgccacacttgtgatgagccacacctccgaacaaggcgggcgcgcttacagacatgccatggaggagctgcccgctacgattgaaacactgatgctcctggcccttatcgccgttctgaccggaggcgtgaccctcttctttctgtctgggcggggactgggcaagacaagcattgggctcctttgtgtgatggcttccagcgtcctgctgtggatggcgtctgttgagcctcactggatcgccgcttccattatcctcgagttctttctgatggtgcttctgatccccgagccggacagcaacgccacccgccaggataatcagctcgcctatgtggtcattggactgctgttcatgatcctcacagtggctgccaacgagatgggccttctggaaacgaccaaaaaggacctgggcattgggcatgttgcggtggagaatcaccaccatgccgctatgctcgatgtcgacctgcaccctgcctctgcttggacactttacgccgtggcgaccacaatcattacccccatgatgagacatacgatcgaaaacaccacagccaacatttccctgaccgctatcgccaatcaggctgccatcctcatgggactggctaagggctggcccattagcaaaatggatatcggggtccctctgctcgcccttggatgctactctcaagtgaacccgctgacactgaccgcgcccgttctcatgctggtgcctcactatcccattatcggccctgggcttcaggccaaggctacgcgggaggcccagaaacgcacagctgccggaattatgaagaatcccaccgtcgacggcatcgtggccatcgatctggaccctgttgtgtacgatgcgaaatttgaaaagcaactcggccagattatgctgctgatcctctgtacaagccagattcttctgatgagaaccacctgggctctgtgcgagtccatcacactcgccacggggccgctgaccacactttgggagggatctcccggcaagttctggaacaccacaattgctgtcagcatggccaatatcttccgggggtcctatctggccggagctggcctcgcctttagcctgatgaaatccctcgggggaggccgcagaggcaccggggcgcagggagaaacgctcggcgagaagtggaaacggcaacttaaccagctgacaaagtctgagttcaatacctacaaaagaagcgggatcatggaggtggaccgctccgaagccaaggagggactgaagcggggcgagaccacaaaacatcctgtgtctagagggaccgctaagctccgctggtttgttgaacggacactggtcaaacccgagggaaaggtgattgatcttggctgtggcagagggggatggagctattactgcgccggcctgaaaaaggtgacggaagtcaaggggtataccaaaggaggccctgggcacgaggaccccatcccgatgggaacatacggctggaacctcgttaagctgcgctccggcaaagatgtgttctttattcctcccgaaaagtgtgacaccctgctctgcgacatcggggagtctagccccaatcctacaattgaggaaggacggacccttagagtgctgaaaatggtcgagccctggctgcgcggcaaccagttctgtatcaagattctcaatccttacatggcttccgtggttgaaacgctggagcagatgcaacggaaacacgggggaatgcttgtgagaaacccgctgagccgcaattctacccatgagatgtattgggtctcctggggcacagggaacatcgtgagcgccgttaatatgacctctcggatgctcctgaacagatttacaatggcgcaccgcaagcccacctacgaaagagatgtggacctgggagccggcacacggcatgtcgctgtggagcctgaagtggccaatctcgatatcattggccagcgcatcgagaacattaagcacgaacacaaatccacctggcattatgacgaggataacccctacaagacgtgggcttatcacgggagctacgagggaaaaccttctggctccgccagctccatggtcaatgggggagttaagctgcttacaaaaccctgggacggcatcccgatggtgacccagattgctatgaccgatacaacgcctttcgggcagcaaagagtgtttaaggaaaaggtcgacacccggacacccaaagccaagagaggcaccgcgcagatcatggaggtgacagccaaatggctgtggggattcctcagccggaacaagaaacctcgcatctgcaccagagaagagtttacacggaaggttcgctctaatgctgccattggcgctgtgttcgtcgatgaaaaccagtggaatagcgccaaggaggccgtggaggacgaaagattttgggatctggttcatcgggagcgcgaacttcacaaacaagggaagtgtgcgacctgcgtgtataacatgatgggaaaaagagagaagaaactgggcgagttcgggaaggctaagggatcccgggccatctggtacatgtggctcggcgcccgcttcctggagtttgaggctctggggttcatgaatgaagaccattggttttctagagagaacagcctctccggcgtcgaaggagagggcctgcacaaacttgggtacattctgcgggacatctctaagattcccggaggcaatatgtatgccgatgacacggctgggtgggatacccgcatcacagaggacgatctccagaacgaagccagaatcaccgacattatggagcctgaacacgcgctgcttgccaaaagcatcttcaagctgacataccagaataaagtggttcgggtgcagcgccccgctaagaacggaaccgtcatggatgtgatttccagacgggaccaaagaggctctgggcaggtcggcacgtatggactcaatacatttaccaacatggaggcccagctgatccgccagatggaaagcggcgggattttctccccgcgggagctggagacacctaatctcgctgaaagagtgctggattgggttgagaaatacggagtggaacgccttgagcggatggccatcagcggcgacgattgcctgggggaacccatctatgacagatttgcgaccgccctcacggctctgaacgatatgggaaaggtccgcaaggacattccccaatgggagccttctaaaggctggaacgactggcagcaggggccgttctgttcccatcactttcatcagcttatcatgaaggatggccgggagattgtggtgccctgcagaaatcaagacgaactggttggacgcgcccgggtgagccagggcgctgggtggtctctcagagagaccgcctgtctgggaaaatcctacgctcagatgtggcagctgatggatttccaccgccgggacctcagactggccgcgaacgccatctggagcgctggccctggggattggattcccacacggagaaccacatggtccatccacgcccatcaccaatggatgaccacagaagacatgctttctgtctggaatcgcgtgtggattgaggaaaacccttggatggaggataagacccatatcagctcctggggagacgttccctatctgggcaaacgggaggatcagtggtgcggcagcctcatcgggctgacggccagagctacatgggccaccaatattcaggtggcgatcaaccaagtccgcagacttattggaaatgaaaactacctggactacatggcttctatgaagcggtttaagaatgagtccgatcctgaaggcgccctctggtga

SEQ ID NO: 19172 - RNA, 9879 nt, synthetic construct
  misc_feature 1..9879: note = derived and/or modified CDS sequence (opt5) from DENV-1__KF921942__SS-prME
  source 1..9879: mol_type = other RNA
agcgtgaccatgctgctcatgctgatgcccacagcccttgctttccacctgacgaccagaggcggggaacctcatatgatcgtctccaagcaggaacgggggaaatctctcctgtttaagaccagcgccggcgttaacatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcgctaaccctgccgttctgcgcaaactttgcattgaagcgaagatctccaataccacgacagatagcagatgtccgacccaaggagaggccaccctggtggaagaacaagacgctaacttcgtgtgccggcgcacatttgtcgatagaggctggggcaatgggtgtggactcttcggcaaagggtctctgattacctgcgccaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagctaccattacgccccaggcccctaccacagagatccagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaattcagacatccggaaccacaaccatctttgctggccatctcaaatgcagactgaagatggataaacttacgctgaaggggatgagctatgtgatgtgtacaggctctttcaaactcgagaaggaactggccgagacccagcacggaaccgtcctggtgcagattaagtacgagggcacagacgcgccgtgcaaaatccctttctccacccaagatgaaaagggggttacacagaacggacggcttatcacggctaatcccattgtgaccgacaaagagaagcctgtcaacatcgaagccgagccgccctttggcgagagctatattgtgatcggggccggagaaaaagctctcaagctgtcttggttcaagaaaggcagctccattgggaagatgtttgaggccacagctagaggcgcccgccggatggcgatcctgggagataccgcctgggacttcggctctatcgggggagtgtttacaagcgctggcaaactcgttcatcagattttcgggaccgcctacggagtcctgttttccggcgtgagctggacgatgaagatcgggattggcgtgcttctgacctggctcggactcaattctagatccacaagcctgtctatgacctgtatcgctgtcggccttgtgacactctacctgggggttatggtgcaggccgattccggatgcgtcattaactggaaaggccgcgaactgaagtgtgggagcggaatcttcgtgaccaatgaggttcacacatggaccgaacaatataagtttcaggcggactcccctaaacggctctctgccgctattggcaaggcctgggaggagggggtgtgcggcatcagaagcgctacgcgcctggaaaacatcatgtggaaacagatttccaacgagcttaatcatatcctgctcgaaaacgacatgaagttcacagtcgtggttggagatgtggccggcattctggcccaggggaaaaagatgatccggccgcaacccatggagtacaaatattcttggaaaagctggggaaaggctaagattatcggcgcggacgtccagaataccacctttatcattgatgggcctaacacacccgaatgtcctgacgatcagagagcctggaatatctgggaggtggaggactacggattcggcatttttaccacgaacatctggctgaaacttcgcgattcctatacacaggtgtgcgaccaccggctcatgagcgctgccattaaagattctaaggccgtccacgctgacatgggctactggatcgaatccgagaaaaatgaaacctggaagctggccagagcgagcttcatcgaggttaagacatgtatttggcccaaatctcataccctgtggtccaacggggtgctcgaaagcgagatgatcattccgaagatctatggaggccctatttctcaacacaattaccgccccgggtacttcacacagaccgctggaccttggcatctgggcaaacttgagctggattttgacctctgcgaagggacgaccgtggtcgtggatgagcactgcggaaaccggggccccagcctgagaacaaccacagttaccggcaagatcatccacgaatggtgttgccggtcctgtacgctgcctccccttcgcttcagaggggaggacggatgctggtatggcatggagattcggccggtgaaagaaaaggaggaaaatctcgtcaagagcatggtgtctgccgggtccggagaggttgacagcttttccctgggcctgctctgtatctctattatgatcgaagaggtgatgagaagccgctggtcccggaaaatgctgatgacagggacccttgccgtcttctttctgctcattatgggacagctgacatggaacgatctgatcagactttgcattatggtgggcgctaatgcctctgaccgcatgggcatggggaccacctacctggcgctcatggctacattcaagatgagacctatgtttgccgttggactgctgttccggcgcctgacgagcagagaggtgcttctgctcaccatcggcctgtccctggtcgcctctgtggaacttcccaacagcctggaggaactcggggatggactggctatgggcatcatgattctcaaactgcttacagactttcaatcccatcagctgtgggccaccctcctgagcctgacattcatcaagaccacgttttctcttcactatgcttggaaaacaatggccatggtgctgtccattgtcagcctcttccccctgtgtctctctaccacctcccagaagacaacctggctgcctgttcttctggggagcctgggatgcaagccgctcacaatgtttctgatcgcggagaataaaatttggggccggcgctcttggccccttaacgaaggcatcatggccgtggggatcgtgtccattctgctcagctccctgctcaagaacgatgtccctctggctggaccccttatcgccggcgggatgctgattgcttgttacgtgatcagcggatctagcgccgacctgtccctcgagaaagccgctgaggtttcttgggaagaggaagcggagcatagcggcgcctcccacaatattctggtggaagtccaggatgacgggacgatgaagatcaaagatgaggagagagacgatacccttacaatcctgctcaaggctaccctgctcgccgtgtctggagtttatcctctgagcattcccgccacacttttcgtgtggtacttctggcagaagaagaagcagcggtccggcgtcctgtgggacaccccttctcccccggaagtggagcgcgctgtcctggatgacggcatctatagaattatgcagcgggggctcctgggacgcagccaggtgggcgttggggtgtttcaagaaaacgtcttccatacgatgtggcacgtgaccagaggagccgttcttatgtaccagggcaaacggctggagccttcctgggcgagcgtgaagaaagacctcatctcttacgggggaggctggagactgcagggctcctggaatacaggggaggaagtccaggtgattgctgtggagcccggaaagaaccctaaaaatgttcaaaccgcccccggcacatttaagaccccggaaggggaggtcggagccatcgctctcgatttcaagcctggcacaagcgggtctcccattgtgaaccgcgaaggaaaaatcgtgggcctgtatggcaatggggtcgtgacgacctccggaacatacgttagcgccatcgcgcaggctaaggcctcccaggagggccctcttcccgagattgaagacgaggtgtttcggaaaagaaacctgaccatcatggatctgcaccccgggtctggaaagacccgccggtatctccctgccattgtcagagaagctatcaaacgcaagctgcggacacttattctggccccgacgagagtggttgctagcgagatggccgaagcgctcaagggcatgcccatccgctaccaaaccacagccgtgaaatccgagcataccgggaaggagatcgtcgacctgatgtgccacgctacattcaccatgcggctgctcagccctgtgagagttcccaattataacatgattatcatggatgaagcccattttacggacccttcttccattgctgcccggggctacatcagcacacgcgtgggaatgggcgaggccgctgcgattttcatgaccgccacaccccctgggtctgtcgaggcttttccgcagagcaatgccgtgatccaggatgaggaaagagacatccccgagcggtcctggaactctggatatgagtggattacagatttccctggcaaaaccgtgtggtttgtccccagcatcaagtccgggaatgacattgccaactgtcttcgcaaaaatggaaagagagttatccagctgtctcggaagacattcgataccgaataccagaagacgaagaacaacgactgggactacgtggtgacaaccgatattagcgagatgggcgctaatttcagagccgaccgcgtcatcgatcctcggagatgcctgaaacccgtgattctcaaggacgggccggaacgcgttatcctggcgggccctatgcccgtgacagtcgcttccgccgcccagcggagaggacgcatcggccggaaccacaataaagagggggatcagtatatttacatgggacagccccttaacaatgacgaggatcatgctcactggaccgaagccaagatgctgctcgacaacatcaatacgcctgagggcattatccccgcgctgtttgaacctgagagagaaaagagcgccgctattgatggggagtatcgcctgagaggagaggcccggaaaaccttcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatctggacaaaagagggagaacggaagaaactcagaccccgctggctggacgcccggacctactccgaccctcttgctctgagagagtttaaggagttcgccgcgggccgccggtctgtcagcggggatctcatcctggagattggaaaactgccccagcacctcacacagagagcccaaaatgctcttgacaacctggtgatgctgcataattccgaacagggcgggcgggcctatcgccacgctatggaggagctccctgataccatcgaaacactgatgcttctggccctcattgccgttctgaccggaggcgtgacgctgtttttcctctctggcagagggcttggaaagacaagcatcggcctgctgtgtgtgatggcttccagcgtcctcctgtggatggcgtctgttgagccccattggattgccgcttccatcatccttgaatttttcctgatggtgctcctgattccggagcctgaccggcagcgcacaccccaagataaccaactggcctacgtggtcatcgggctcctttttatgattctgaccgtggccgctaatgagatgggactgctcgaaaccaccaagaaagacctgggcatcgggcacgttgccgtggagaaccaccatcacgcggccatgcttgatgtcgacctgcatcctgctagcgcctggacactctacgctgtggccacgaccattatcacacccatgatgagacacaccattgaaaacacaaccgcgaatatctctctgacggccatcgctaaccaggccgctattctgatgggactcgataagggctggcctatctccaaaatggacattggcgtcccccttctggccctggggtgctatagccaggtgaatccgctcaccctgacagctgccgttcttatgctggtggcgcattacgccatcattggacctggcctccaagctaaggccacccgggaggctcagaaacgcacagccgccgggatcatgaagaaccccaccgtcgatggaatcgtggcgattgacctggatcccgttgtgtatgacgctaagttcgaaaaacagctgggccagatcatgctccttattctgtgtacgtctcaaatcctgctcatgagaacaacctgggccctgtgcgagagcattacacttgctaccgggcctctgaccacactctgggagggatccccgggcaagttttggaatacgaccatcgccgtctctatggccaacatcttccggggcagctacctggctggggccggactggcgttctccctcatgaaaagccttggcgggggacgcagaggcacaggggcccagggagaaaccctgggcgagaagtggaaacggcagctgaatcagctctccaagtctgaatttaacacatataagagaagcggcattatggaggtggaccgctccgaagctaaagaggggctgaagcggggagagaccacgaaacacgccgtgtctagaggcacagctaaacttcgctggttcgttgaacggaatctggtcaaacccgaggggaaggtgatcgatctcggatgtggcagagggggatggagctactattgcgccggcctgaagaaagtgaccgaagtcaagggctacaccaaagggggacctggccacgaggaacccattcctatggcgacatacgggtggaacctggttaagctccattccggaaaagacgtgtttttcattccccctgagaagtgtgatacccttctgtgcgacatcggcgagtctagcccgaatcccacaatcgaagaggggcgcacgctgcgggtgctcaaaatggtcgaaccttggctgagaggaaaccaattttgtattaagatccttaatccctatatgccttccgtggttgagaccctggagcagatgcagcgcaagcacggcggcatgctcgtgcggaaccccctgagcagaaattctacacatgaaatgtactgggtctcctgcgggaccggaaacatcgtgagcgccgttaatatgacatctcgcatgctgctcaaccggttcaccatggctcacagaaaaccgacgtatgagcgcgatgtggacctgggcgccgggaccagacacgtcgctgtggaacctgaggtggccaaccttgatattatcggacagcggattgaaaatatcaagcatgagcacaaatccacatggcattacgacgaggataacccctataagacctgggcttaccacggcagctatgaagtcaaaccctctgggtccgccagctccatggttaatggagtggtgaagctgctcacaaagccttgggacgtcattcccatggtgacccaaatcgcgatgacagataccacgccttttggccagcagcgcgttttcaaagagaaggtggacacaagaaccccgaaagccaagcggggcaccgctcaaatcatggaagtcacagccaaatggctgtgggggtttcttagcagaaacaagaagccccggatttgtacgcgcgaggagttcaccagaaaagtgcggtctaatgctgccatcggagccgtttttgtggacgagaaccagtggaatagcgcgaaggaggctgtcgaagatgagcgcttctgggacctggtgcatagagaacgggagctccacaaacagggcaagtgcgccacatgcgtttacaacatgatggggaaacgcgaaaagaagctgggagagtttggcaaagccaaggggtccagagctatttggtacatgtggctgggcgcccggttcctcgagttcgaagctctgggatttatgaatgaggatcactggttctctcgcgaaaacagcctttccggcgtggagggggagggactgcataaactcggctatatcctgagagacatttctaagatccctgggggaaatatgtacgccgatgacaccgcgggctgggatacacggatcaccgaagacgatcttcagaacgaggcccgcattacagacatcatggaacccgagcacgctctgctcgccaaaagcatttttaagctgacctatcaaaataaagtcgtgagagtccagcggcctgctaagaacgggacggtgatggatgttatctcccgcagagaccagcggggctctggacaggtgggcacctacgggctgaatacattcaccaacatggaagcccaactcattagacagatggagagcgagggaatcttttcccccagcgaactggagacaccgaaccttgcggaacgcgtcctggattggctcgagaagtatggcgtggaacggctgaaaagaatggccatctctggggacgactgtgtggttaagcctattgatgaccgcttcgctaccgcccttacggctctgaatgatatgggaaaagtgcggaaggacatcccccagtgggagccttccaaaggctggaacgattggcagcaagtccccttttgcagccatcacttccaccagctcattatgaaggacgggagagagatcgtggttccttgtcgcaatcaggatgaactggtgggccgggccagagtctctcagggagctggctggtccctgcgcgagacagcctgcctcggaaagagctacgcgcaaatgtggcagctgatgtattttcatcggagagaccttcgcctggccgctaacgccatttgttccgccgtgcccgtcgattggatcccgacctctcggacaacctggagcattcacgctcatcaccagtggatgacgaccgaagacatgctctccgtgtggaatagagtttggatcgaggaaaacccttggatggaggataaaacacatatcagctcttggggagacgtgccctacctgggcaagcgggaggaccaatggtgcgggtcccttattggactgaccgccagagcgacatgggctaccaatatccaggtcgccattaaccaggtgcgccggctcatcggcaatgaaaactacctggattatatgacaagcatgaaaagattcaagaatgagtctgaccccgaaggggccctgtggtga

SEQ ID NO: 19173 - RNA, 9879 nt, synthetic construct
  misc_feature 1..9879: note = derived and/or modified CDS sequence (opt5) from DENV-1__JF937602__SS-prME
  source 1..9879: mol_type = other RNA
agcgtgacaatgctgctcatgctgatgcccacagcccttgctttccacctgacgacccggggaggggagcctcatatgatcgtgtccaagcaggaacggggaaaatctctcctgtttaagacaagcgccggcgttaacatgtgcacccttattgcgatggacctgggggagttctgtgaagatacaatgacctacaaatgcccccgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttctgacacaagatgaaaagggggtgacccagaacggacggctgatcacagctaatcccattgtcacggacaaagagaagcctgtgaacatcgaagccgagccgcccttcggcgagagctatattgtgatcggggccggagaaaaagctcttaagctctcttggtttaagaaaggcagctccattgggaagatgttcgaggccaccgctagaggcgcccgccggatggcgatcctgggagatacagcctgggactttggctctatcgggggagttttcaccagcgtcggcaaactggtgcatcagatttttgggacagcttacggagtcctgttctccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatctttgtgacaaatgaggtccacacctggacagaacaatataagttccaggccgactcccctaaacggctgtctgcggccattggcaaggcttgggaggagggggtgtgcggcatcagaagcgccacccgcctcgaaaacatcatgtggaaacagatttccaacgagctgaattacatccttctggaaaacgacatgaagctcacggttgtggtcggagatgtggctggcattctggcccaggggaaaaagatgatccggccgcaacccatggagtataaatactcttggaaaagctggggaaaggccaagattatcggcgctgacgtgcagaatacaacctttatcattgatgggcctaacacccccgaatgtcctgacgatcagagagcgtggaatatctgggaggtcgaggactatggattcggcatttttacaaccaacatctggctgaaacttcgcgattcctacacgcaggtttgcgaccatcggctcatgagcgccgctattaaagattctaaggccgtgcacgccgacatgggctattggatcgaatccgagaaaaatgaaacatggaagctggctagagccagcttcatcgaggtgaagacctgtatttggcccaaatctcacacactgtggtccaacggggtcctcgaaagcgagatgatcattccgaagatctacggaggccctatttctcaacataattaccgccccgggtatttcacccagacagcgggaccttggcacctgggcaaacttgagctggattttgacctctgcgaagggaccacggtggttgtggatgagcattgcggaaaccggggccccagcctgagaaccacaaccgtcacaggcaagatcatccacgaatggtgttgccggtcctgtaccctgcctccccttcgcttcaaaggggaggacggatgctggtacggcatggagattagaccggtgaaggaaaaggaggaaaatctcgttaaaagcatggtgtctgctgggtccggagaggtcgacagcttttccctgggcctgctctgtatctctattatgatcgaagaggtgatgcggagcagatggtcccgcaagatgctgatgacggggacacttgccgttttctttctgctcattatgggacagctgacctggaacgatctgatccggctttgcattatggtgggcgccaatgcttctgacagaatgggcatggggacaacctatctggccctcatggcgaccttcaaaatgcgccctatgtttgctgtcggactcctcttcagacggctgacaagccgcgaggtgcttctgctcacgatcggcctgtccctggtggcctctgtcgaacttcccaacagcctggaggaactcggggatggactggccatgggcatcatgattctcaagctgcttaccgactttcaatcccaccagctgtgggctacactcctgagcctgaccttcgttagaacaaccttttctcttcattacgcctggaaaacgatggctatggtgctgtccatcgtgagcctcttccccctgtgtctctctacaacctcccagaagaccacatggctgcctgtccttctggggagcctgggatgcaagccgctcaccatgtttctgattgccgagaataaaatctggggccggaagtcttggccccttaacgaaggcattatggcggtggggatcgtttccatcctgctcagctccctgctcaaaaacgatgtgcctctggccggaccccttattgctggcgggatgctgatcgcctgttatgtcattagcggatctagcgctgacctgtccctcgagaaggccgccgtggtttcttgggaggaagaggctgaacacagcggcgcgtcccataatatcctggtggaggtccaggatgacgggacaatgaaaattaaggatgaagaaagagacgatacgcttaccatcctgctcaaagccacactgctcgctgtgtctggagtctaccctctgagcatccccgccacccttttcgtgtggtatttctggcaaaagaagaaacagagatccggcgttctgtgggacacaccttctcccccggaggtggaacgggccgtcctggatgacggcatttaccgcatcatgcagagagggctcctgggacggagccaggtgggcgttggggtgtttcaagagaacgtcttccacaccatgtggcatgtgacgcgcggagctgtgcttatgtaccagggcaagagactggaaccttcctgggccagcgttaaaaaggacctcatttcttatgggggaggctggcggctgcagggctcctggaataccggggaggaggtccaggtgatcgcggtggaacccggcaagaatcctaagaatgtccaaacagctcccggcacctttaagacaagcgagggggaagtgggagccattgccctcgatttcaaaccgggcacctctgggtcccctatcgttaacagagagggaaagattgtgggcctgtacggcaatggggtcgtgacaacgagcggaacctatgtttccgctatcgcccaggcgaaggcttctcaggaaggcccccttcctgagatcgaggacgaagtgtttcgcaagcggaacctgacaattatggatctgcaccccgggagcggaaaaaccagacgctacctccccgccatcgtccgggaggccattaagagaaagctgcgcacccttatcctggctcctacacgggtggttgcctccgaaatggctgaggccctcaaaggcatgccgattagatatcaaacgaccgcggtgaagtccgaacacacagggaaagagatcgtcgacctgatgtgccatgccaccttcacaatgcgcctgctctctcccgtgcgggtgcctaattacaacatgatcattatggatgaggctcactttaccgacccctccagcatcgccgctagaggctatatttctacgcgggtcggaatgggcgaagccgccgctatcttcatgacagcgacccctcccgggagcgttgaggcctttcctcagtccaatgctgtgattcaggatgaggaacgcgacatcccggaaagatcttggaacagcggatacgagtggatcaccgatttccccggcaagacagtgtggtttgtcccttccattaaatctgggaatgacatcgccaactgtcttcggaagaatggaaagcgcgtgattcagctgagcagaaaaaccttcgatacagagtaccaaaagaccaaaaacaacgactgggactatgttgtgacgacagatatctccgaaatgggcgccaatttccgggctgacagagtcattgatccccgccggtgcctgaagcctgtgatcctcaaagacgggcccgagagagttattctggccggcccgatgcctgtgaccgtcgcgagcgctgcccagcgccggggaagaatcggccgcaaccataataaggaaggggatcagtacatctatatgggacagccccttaacaatgacgaggatcacgcccattggacagaggctaagatgctgctcgacaacattaatacccccgaaggcatcattcctgccctgtttgagcccgaacgggagaaatctgcggccatcgatggggaatacagactgcgcggagaggctagaaagacgttcgtggagctcatgcggcgcggcgaccttcctgtctggctgtcctataaagtggccagcgaagggtttcaatactccgatagacggtggtgcttcgacggcgagcgcaacaatcaggttctggaagagaacatggatgtggaaatttggaccaaggagggagagcgcaaaaagctccggccgagatggctggacgctcgcacatattctgacccccttgccctgcgggaatttaaagagttcgctgccggcagacgcagcgtgtccggggatctcatcctggaaatcggaaagctgcctcagcacctcacccagcgggcgcaaaatgcccttgacaacctggtcatgctgcacaattctgagcagggcgggagagcttaccggcatgccatggaggaactccccgatacaattgagaccctgatgcttctggctctcatcgccgttctgacaggaggcgtgaccctgtttttcctcagcggccgcgggcttggaaagacgtccattggcctgctgtgtgtgatggccagctctgtcctcctgtggatggcttccgtggaacctcactggatcgcggccagcattatccttgagtttttcctgatggttctcctgatccccgaaccggacagacagcggacacctcaggataaccaactggcttacgtggtcattgggctcctttttatgatcctgaccgtggccgccaatgagatgggactgctcgagaccaccaaaaaggacctgggcattgggcatgtcgctgtggaaaaccaccaccatgccgcgatgcttgatgttgacctgcaccccgcctctgcttggaccctctatgccgtggctacaacgatcattacccctatgatgcgccatacaatcgagaacaccacagccaatatttccctgaccgcgatcgccaaccaggctgccatcctgatgggactcgataaaggctggcccattagcaagatggacatcggcgtccctcttctggctctggggtgctactctcaggtgaatcccctcacgctgaccgccgctgttcttatgctggtggcccactatgcgattatcggaccgggcctccaagccaaagctacaagagaagcccagaagcggaccgctgccgggattatgaagaaccctacagtcgatggaatcgtggccatcgacctggatcccgtggtttacgacgcgaaattcgagaagcagctgggccagattatgctccttatcctgtgtaccagccaaattctgctcatgcgcacgacatgggctctgtgcgaatccatcacccttgccacagggcccctgaccaccctctgggagggatctcctggcaaattttggaatacaacgattgctgtcagcatggccaacatcttcagaggctcctatctggccggggctggactggccttcagcctcatgaagtcccttggcgggggacggcgcggcaccggggcgcagggagagacactgggcgaaaaatggaagagacagctgaatcagctctctaagagcgagtttaacacctacaaacggtccggcatcatggaagtggacagatctgaggccaaggaagggctgaaacgcggagagacaaccaagcatgctgtgagccggggcacggccaaacttagatggttcgtcgagcgcaatctggttaagccggaagggaaggtgattgatctcggatgtggcagagggggatggtcctattactgcgctggcctgaaaaaggtgacagaggtcaaaggctacaccaaagggggacccggccacgaggagcctatccccatggccacctatgggtggaacctggtgaaactccactctggaaaggacgtgtttttcattcctcccgaaaaatgtgatacacttctgtgcgacatcggcgagagctcccctaatccgaccattgaggaagggagaacactgcgcgttctcaagatggtcgagccctggctgcggggaaaccaattttgtatcaagattcttaatccttacatgcccagcgtggttgaaacgctggagcagatgcagagaaaacatggcggcatgctcgtgcgcaaccctctgtctagaaattccacccacgagatgtattgggtcagctgcgggacaggaaacatcgtgtctgcggtgaatatgacctccagaatgctgctcaaccgcttcacaatggcccatcggaagcccacctacgaaagagatgtcgacctgggcgctgggacgcgccacgttgccgtggagccggaagtggctaaccttgatatcattggacagagaatcgagaatattaaacacgaacataagagcacctggcactatgacgaggataacccttacaaaacatgggcctatcatggctcttacgaggtcaagccctccgggagcgcttccagcatggtgaatggagttgtgaagctgctcaccaaaccctgggacgtcatccctatggtgacacaaattgccatgaccgatacaaccccctttggccagcagcgggttttcaaggaaaaagtggacacgcgcacacctaaggcgaaaagaggcaccgcccaaatcatggaggtcaccgctaagtggctgtgggggtttctttctcggaacaagaaaccgagaatctgtacacgggaagagttcacgcgcaaggtgagaagcaatgccgctattggagccgtttttgtggacgaaaaccagtggaactccgccaaagaggcggtcgaggatgaacggttctgggacctggtgcaccgcgagagagaactccataagcagggcaaatgcgctacctgcgtctacaacatgatggggaagcgggagaagaaactgggagaatttggcaaggccaaagggtctcgcgccatctggtatatgtggctgggcgctagattcctcgagttcgaggccctgggatttatgaatgaagatcactggttcagccgggagaactccctttctggcgtggaaggggagggactgcacaagctcggctacattctgcgcgacatcagcaaaattcccgggggaaatatgtatgctgatgacacagccggctgggataccagaatcacagaggacgatcttcagaacgaagcgaagatcaccgacattatggagcctgaacatgccctgctcgctaaatccatctttaagctgacataccaaaataaggttgtgcgggtccagcgccccgccaaaaacgggaccgtgatggatgtgatttctagacgggaccagcgcggcagcggacaggttggcacgtatgggctgaataccttcacaaacatggaggctcaactcatcagacagatggaatccgagggaatttttagcccttctgagctggaaacccccaaccttgccggccgggtgctggattggctcgagaagcacggggtcgaaagactgaaacgcatggcgatctccggagacgactgtgtggttaagccgatcgatgaccggttcgccacagctcttaccgccctgaatgatatgggcaaagtgagaaaggacattcctcagtgggagcccagcaaggggtggaacgattggcagcaagtccctttttgctctcatcacttccaccagctcatcatgaaagacggccgcgaaattgtggtcccctgtcggaatcaggatgagctggtgggacgggctcgcgtttcccagggcgccgggtggagcctgcgggagacggcttgcctcggaaagtcctacgcccaaatgtggcagctgatgtattttcatagacgcgaccttcggctggcggccaacgctatctgttctgccgtgcctgtcgattgggtgcccacaagcagaaccacatggtccattcacgcccatcaccagtggatgaccacggaagacatgctcagcgtttggaatcgcgtgtggatcgaggaaaacccgtggatggaggataaaacccatatttcttcctggggcgacgtcccttacctggggaagcgggaagaccaatggtgcggaagccttatcggcctgacagctagagccacctgggcgacaaatatccaggtggctattaaccaggtgcggagactcctggggaatgagaactacctggattatatgacctctatgaaacgcttcaagaatgagagcgaccccgaaggcgccctctggtga

SEQ ID NO: 19174 - RNA, 9879 nt, synthetic construct
  misc_feature 1..9879: note = derived and/or modified CDS sequence (opt5) from DENV-1__GU131729__SS-prME
  source 1..9879: mol_type = other RNA
agcgtgaccatgctgctcatgctgatgcccacagcccttgctttccacctgacgaccagaggaggggaacctcatatgatcgtgtccaagcaggaacgggggaaatctctcctgtttaagacaagcgccggagttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgggaaaactttgcattgaagccaagatctccaatacgacaaccgatagccgctgtccgacccaaggcgaggcgacactggtggaagaacaagacgccaacttcgtgtgcagacggacctttgtcgatcgcggctgggggaatggatgtggcctcttcgggaaaggatctctgattacatgcgctaagtttaagtgcgtgacgaaacttgagggcaagatcgttcagtacgaaaacctgaaatattccgtgatcgtcaccgtgcacacaggggaccagcatcaagttggaaatgagagcaccgaacacggcacaaccgccacgattacaccccaagctcctaccaccgagatccagctcacagactacggcgccctgaccctggattgttctcccagaacggggctcgacttcaacgaaatggtgctgcttacaatgaaggagaaatcctggctggtccataagcagtggtttctcgatctgcctcttccctggaccagcggagcctccacatctcaagagacctggaatcggcaggacctgctcgtgaccttcaaaacagctcacgcgaagaagcaggaagtcgtggttctgggcagccaagagggggccatgcacacggctctgaccggagccacagaaattcagacctccggcacaaccacgatctttgccgggcatctcaaatgccgcctgaagatggataaacttacactgaagggcatgagctatgtgatgtgtaccggatctttcaaactcgagaaggaactggctgagacccagcacggcacagtcctggtgcagattaagtacgaggggaccgacgccccgtgcaaaatccctttctccacacaagatgaaaagggagttacgcagaacggcagacttatcaccgcgaatcccattgtgacagacaaagagaagcctgtcaacatcgaagctgagccgccctttggggagagctatattgtgatcggagccggcgaaaaagccctcaagctgtcttggttcaagaaagggagctccattggcaagatgtttgaggctaccgcccggggagctagacgcatggccatcctgggcgatacagcgtgggacttcgggtctatcggaggcgtgtttaccagcgttgggaaactcgtccatcagattttcggaacggcctacggcgtgctgttttccggggtgagctggaccatgaagatcggcattggagtccttctgacatggctcggcctcaattctcggtccaccagcctgtctatgacatgtatcgctgtggggcttgttaccctctacctgggagtgatggtccaggccgattccggctgcgtgattaactggaaagggagagaactgaagtgtggaagcggcatcttcgttacaaatgaggtgcacacctggacggaacaatataagtttcaggctgactcccctaaacgcctctctgccgcgattgggaaggcctgggaggagggcgtctgcggaatccggagcgctacaagactggaaaacatcatgtggaaacagatttccaacgagcttaatcatatcctgctcgaaaacgacatgaagttcaccgtggttgtgggcgatgtcgccgggattctggctcagggcaagaagatgatccgcccgcaacccatggagtacaaatattcttggaaaagctggggcaaggccaagattatcggggccgacgtgcagaataccacatttatcattgatggacctaacacccccgaatgtcctgacgatcagcgggcttggaatatctgggaggtggaggactacggcttcggcatttttacgacaaacatctggctgaaacttagagattcctatacccaggtctgcgaccaccgcctcatgagcgcggccattaaagattctaaggctgttcacgccgacatggggtactggatcgaatccgagaaaaatgaaacatggaagctggcccgggctagcttcatcgaggtgaagacctgtatttggcccaaatctcatacactgtggtccaacggagtgctcgaaagcgagatgatcattccgaagatctatggcgggcctatttctcaacacaattacagacccggatacttcacccagacggccggcccttggcatctggggaaacttgagctggattttgacctctgcgaaggaaccacagtcgtggttgatgagcactgcggcaaccgcggccccagcctgcggaccacaaccgtgacggggaagatcatccacgaatggtgttgcagatcctgtacactgcctccccttcggttccgcggagaggacggctgctggtatgggatggagattagaccggtcaaagaaaaggaggaaaatctcgtcaagagcatggtttctgcgggatccggcgaggtggacagcttttccctggggctgctctgtatctctattatgatcgaagaggtcatgcggagcagatggtcccgcaaaatgctgatgaccggaacacttgctgtgttctttctgctcattatgggccagctgacctggaacgatctgatccggctttgcattatggttggcgccaatgcctctgacagaatggggatgggaaccacatacctggctctcatggccacgttcaagatgcgccctatgtttgcggtgggcctgctgttcagacggctgaccagccgcgaggtccttctgctcacaatcgggctgtccctggtggcttctgtggaacttcccaacagcctggaggaactcggagatggcctggccatggggatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctgggaagcctgggctgcaagccgctcacgatgtttctgattgctgagaataaaatctggggcagacggtcttggccccttaacgaagggatcatggccgtgggaattgtgtccatcctgctcagctccctgctcaagaacgatgtccctctggcgggcccccttattgccgggggaatgctgatcgcttgttacgtgattagcggctctagcgccgacctgtccctcgagaaagctgccgaggtttcttgggaagaggaagccgagcatagcggggcttcccacaatatcctggtggaagtccaggatgacggacctatgaagatcaaagatgaggagcgcgacgatacccttacaattctgctcaaggcgaccctgctcgccgtgtctggcgtttatcccctgagcatccctgctacacttttcgtgtggtacttctggcagaagaagaagcagagatccggcgtcctgtgggacaccccctctccgcctgaagtggagcgggccgtcctggatgacgggatttatcgcatcatgcagagaggactcctgggccggagccaggtgggggttggagtgtttcaagaaaacgtcttccatacgatgtggcacgtgacccgcggcgccgttcttatgtaccaggggaaaagactggagccctcctgggctagcgtgaagaaagacctcatttcttacggaggcggctggcggctgcaggggtcctggaatacaggagaggaagtccaggtgatcgccgtggagcctggcaagaaccccaaaaatgttcaaaccgcgccggggacatttaagacccctgaaggagaggtcggcgctattgccctcgatttcaagcccgggacaagcggatctcctatcgtgaacagagaaggcaaaatcgtgggcctgtatgggaatggagtcgtgacgacctccggcacatacgttagcgccattgctcaggccaaggcgtcccaggaggggccccttcccgagatcgaagacgaggtgtttcgcaaacggaacctgaccattatggatctgcaccctggatctggcaagaccagacgctatctcccggctatcgtccgggaagccattaaaagaaagctgcgcacacttatcctggcccccacgcgggtggttgctagcgagatggccgaagctctcaaggggatgcctatcagataccaaaccacagccgtgaaatccgagcataccggcaaggagattgtcgacctgatgtgccacgcgacattcaccatgcgcctgctcagccccgtgcgggttcctaattataacatgatcattatggatgaagcccattttacggacccctcttccatcgctgccagaggatacattagcacacgggtgggcatgggggaggctgccgccatcttcatgaccgctacccctccgggatctgtcgaagcgtttccccagagcaatgccgtgatccaggatgaggaacgcgacattcctgagagatcctggaactctggctatgagtggatcacagatttccccgggaaaaccgtgtggtttgtccctagcattaagtccggaaatgacatcgctaactgtcttcggaaaaatggcaagcgcgttattcagctgtctagaaagacattcgataccgaataccagaaaacgaagaacaacgactgggactacgtggtgacaaccgatatcagcgagatgggggccaatttccgggccgctagagtcattgacccccgccggtgcctgaaaccggtgatcctcaaggatggccctgaaagagttatcctggccggacccatgcccgtgacagtcgcgtccgctgcccagcgccggggcagaattgggcgcaaccacaataaagagggagaccagtatatctacatgggccagcctcttaacaatgatgaggaccatgcccactggaccgaagctaagatgctgctcgataacattaatacgcccgaggggatcattcctgccctgtttgaaccggagcgggaaaagagcgcggccatcgacggagagtatagactgcgcggcgaggctagaaaaaccttcgtggaactcatgcggcgcggggatcttcccgtttggctgtcttacaaggtggcctccgagggctttcaatatagcgacagacggtggtgcttcgatggagaacgcaacaatcaggtcctggaggaaaacatggacgtggagatctggacaaaagagggcgaaagaaagaaactccggcctagatggctggatgctcgcacctactccgacccccttgccctgcgggagtttaaggagttcgctgccgggagacgctctgtcagcggagacctcattctggagatcggcaaactgcctcagcacctcacacagcgggcgcaaaatgcccttgataacctggtgatgctgcataattccgaacaagggggcagagcttatcggcacgccatggaggagctccccgacaccattgaaacactgatgcttctggctctcatcgccgttctgaccggcggcgtgacgctgtttttcctctctgggcgcggacttggcaagacaagcattgggctgctgtgtgtgatggcctccagcgtcctcctgtggatggcttctgttgagccgcattggatcgcggcctccatcattcttgaatttttcctgatggtgctcctgatccctgagcccgatagacagcggacccctcaggacaaccaactggcttacgtggtcattggactcctttttatgatcctgaccgtggccgccaatgagatgggcctgctcgaaacaaccaagaaagatctggggattggacacgttgctgtggagaaccaccatcacgccgcgatgcttgacgtcgatctgcatcccgccagcgcttggacactctacgccgtggctacgaccatcattacacctatgatgcgccacaccatcgaaaacacaaccgccaatatctctctgacggcgattgccaaccaggctgccatcctgatgggcctcgacaagggctggcccatttccaaaatggatatcggggtcccgcttctggctctgggatgctatagccaggtgaatcctctcaccctgacagccgctgttcttatgctggtggcccattacgcgattatcggccccgggctccaagccaaggctaccagagaggcccagaaacggacagctgccggaatcatgaagaaccccaccgtcgacggcattgtggccatcgatctggaccctgttgtgtatgatgcgaagttcgaaaaacagctggggcagattatgctccttatcctgtgtacgtctcaaattctgctcatgcgcacaacctgggctctgtgcgagagcatcacacttgccaccggaccgctgaccacactctgggagggctcccccggcaagttttggaatacgaccatcgctgtctctatggccaacattttcagagggagctacctggccggagctggcctggccttctccctcatgaaaagccttgggggaggccggcgcgggacaggagcgcagggcgaaaccctgggcgagaagtggaaaagacagctgaatcagctctccaagtctgaatttaacacatataagcggagcgggatcatggaggtggacagatccgaagccaaagagggactgaagcgcggcgagaccacgaaacacgctgtgtctcgggggacagccaaacttagatggttcgttgaacgcaccctggtcaaacctgagggaaaggtgattgacctcggctgtgggcggggaggctggagctactattgcgctggcctgaagaaagtgaccgaagtcaaggggtacacaaaaggaggccccgggcacgaggaacctatccccatggccacctacggatggaatctggttaagctccattccggcaaagatgtgtttttcattcctccggagaagtgtgacacacttctgtgcgatatcggggagtctagccccaaccctacgattgaagagggaagaaccctgcgcgtgctcaaaatggtcgaaccctggctgcggggcaatcaattttgtatcaagatccttaacccttatatgccctccgtggttgagacactggagcagatgcagagaaagcacggcgggatgctcgtgcgcaatccgctgagccggaactctacccatgaaatgtactgggtctcctgcggaacaggcaatattgtgagcgcggttaacatgacctctagaatgctgctcaatcgcttcacgatggcccaccggaaacctacctatgagagagacgtggatctgggggctggaacacgccacgtcgccgtggaacccgaggtggctaaccttgacatcattggccagagaatcgaaaacattaagcatgagcacaaatccacctggcattacgatgaggacaatccctataagacatgggcctaccacgggagctatgaaggaaaaccttctggctccgctagctccatgggcaacggggtcgttaagctgctcaccaagccctgggatgtgatccctatggtgacacaaatcgccatgaccgacacgacaccgtttggacagcagcgggtcttcaaagagaaggtggatacccgcacccccaaagcgaagagaggcacagcccaaattatggaagttacggctaaatggctgtgggggtttcttagccggaataagaagcctagaatctgtacccgggaggagttcacacgcaaagtgagatctaacgccgctattggagccgtctttgtggacgagaatcagtggaacagcgccaaggaggcggttgaagacgagcggttctgggatctggtgcatcgcgaaagagagctccacaaacagggcaagtgcgctacctgcgtctacaatatgatggggaaacgggaaaagaagctgggcgagtttggaaaagccaagggctcccgcgccatctggtacatgtggctgggggctagattcctcgagttcgaagccctgggatttatgaacgaggaccactggttctctcgggaaaatagcctttccggcgtggagggggagggactgcataaactcggctatattctgcgcgatatctctaagatccccgggggcaacatgtacgctgacgatacagccggatgggacaccagaattacagaagatgaccttcagaatgaggcgcggatcaccgatattatggaacctgagcacgccctgctcgctaaaagcatctttaagctgacgtatcaaaacaaagttgtgcgcgtccagagacccgccaagaatggcaccgtgatggacgtcatttcccggcgcgatcagagagggtctggacaggtgggcacatacgggctgaacaccttcacaaatatggaagctcaactcatccggcagatggagagcgagggaatcttttccccgagcgaactggagacccctaaccttgccgaaagagttctggactggctcgagaagtatggcgtggaacgcctgaaacggatggcgatttctggggatgactgtgtcgtgaagcccatcgacgatagattcgccacggctcttacagccctgaacgacatgggcaaagtgcgcaaggatattcctcagtgggagccctccaaaggatggaatgactggcagcaagttcctttttgcagccatcacttccaccagctcatcatgaaggatggccgggagattgtggtcccctgtagaaaccaggacgaactggtggggcgcgctcgggtttctcagggagccggctggtccctgagagagaccgcttgcctcggaaagagctacgcccaaatgtggcagctgatgtattttcatcgccgggatcttagactggcggccaatgctatctgttccgccgtgccggtcgactggattcctacatctcgcaccacgtggagcatccacgcccatcaccagtggatgaccacagaagatatgctctccgtgtggaaccgggtctggatcgaggaaaatccctggatggaggacaaaacccatattagctcttggggagatgtgccctacctgggcaagagagaggaccaatggtgcgggtcccttatcggcctgacagctcgggccacctgggcgacaaacattcaggttgctatcaatcaggtgagacgcctcattggaaacgaaaattacctggactatatgaccagcatgaaacggttcaagaacgagtctgatcctgaaggcgccctgtggtga

SEQ ID NO: 19175 - RNA, 9879 nt, synthetic construct
  misc_feature 1..9879: note = derived and/or modified CDS sequence (opt5) from DENV-1__GU131730__SS-prME
  source 1..9879: mol_type = other RNA
agcgtgaccatgctgctgatgctgatgcccacagcccttgctttccacctgacgaccagaggaggggagcctcatatgattgtctccaagcaggaacggggaaagtctctcctgtttaagacaagcgccggcgttaacatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcgcgctgatagcggatgcgttattaactggaaaggccgggaactcaagtgtgggtccggaatctttgtgacaaatgaggtccacacctggacagaacagtataagttccaagccgactctcctaaaagactgagcgcggccattggcaaggcttgggaggagggggtgtgcggcatccgctccgccacccggctggaaaacatcatgtggaaacagatttctaacgagctcaatcatatcctgcttgaaaacgacatgaagctgacggttgtggtcggagatgtggctggcattctcgcccaggggaaaaagatgatcagaccgcagcccatggagtacaaatatagctggaagtcctggggaaaggccaaaattatcggcgctgacgtgcaaaatacaacctttatcattgatgggcctaacacccccgaatgtcctgacgatcagcgcgcgtggaatatctgggaggtcgaggactacggattcggcatttttacaaccaacatctggctgaagctgcgggatagctatacgcaggtttgcgaccacagacttatgtctgccgctattaaagattccaaggccgtgcacgccgacatgggctactggatcgaaagcgagaaaaatgaaacatggaagctcgctcgcgcctctttcatcgaggtgaagacctgtatttggcccaaatcccatacactgtggagcaacggggtcctggaatctgagatgatcattccgaagatctatggaggccctattagccagcacaattaccggcccgggtacttcacccaaacagcgggaccttggcatctcggcaaactggagcttgattttgacctgtgcgaagggaccacggtggttgtggatgagcactgcggaaacagaggcccctccctccggaccacaaccgtcacaggcaagatcatccacgaatggtgttgccgcagctgtaccctgcctcccctgagattcaaaggggaggacggatgctggtatggcatggagattcggccggtgaaggaaaaggaggaaaatcttgttaaatctatggtgtccgctgggagcggagaggtcgactccttttctctcggcctgctgtgtatcagcattatgatcgaagaggtgatgagatcccgctggtctcggaagatgctcatgacggggacactggccgttttctttcttctgattatgggacagctcacctggaacgatctgatcagactgtgcattatggtgggcgccaatgctagcgaccgcatgggcatggggacaacctaccttgccctgatggcgaccttcaaaatgagacctatgtttgctgtcggactcctgttccggcgcctcacatccagagaggtgctgcttctgacgatcggcctctctctggtggccagcgtcgaactgcccaactcccttgaggaactgggggatggactcgccatgggcatcatgattctgaagctcctgaccgactttcagagccatcaactttgggctacactgctctctctgaccttcatccggacaaccttttccctgcactatgcctggaaaacgatggctatggttcttagcattgtgtctctgttccccctctgtctgtccacaaccagccagaagaccacatggctccctgtgctgcttgggtctctgggatgcaagccgctgaccatgtttctcatcgccgagaataaaatttggggccgcaagtcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgtcgtgagctgggaggaagaggctgaacattccggcgcgtctcacaatattctcgttgaggtgcaggatgacgggacaatgaaaatcaaggatgaagagagagacgatacgctgaccatccttctgaaagccacactcctggctgtcagcggagtgtatcctctctccattcccgccaccctgttcgtctggtacttctggcagaagaagaaacaacggtctggcgtgctttgggacacaccttcccctcccgaggttgaacgcgccgtgctggatgacggcatctatagaattatgcagcgggggctgctcggacgctcccaggtcggcgtgggggtttttcaggagaacgtgttccataccatgtggcacgtcacgagaggagctgtgctgatgtaccaaggcaagcggcttgaacccagctgggcctctgtgaaaaaggacctgatctcctacgggggaggctggagactccagggcagctggaataccggggaggaggttcaggtcattgcggtggaacccggcaagaatcctaagaatgtgcagacagctcccggcacctttaagacatctgagggggaagtcggagccatcgccctggatttcaaaccgggcacctccgggagccctattgtgaaccgcgagggaaagatcgttggcctctatggcaatggggtggtcacaacgtccggaacctacgtgtctgctatcgcccaagcgaaagctagccaggaaggccccctgcctgagattgaggacgaagtttttcggaagagaaaccttacaaccatggatctgcaccccgggtccggaaaaacccgccggtatctgcccgccatcgtgagagaggccattaagcgcaagctccggacactgatccttgctcctacgagagtcgtggccagcgaaatggctgaggccctgaaaggcatgccgattcgctaccagaccacagcggttaagtctgaacataccgggaaagagatcgtggacctcatgtgccacgccacattcaccatgcggctgctgtcccccgtcagagtgcctaattataacatgatcattatggatgaggctcattttacggaccccagctctatcgccgctcggggctacattagcacacgcgtgggaatgggcgaagccgccgctatcttcatgaccgcgacccctcccgggtccgtcgaggcctttcctcaatctaatgctgttattcaggatgaagagagagacatcccggaacggagctggaactccggatatgagtggatcacagatttccccggcaagaccgtgtggtttgtgccttctattaaaagcgggaatgacatcgccaactgtctccgcaagaatggaaagagagtcattcagctttcccggaaaacattcgataccgagtaccagaagacgaaaaacaacgactgggactacgtggttacaaccgatatcagcgaaatgggcgccaatttcagagctgaccgcgtgattgatccccggagatgcctgaagcctgtcatcctgaaagacgggcccgagcgcgtgattctcgccggcccgatgcctgttacagtggcgtctgctgcccaacggagaggacgcatcggccggaaccccaataaggaaggggatcagtatatctacatgggacagcccctgaacaatgacgaggatcacgccccttggaccgaggctaagatgcttctggacaacattaatacgcccgaaggcatcattcctgccctctttgagccggaaagagagaaatccgcggccatcgatggggaatatcgcctgagaggagaggctcggaagaccttcgtcgagctgatgcgcagaggcgacctccccgtgtggcttagctacaaagtcgcctccgaagggtttcagtattctgatcggcgctggtgcttcgacggcgagagaaacaatcaagtgctggaagagaacatggatgttgaaatttggacaaaggagggagagcggaaaaagctgagacctcgctggctcgacgctcggacctacagcgaccccctggcccttagagaatttaaagagttcgctgccggccgccggtccgtgtctggggatctgatcctcgaaatcggaaagctgcctcagcatctgacacagagagcgcagaatgccctcgacaaccttgtgatgctgcacaatagcgagcaaggcgggcgggcttatcgccacgccatggaggaactgcccgataccattgagacactcatgctgcttgctctgatcgccgtcctcaccggaggcgttacgctgtttttcctgtccggcagagggctcggaaagacaagcattggccttctgtgtgtgatggcctcttccgtgctgctctggatggctagcgtcgaaccgcattggatcgcggcctctattatcctggagtttttccttatggtgctgctcatccctgaacccgaccggcagcgcacccctcaggataaccagctggcttacgttgtgattgggctgctctttatgatccttaccgtcgccgccaatgagatgggactgctggagacaaccaaaaaggacctcggcattgggcacgtggctgtcgaaaaccatcaccacgccgcgatgctggatgtggaccttcatcccgcctccgcttggacactgtacgccgttgctacgaccatcattacacctatgatgagacacaccatcgagaacacaaccgccaatattagcctcacggcgatcgccaaccaagctgccatcctgatgggactggataaaggctggcccatttctaagatggacatcggcgtgccgctccttgctctggggtgctatagccaggtcaatcctctgaccctcacagccgctgtgctgatgcttgttgcccattacgcgattatcggacccggcctgcaggccaaagctacccgggaagcccaaaagcgcacagctgccgggattatgaagaaccccaccgtggatggaatcgtcgccatcgacctcgatcctgtggtgtatgacgcgaaattcgagaagcagctgggccagattatgctgctcatcctttgtacgtcccagattctgctgatgagaacaacctgggctctctgcgaatctatcacactggccaccgggccgcttaccacactgtgggagggaagccccggcaaattttggaatacgaccattgctgtttccatggccaacatcttccggggcagctacctcgccggggctggactggccttctccctgatgaagtctctcggcgggggacgcagaggcacaggggcgcaaggagagacccttggcgaaaaatggaagcggcagctgaatcagctgagcaagtccgagtttaacacatataaaagatctggcatcatggaagtcgaccgcagcgaggccaaggaagggctcaaacggggagagaccacgaagcacgctgtgtccagaggcacagccaaactgcgctggttcgtggagcggaatcttgtcaagcctgaagggaaggttattgatctgggatgtggcagagggggatggtcttactattgcgctggcctcaaaaaggtgaccgaggtgaaaggctacaccaaagggggacccggccatgaggaacctatccccatggccacatacgggtggaacctggtcaaactgcacagcggaaaggacgtgtttttcattcctccggaaaaatgtgataccctcctttgcgacatcggcgagtccagccccaatcctacaattgaggaagggcgcacgctgcgggttctgaagatggtggagccctggctcagaggaaaccagttttgtatcaagattctgaatccttatatgccctctgtcgtggaaacccttgagcaaatgcagcgcaaacacggcggcatgctggttcggaacccgctctccagaaatagcacacatgagatgtactgggtgtcttgcgggaccggaaacatcgtctccgcggtgaatatgacaagccgcatgctgctgaaccggttcaccatggcccacagaaagcctacgtatgaacgcgatgtggacctcggcgctgggaccagacatgtcgccgttgagcccgaagtggctaacctggatatcattggacagcggatcgagaatattaaacacgaacacaagtctacatggcattacgacgaggataacccctataaaacctgggcctaccacggctcctatgaggtgaagcctagcgggtccgctagctctatggtcaatggagtggttaaacttctgacaaaaccctgggacgtgatccctatggtcacccagattgccatgacagataccacgccgtttggccaacagcgcgtgttcaaggaaaaagttgacacaagaacccccaaggcgaaacggggcaccgcccagatcatggaggtgacagctaagtggctctgggggtttctgagcagaaacaagaaacctcggatctgtacgcgcgaagagttcaccagaaaggtccggtccaatgccgctattggagccgtgtttgttgacgaaaaccaatggaactctgccaaagaggcggtggaggatgaacgcttctgggaccttgtccatagagagcgggaactgcacaagcagggcaaatgcgctacatgcgtgtacaacatgatggggaagcgcgagaagaaactcggagaatttggcaaggccaaagggagcagagccatctggtacatgtggctgggcgctcggttcctggagttcgaggccctcggatttatgaatgaagatcattggttctcccgcgagaactctctgagcggcgtcgaaggggagggacttcacaagctgggctatattctcagagacatctccaaaattcccgggggaaatatgtacgctgatgacaccgccggctgggatacacggatcaccgaggacgatctgcagaacgaagcgaagatcacagacattatggagcctgaacacgcccttctggctaaatctatctttaagctcacctatcagaataaggtggttcgcgtgcaaagacccgccaaaaacgggacggtcatggatgtgattagccggcgcgaccagagaggctccggacaggtgggcacctacgggctgaatacattcaccaacatggaggctcagctgatccggcaaatggaaagcgagggaatcttttctccgtccgagctcgaaacacctaacctggccggcagagttcttgattggctggagaagcatggggtggaacgcctcaaacggatggcgatcagcggagacgactgtgtcgtgaagcccatcgatgacagattcgccaccgctctgacggcccttaatgatatgggcaaagttcgcaaggacattcctcagtgggagccctctaaggggtggaacgattggcaacaggtgcctttttgctcccaccatttccaccaactgatcatgaaagacggccgggaaattgtcgtgccctgtagaaatcaggatgagctcgtcggacgcgctcgggtgagccagggcgccgggtggtccctgagagagacagcttgcctgggaaagtcttatgcccagatgtggcaactcatgtactttcaccgccgggacctgagacttgcggccaacgctatctgtagcgccgttccggtggattgggtccctacctcccgcacaacctggagcattcatgcccaccatcagtggatgacgaccgaagacatgctgtctgtgtggaatcgggtttggatcgaggaaaacccctggatggaggataaaacacacatttccagctggggcgacgtgccctatctcgggaagagagaagaccagtggtgcggatctctgatcggccttaccgctcgggccacatgggcgaccaatatccaagtcgctattaaccaggtgagacgcctgctcgggaatgagaactacctggattacatgacaagcatgaaacggttcaagaatgagtccgaccctgaaggcgccctgtggtga

SEQ ID NO: 19176 - RNA, 9879 nt, synthetic construct
  misc_feature 1..9879: note = derived and/or modified CDS sequence (opt5) from DENV-1__GU131731__SS-prME
  source 1..9879: mol_type = other RNA
agcgtgaccatgctgctcatgctgatgcccacagcccttgctttccacctgacgacccggggcggggaacctcatatgatcgtgacaaagcaggaacggggaaaatccctcctgtttaagacctctgccggcgttaatatgtgcacacttattgcgatggacctgggggaactctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtatctggcccaaatctcacaccctgtggtccaacggggtgctggaaagcgagatgattatcccgaagatttacggaggccctatctctcaacataattatcgccccgggtacttcacacagaccgccggaccttggcacctcggcaaactggagcttgattttgacctgtgcgaagggacgaccgttgtggtcgatgagcactgcggaaaccggggccccagcctcagaacaaccacagtgaccggcaagattatccatgaatggtgttgccggtcctgtacgctgcctcccctgcgcttcaaaggggaggacggatgctggtacggcatggagatcagaccggttaaggaaaaggaggaaaatcttgtgaaaagcatggtctctgcggggtccggagaggtggacagcttttccctcggcctgctgtgtatttctatcatgattgaagaggttatgcggagcagatggtcccgcaagatgctcatgacagggaccctggctgtgttccttctgctcatcatgggacagctgacatggaacgatctgattcggctttgcatcatggtcggcgccaatgcctctgacagaatgggcatggggaccacctatctggctctcatggccacatttaaaatgcgccctatgttcgcggtgggactgctctttagacggctgacgagccgcgaggtgcttctgctcaccattggcctgtccctggtcgcttctgttgaacttcccaacagcctggaggaactcggggatggactggccatgggcatcatgatcctcaagctgcttacagacttccaatcccaccagctgtgggccaccctcctgagcctgacatttattaaaaccacgctttctctgcattacgcttggaagacaatggccatggtgctctccatcgtgagcctgttccccctctgtctgtctaccacctcccagaagacaacctggcttcctgtcctgctggggagcctcggatgcaaaccgctgacaatgtttcttattacggagaataagatctggggcagaaaatcttggcccctgaacgaaggcattatggctgtgggggttgtgtccatcctcctgagctccctcctgaagaacgatgtccctcttgccggacccctgatcgcgggcgggatgctgattgcctgttatgtgatcagcggatctagcgctgacctctccctggagaaagccgctgaggtttcttgggaagaggaagccgagcacagcggcgcctcccataatattcttgtggaagtccaggatgacgggaccatgaagatcaaagatgaggagcgggacgatacactgaccattctcctgaaggctacactcctggcggtgtctggagtctaccctcttagcatccccgccaccctgttcgtgtggtatttttggcaaaagaaaaagcagcgctccggcgttctgtgggacacgccttctcccccggaagtggagagagctgtcctcgatgacggcatctaccggattatgcagcgcgggctgcttggaagaagccaggtgggcgttggggtgttccaagaaaacgtcttccacaccatgtggcacgtgacacggggagccgtgctgatgtatcagggcaaacgcctcgagccttcctgggccagcgttaagaaagacctgatctcttacgggggaggctggagactccagggctcctggaataccggggaggaagtccaggtgattgctgtggagcccggaaagaaccctaagaatgtccaaacagcccccggcacctttaaaacaccggaaggggaggtgggagcgatcgctctggatttcaagcctggcacgagcgggtctcccattgttaaccgggaaggaaaaatcgtgggcctttacggcaatggggtcgtgaccacatccggaacctatgttagcgccattgcccaggctaaggcctcccaggagggccctctgcccgagatcgaagacgaggtgtttagaaaacgcaacctgaccatcatggatctccatcccgggtctggaaagacacggagatacctgcctgcgattgtccgcgaagctatcaagcggaaacttagaacgctgattctcgccccgacccgcgtggttgccagcgagatggctgaagccctgaagggcatgcccatccggtatcaaacaaccgctgtgaaatccgagcacacagggaaggagattgtcgacctgatgtgccatgccaccttcacgatgagactccttagccctgtgcgcgtgcccaattacaacatgatcatcatggatgaagcgcactttacagacccttcttccattgccgctcggggctatatcagcaccagagtcggaatgggcgaggccgctgccattttcatgaccgccacaccccctgggtctgttgaggcttttccgcagagcaatgcggtgatccaggatgaggaacgggacattcccgagcgctcctggaactctggatacgagtggatcaccgatttccctggcaaaacagtgtggtttgtccccagcatcaagtccgggaatgacattgccaactgtctgagaaagaatggaaaacgggtgatccagctgtctcgcaagaccttcgatacggaatatcagaagaccaagaacaacgactgggactacgttgtgaccacagatattagcgagatgggcgctaattttagagccgaccgggtcatcgatcctagacgctgcctcaaacccgtgattctgaaggacgggccggaacgggttatccttgccggccctatgcccgtgaccgtcgcttccgccgcgcagagacgcggacggattggcagaacgcataacaaggagggggatcagtacatcagcatgggacagcccctgaataccgctgaggaccacgccccttggacagaagccaaaatgctcctggataacatcaatacccccgagggcattatccctgctctgttcgaaccggagcgcgaaaagtctgccgcgattgacggggagtatcggctcagaggagaggcccgcaaaacattcgtggaacttatgagacggggcgatctgcccgtctggctgtcctacaaggtggctagcgaggggtttcaatattccgaccgcagatggtgcttcgatggcgaacggaacaatcaggttctcgaggaaaacatggacgtggagatctggaccaaagagggagaacgcaagaaactgagacctcggtggcttgatgccagaacatactctgaccccctggctctccgcgagtttaaggagttcgccgctggccggagaagcgtgtccggggacctgattctggagatcggaaagctccctcagcaccttacccagcgcgcccaaaatgcgctggataacctggtcatgctccataattctgaacagggcgggcgggcctatagacacgctatggaggagctgcccgacacgatcgaaacacttatgctgctcgccctgattgctgttctgaccggaggcgtgaccctctttttccttagcggccgggggctgggaaaaacatccatcggcctgctctgtgtgatggccagctctgtcctgctttggatggcctccgtggagccgcattggattgctgcgagcatcattctggaatttttcctcatggttctgctgatccctgagcccgatcgccagagaacccctcaggacaaccaactcgcctacgtggtcatcgggcttctgtttatgattctgacagtggctgccaatgagatgggactcctggaaacgaccaagaaagatcttggcatcgggcacgtcgccgtggagaaccaccatcacgctacaatgctggacgttgatctccatcccgcctctgcgtggaccctgtatgccgtggctacaaccattatcacgcctatgatgcggcacaccattgaaaatacaaccgccaacatctccctgacagctattgccaaccaggcggccatcctcatgggacttgacaagggctggcccatcagcaaaatggatattggcgtcccgctgctggctctcgggtgctactctcaggtgaatcctctgacccttacggccgctgttctgatgctcgtggcccattacgctatcattggacccggcctgcaagccaaggcgacacgcgaggcccagaagagaaccgctgccgggatcatgaaaaaccccacagtcgacggaattgtggctatcgatctggaccctgtggtttatgatgccaagttcgaaaaacagctcggccagatcatgcttctgattctgtgtaccagccaaatcctcctgatgcggaccacatgggccctttgcgagtccattacgctggcgaccgggccgctcacaaccctgtgggagggatctcccggcaagttttggaatacaaccatcgctgtcagcatggccaacattttccgcggctcctacctggctggggccggactcgcctttagccttatgaaatccctgggcgggggaagacggggcacgggggctcagggagaaacactgggcgagaagtggaagcgccagctcaatcagctgtctaaaagcgagttcaacatctataagagatccggcatcatggaggtggaccggtctgaagccaaagaggggcttaagagaggagagaccacccgccacgcggtgagccggggcacagccaaactgagatggttcgtcgaacgcaatctcgttaagcctgaggggaaggtgattgacctgggatgtggcagagggggatggtcctactattgcgctggcctgaaaaaggtgaccgaagtcaaaggctacacaaaagggggacccggccacgaggatcctatccccatggccacgtatgggtggaacctcgtgaaacttcattctggaaaggacgtctttttcacccctccggaaaaatgtgatacactgctgtgcgacattggcgagagctcccccaatcctaccatcgaggaagggagaacactccgcgtgctgaagatggtcgagccctggcttcggggaaaccaattttgtattaagatcctgaatccttacatgcccagcgtggttgaaaccctcgagcagatgcagagaaaacacggcggcatgctggtgcgcaacccgctgtctagaaattccacgcatgagatgtactgggtcagctgcgggaccggaaacattgtgtctgctgtgaatatgacatccagaatgctcctgaaccgcttcaccatggcccaccggaagcctacatatgaaagagatgtcgaccttggcgcggggacccgccacgttgccgtggagcccgaagtggctaatctggatatcatcggacagagaattgagaacatcaaacatgaacacaagagcacatggcattacgacgaggataacccctataaaacctgggcctaccacggctcttatgaggtcaagccttccgggagcgcttccagcatggtgaatggagttgtgaagctcctgacgaaaccctgggacgtcattcctatggtgacacaaatcgccatgaccgataccacaccgtttggccagcagcgggttttcaaggaaaaagtggacacgcgcacccccaaggctaaaagaggcacagcccaaattatggaggtcaccgcgcggtggctttgggggtttctgtctagaaacaagaagcctcggatctgtacacgcgaagagttcaccagaaaagtgcggagcaatgccgctatcggagccgtttttgtggacgaaaaccagtggaactccgctaaggaggccgtcgaggatgaacgcttctgggacctcgtgcagaaagagagagaactgcataagcagggcaaatgcgccacatgcgtctacaacatgatggggaagcgggagaagaaactgggagaatttggcaaggcgaaagggtctcgcgctatttggtatatgtggctcggcgccagattcctggagtttgaggcccttggattcatgaatgaagatcactggttcagccgggagaactccctgtctggcgtggaaggggagggactccacaagctgggctacatccttcgcgacattagcaaaatccccgggggaaatatgtacgctgatgacaccgccggctgggatacgagaattaccgaggacgatctgcaaaacgaagctaagatcacagacatcatggagcctgaacatgccctcctggcgacctccatttttaaactgacatatcagaataaggttgtgcgggtccagcgccccgccaagaacgggaccgtgatggatgtgatctctagacgggaccagcgcggcagcggacaagttggcacgtacgggctcaatacattcaccaacatggaggctcagctgattagacagatggaatccgagggaatctttcttccgagcgagctggaaacacctaatctcgccgagcgggtgctggattggcttgaaaaatatggcgtcgagagactgaagcgcatggctatttctggggacgactgtgtggttaaacccatcgatgaccggttcgccaccgcgctcacggccctgaacgatatgggaaaggtgagaaaagacatccctcagtgggaaccctccaagggctggaacgattggcaacaggtccctttttgcagccaccatttccaccagctgattatgaaggacgggcgcgagatcgtggtcccctgtcggaatcaggatgagctcgtgggcagagctcgcgtttctcaaggagccggctggtccctgcgggaaaccgcttgccttgggaaaagctacgcccagatgtggcagctgatgtattttcacagacgcgacctccggctggctgccaacgcgatttgttccgccgtgccggtcgattgggtgcctacatctagaaccacatggagcatccatgctcaccatcaatggatgaccacagaggacatgctttccgtttggaatcgcgtgtggattgaagagaacccctggatggaagataagacccacgtcagctcttggggagacgtgccctacctgggcaaacgggaggaccagtggtgcgggtccctcatcggactgacggccagagccacatgggctagcaatattcaggtggccatcaaccaggttcggagactgatcggcaatgagaactatctcgattacatgacctctatgaagcgcttcaaaaatgaaggggaccctgagggcgcgctgtggtga

SEQ ID NO: 19177 - RNA, 9879 nt, synthetic construct
  misc_feature 1..9879: note = derived and/or modified CDS sequence (opt5) from DENV-1__GU131733__SS-prME
  source 1..9879: mol_type = other RNA
agcgtgaccatgttcctgatgctcatgcccaccgccctggcttttcaccttacgaccagaggcggggaacctcatatgatcgtgtccaagcaggaacggggaaaatctctcctgttcaagacaagcgccggcgttaacatgtgcaccctgatcgcgatggaccttggggaactgtgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtgacacctagcatggccatgagatgcgtgggcattgggtcccgggatttcgttgagggacttagcggcgctacgtgggtggacgtggtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatccctttttccacacaagatgaaaagggggttacgcagaacggacggctgatcaccgcgaatcccattgtgacagacaaagagaagcctgtcaacatcgaagctgagccgcccttcggcgagagctatattgtgatcggggccggagaaaaagcccttaagctctcttggtttaagaaaggcagctccattgggaagatgttcgaggctaccgccagaggcgctcgccggatggccatcctgggagatacagcgtgggactttggctctatcgggggagtgttcaccagcgttggcaaactggtccatcagatttttgggacggcctacggagtcctgttctccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagtttaccgtggttgtgggagatgtcgccggcattctcgctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggctgaagctgcgcgattcctatacccaggtctgcgaccaccggcttatgagcgcggccattaaagattctaaggctgttcacgccgacatgggctactggatcgaatccgagaaaaatgaaacatggaagctcgccagagctagcttcatcgaggtgaagacctgtatttggcccaaatctcatacactgtggtccaacggggtgctggaaagcgagatgatcattccgaagatctatggaggccctatttctcaacacaattaccgccccgggtactttacccagacggccggaccttggcatctcggcaaactggagcttgatttcgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgctttagaggggaggacggatgctggtatggcatggagattcggccggtcaaagaaaaggaggaaaatcttgtcaagagcatggtttctgcggggtccggagaggtggacagcttctccctcggcctgctgtgtatctctattatgatcgaagaggtcatgagaagccgctggtcccggaaaatgctcatgaccgggacactggctgtgtttttccttctgattatgggacagctcacctggaacgatctgatcagactgtgcattatggttggcgccaatgcctctgaccgcatgggcatggggaccacataccttgctctgatggccacgtttaagatgagacctatgttcgcggtgggactcctgtttcggcgcctcaccagcagagaggtcctgcttctgacaatcggcctctccctggtggcttctgtggaactgcccaacagccttgaggaactgggggatggactcgccatgggcatcatgattctgaaactcctgaccgacttccaatcccatcagctttgggccacactgctcagcctgacctttatcaagacgacattctctctgcactatgcttggaaaaccatggccatggtcctttccattgttagcctgtttcccctctgtctgtctaccacatcccagaagaccacatggctccctgtgctgcttgggagcctgggatgcaagccgctgacgatgttcctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggaccatgaagatcaaagatgaggagagagacgatacactgaccatccttctgaaggcgacactcctggccgtttctggagtgtatcctctcagcattcccgctaccctgttcgtctggtacttttggcagaagaagaagcagcggtccggcgtgctttgggacacgccttctcccccggaagtcgagcgcgccgtgctggatgacggcatctatagaattatgcagcgggggctgctcggacgcagccaggttggcgtgggggtcttccaagaaaacgtgtttcataccatgtggcacgttacaagaggagccgtgctgatgtaccagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctctatggcaatggggtggttaccacatccggaacctacgtgagcgccatcgctcaggcccgggcgtcccaggagggccctctgcccgagattgaagacgaggtcttcagaaagcgcaaccttaccatcatggatctgcaccccgggtctggaaaaacacggagatatctgcctgctattgtgcgcgaagccatcaagcggaaactcagaacgctgattcttgccccgacccgcgttgtggctagcgagatggccgaagctctgaagggcatgcccatccggtaccaaacaaccgccgtcaagtccgagcatacagggaaagagatcgtggacctcatgtgccacgcgacctttacgatgagactgctgagccctgttcgggtgcccaattataacatgattatcatggatgaagcccatttcacagacccttcttccattgctgcccgcggctacatcagcaccagagtcggaatgggcgaggctgccgccatttttatgaccgctacaccccctgggtctgtggaagcgttcccgcagagcaatgccgtgatccaggatgaggaacgggacatccccgagcgctcctggaactctggatatgagtggattaccgattttcctggcaagacagtctggttcgttcccagcatcaaatccgggaatgacattgctaactgtctcagaaagaatggaaaacgggtgatccagctttctagaaagaccttcgatacggaataccaaaagaccaagaacaacgactgggactacgtggtcaccacagatattagcgagatgggcgccaattttcgcgccgaccgggtgatcgatcctagacgctgcctgaagcccgttattctgaaagacgggccggaacgggtgatcctcgctggccctatgcccgtcaccgtggcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctcttcgaacctgagcgcgaaaagagcgccgcgattgatggggagtatagactgcggggagaggcccgcaagacatttgttgaactgatgagacggggcgacctcccggtgtggctttcttacaaagtcgcttccgaggggttccaatatagcgatcgcagatggtgctttgacggcgaacggaacaatcaggtgctggaggaaaacatggatgtcgagatctggaccaaggagggagaacgcaagaagctgcgcccccggtggctcgacgccagaacatactccgaccctctggctcttagagagttcaaagaatttgccgctggccggagatctgtgagcggggatctgatcctcgagattggaaagctgccccagcacctgacccagcgggcccaaaatgcgctcgacaaccttgttatgctgcataattccgaacagggcgggcgcgcctatagacacgctatggaggagctgcctgatacaatcgaaaccctcatgctgcttgccctgattgctgtgctcacgggaggcgtgacactgttctttctgtctggccgggggctcggaaaaaccagcatcggccttctgtgtgtcatggcctccagcgttctgctctggatggcctctgtggagccccattggattgctgcgtccatcatcctggagttctttcttatggtgctgctcattccggagcctgaccgccagagaacaccccaggataaccaactggcctacgtcgtgatcgggctcctcttcatgattcttacagttgctgccaatgagatgggactgctggaaaccacaaagaaggacctcggcatcgggcacgtggccgtcgagaaccaccatcacgctgccatgctggatgtggaccttcatcctgcgagcgcctggacgctgtacgctgtcgccaccacaattatcacccccatgatgcggcacacaattgaaaacaccacggctaatatctctctcaccgccatcgcgaaccaggccgctattctgatgggactggataaaggctggcctatctccaagatggacattggcgtgcccctccttgccctggggtgctatagccaggttaatccgctgacactcaccgctgccgtgctgatgcttgtcgctcattacgccatcattggacctggcctgcaagcgaaagccacacgcgaggctcagaagagaaccgccgctgggatcatgaaaaaccccacggtggatggaatcgttgccattgacctcgatcccgtggtctatgacgccaagtttgaaaagcagctgggccagatcatgctgctcattctttgtacatctcaaatcctgctgatgcggaccacatgggcgctctgcgagagcattaccctggctaccgggcctcttacaacgctgtgggagggatccccgggcaaattctggaataccacaatcgccgtgtctatggctaacatcttccgcggcagctacctcgccggggccggactggctttttccctgatgaaaagcctcggcgggggaagacggggcaccggggcccagggagaaacacttggcgagaaatggaagagacagctgaatcagctgtccaaatctgagttcaacacctataagcgcagcggcattatggaggtggaccggtccgaagcgaaggaggggctcaaaagaggagagacgacaaagcacgccgtttctcgcggcaccgctaaactgcggtggtttgtcgaaagaaatcttgtgaagcccgaggggaaagtgatcgatctgggatgtggccgcgggggatggagctactattgcgccggcctcaagaaggtcaccgaagttaaaggctacacaaaaggcgggcctgggcacgaggaacccattcctatggctacctacgggtggaacctggtgaaactgcattccggaaaggacgtgttctttattccccctgagaaatgtgatacactcctttgcgacattggcgagtctagcccgaatcccacgatcgaagaggggcggaccctgagagtcctgaagatggtggaaccttggctccgcggaaaccaattctgtattaaaatcctgaatccctatatgccttccgttgtggagacacttgagcagatgcagcggaagcacggcggcatgctggtcagaaaccccctcagccgcaattctacccatgaaatgtactgggtgtcctgcgggacaggaaacatcgttagcgccgtgaatatgacctctcggatgctgctgaacagatttacgatggcgcaccgcaagccgacctatgagagagatgtcgacctcggcgccgggacacggcacgtggctgtggaacctgaggtcgccaacattgatatcattggacagcgcatcgaaaatattaaacatgagcacaagtccacctggcattacgacgaggataacccctataaaacatgggcttaccacggcagctatgaagttaagccctctgggtccgccagctccatggtgaatggagtggtcaaactgcttaccaagccttgggacgtgatccccatggttacacaaatcgctatgaccgatacgacacctttcggccagcagagagtgtttaaggagaaagtcgacacccggaccccgaaggccaaaagaggcacagcgcaaattatggaagtgacggccaagtggctgtgggggttcctcagccggaacaaaaagccccgcatctgtaccagagaggaatttacacggaaggttcgctctaatgctgccattggagctgtgttcgtcgacgagaaccagtggaatagcgccaaagaggccgtggaagatgagagattttgggacctggttcatcgggaacgcgagcttcacaagcagggcaaatgcgcgacctgcgtgtacaacatgatggggaagagagagaaaaagctgggagagttcggcaaggctaaagggtcccgggccatctggtacatgtggctcggcgcccgcttcctggagtttgaagctctgggattcatgaatgaggatcactggttttctagagaaaacagcctctccggcgtcgagggggagggactgcataaacttggctatattctgcgggacatctctaaaatccctgggggaaatatgtacgccgatgacacagctggctgggatacccgcattacagaagacgatctccagaacgaggccagaatcaccgacattatggaacccgagcacgcgctgcttgccaagagcatcttcaaactgacgtatcaaaataaggtggtccgggtgcagcgccctgctaaaaacgggaccgttatggatgtgatttccagacgggaccagagaggctctggacaggtcggcacatacgggctcaatacctttacaaacatggaagcccaactgatccgccagatggagagcgagggaatcttctcccccagcgaactggagaccccgaacctcgctgaacgggtgctggattggcttgagaagtatggcgtggaaagactgaagcgcatggccatttctggggacgactgtgttgtgaaacctatcgatgaccggtttgcgacggccctcacagctctgaatgatatgggaaaggtcagaaaagacattccccagtgggagccttccaagggctggaacgattggcagcaagtgcccttctgcagccatcactttcaccagcttatcatgaaagacgggcgcgagattgttgtgccttgtcggaatcaggatgaactggtcggcagagcccgcgtgtctcagggagctggctggtccctccgggagaccgcctgcctgggaaagagctacgctcaaatgtggcagctgatgtatttccatagacgcgacctccggctggccgcgaacgccatctgttccgctgtccccgtggattggattccgacatctagaaccacgtggagcatccacgcccatcaccagtggatgaccacagaagacatgctttccgtttggaatcgggtgtggatcgaggaaaacccttggatggaggataagacccatattagctcttggggagacgtcccctacctgggcaaaagagaggaccaatggtgcgggtccctcatcggactgacagcccgcgctacctgggccacaaatattcaggtggcgatcaaccaggttcggagacttattggcaatgaaaactacctggattatatgaccagcatgaagcgctttaaaaatgagtctgaccccgaaggggctctctggtga

SEQ ID NO: 19178 - RNA, 9879 nt, synthetic construct
  misc_feature 1..9879: note = derived and/or modified CDS sequence (opt5) from DENV-1__GU131734__SS-prME
  source 1..9879: mol_type = other RNA
agcgtgacaatgctgctcatgctgatgcccacagcccttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgccccagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcattgaagcgaagatctccaacaccacgacagacagcagatgtccgacccaaggagaggccacccttgtggaagaacaagatgctaattttgtgtgccggcgcacattcgtcgacagaggctggggcaacgggtgtggactgtttggcaaagggtctctcatgacctgcgccaagttcaagtgcgtgacaaaactggagggaaagattgttcagtacgaaaatcttaaatattccgtgatcgtcacggtgcacaccggcgaccagcatcaagttgggaacgagagcacagaacacggaaccacagctaccatcacgccccaggccccttctaccgagattcagctgacagattacggcgccctcaccctggactgtagcccccggacaggcctggattttaatgaaatggtgctcctgaccatgaaggagaaaagctggcttgtccataagcagtggttcctggacctccctctgccctggacgtccggggcttctacaagccaagagacctggaaccgcaaagatcttctggtgacatttaagaccgcgcacgccaagaaacaggaagtcgtggttctcggatcccaggagggcgctatgcacaccgccctgacaggggccacggaaatccaaaccagcggaacaaccacaattttcgctggccatctgaagtgcagactcaaaatggacaagctgacccttaaagggatgtcttatgtgatgtgtacggattccttcaagctggagaaggaagtcgccgagacacagcacggcaccgtgctcgttcagatcaaatacgagggaaccgacgcgccgtgcaagattccttttagcacacaggatgaaaaaggcgtgacccaaaatgggcggctgatcacagctaaccccatcgtcacggacaaggagaaacctgtgaatattgaagccgagccgcccttcggagagtcttatatcgtgattggcgccggggaaaaggctctgaaacttagctggtttaaaaagggatcctctatcggcaaaatgttcgaggccaccgctagaggggcccgccggatggcgattctcggcgatacagcctgggactttggaagcatcggcggggttttcacctccgtcggaaagctggtgcatcagatctttggcacagcttacggggtgctgttcagcggagtctcttggaccatgaaaattggcatcggggtgctcctgacgtggcttggcctgaactccagaagcacctctctctccatgacatgtattgccgttggactggtgaccctgtaccttggcgtcatggtgcaggctgacagcgggtgcgttatcaattggaagggacgcgaactcaagtgtggctccgggatttttgtgacaaacgaggtccacacctggacagaacagtataaattccaagccgattctcctaagcggctgagcgcggccatcggaaaggcttgggaggagggcgtgtgcgggattagatccgccacccgcctggaaaatatcatgtggaagcagatctctaacgagctcaaccatattctgcttgaaaatgacatgaaatttacggttgtggtcggcgatgtggctggaatcctggcccagggcaagaaaatgattcggccgcagcccatggagtacaagtatagctggaagtcctgggggaaagccaagatcattggagctgacgtgcaaaacacaaccttcatcatcgatggccctaatacccccgaatgtcctgacgatcagagagcgtggaacatttgggaggtcgaggactacgggtttggaatcttcacaaccaatatttggctcaaactgcgcgatagctatacgcaggtttgcgaccaccggctgatgtctgccgctatcaaggattccaaagccgtgcacgccgacatgggctactggattgaaagcgagaagaacgaaacatggaaacttgctagagcctctttcatcgaggtgaaaacctgtatctggcccaagtcccatacactctggagcaatggcgtcctggaatctgagatgattatcccgaaaatttatgggggacctatcagccagcacaactaccgccccggctactttacccaaacagcggggccttggcatctgggaaagctcgagctggatttcgacctttgcgaaggcaccacggtggttgtggacgagcactgcgggaatcggggaccctccctgagaaccacaaccgtcacaggcaaaattatccacgaatggtgttgccggagctgtaccctccctcccctgcgctttaagggcgaggatgggtgctggtatggaatggagatcagaccggtgaaggaaaaagaggaaaacctggttaagtctatggtgtccgctggcagcggggaggtcgactccttctctcttggactcctgtgtattagcatcatgattgaagaggtgatgcggtccagatggtctcgcaaaatgctgatgacgggcacactcgccgtctttttcctgcttatcatggggcagctgacctggaatgatctcattcggctgtgcatcatggtgggagccaacgctagcgacagaatgggcatgggcacaacctacctggcccttatggcgacctttaagatgcgccctatgttcgctgtcgggctgctctttagacggctgacatcccgcgaggtgctcctgcttacgattggactgtctctcgtggccagcgtcgaactgcccaattccctggaggaacttggcgatgggctggccatgggaatcatgatcctcaaactgctcattgacttccagagccatcaactgtgggctacccttctgtctctcacatttatcaagaccacattctccctgcactatgcctggaagaccatggctatggttctgagcattgtgtctctttttcccctgtgtctctccacgacaagccagaaaaccacctggctgcctgtgctcctgggctctcttgggtgcaagccgctgacaatgttcctgatcgccgagaacaaaatttggggaagaaagtcctggcccctcaatgaaggcatcatggcggtcggcatcgtgagcattctgctttccgccctgctcaaaaacgatgttcctctggctgggcccctcatcgccggaggcatgctgattgcttgttacgtgatcagcgggtctagcgccgacctttccctggagaaggccgctgaggtctcttgggaagaggaagcggagcatagcggagcctcccacaacattctggtggaagttcaggatgacggcaccatgaaaatcaaggatgaggagcgggacgatacactcacgatcctgcttaaggctaccctgctcgccgtgtctggggtctatcctctgagcattcccgccacactcttcgtgtggtacttttggcagaaaaagaaacaacgctccggagtcctgtgggacaccccttctcccccggaagtggagagagctgttcttgacgatggcatctatcggattatgcagcgcggcctgctggggagaagccaggtgggagtcggcgtgttccaggaaaatgtttttcatacaatgtggcacgtgaccagaggggccgtcctcatgtaccaaggaaagcgcctggagccttcctgggcgagcgtgaaaaaggaccttatctcttacggcgggggatggagactgcagggctcctggaacacgggcgaggaagtgcaggttattgctgtcgagcccgggaagaatcctaaaaacgtgcagaccgcccccggaacattcaagaccagcgaaggcgaggtgggggccatcgctctcgattttaaaccgggaacatctggctcccctattgtcaatcgggaagggaagatcgtgggactgtatggcaacggcgttgtgaccacaagcgggacgtacgtctccgccatcgcgcaagctaaagcctctcaggagggacccctccctgagattgaagacgaggtgttcagaaagcgcaatctgaccatcatggatcttcaccccggcagcgggaagacacggagatatctgcccgccattgttcgcgaagctatcaaacggaagctgagaaccctcattctggcccctacccgcgtggtcgcttccgagatggccgaagcgcttaaaggaatgccgatccggtaccagacaacggccgtgaagtccgagcataccggcaaagagatcgttgacctgatgtgccacgctacatttaccatgagactcctgtctcccgtgcgcgtccctaactataatatgattatcatggatgaagcccatttcacagacccctccagcattgctgcccgggggtacatctctaccagagtgggcatgggagaggccgctgcgatttttatgacggccacacctcccggcagcgtggaggctttccctcaatccaacgccgtcatccaggatgaagaacgggacatcccggagcgctcttggaatagcgggtatgagtggattaccgattttcccggaaagaccgtttggttcgtgccttccatcaagtctggcaacgacattgccaattgtctgcgcaagaacgggaagcgggtgatccagctcagccgcaaaacattcgacaccgaataccagaagaccaagaataacgattgggactacgtcgtgaccacggatatttccgagatgggagctaactttagagccgaccgggttatcgatcccagacgctgccttaagcctgtgattctgaaggacggccccgaacgggtcatcctggcggggccgatgcctgtgacagttgctagcgccgcccaaagacgcggccggatcggaagaaatcacaacaaagagggcgatcagtatatttacatggggcagcccctcaataacgacgaggatcatgctcactggaccgaagccaagatgctgcttgacaatatcaacacacccgagggaattatccctgcgctgttcgaacccgagcgcgaaaaatctgccgctattgatggcgagtatcggctcagaggggaggcccgcaagacctttgtggaactgatgagacggggagacctgcctgtctggctctcctacaaagtggctagcgagggcttccagtattccgatcgcagatggtgctttgacggggaacggaataaccaagtccttgaggaaaatatggacgtggagatctggacgaaggagggcgaacgcaaaaagctgagaccgcggtggctggatgccagaacctactctgaccccctcgctctgcgcgagttcaaggaatttgccgcgggacggagaagcgtttccggcgatcttatcctggagattgggaaactccctcagcacctgacacagcgcgcccagaacgctctggacaatctcgtgatgcttcataactctgaacaaggaggccgggcctatagacacgctatggaggagctgcccgataccatcgaaacactgatgctcctggcccttattgccgtgctgaccgggggagtcacactcttctttctgagcggccggggcctggggaagacctccatcggactcctttgtgttatggctagctctgtgctgctgtggatggcgtccgtggagcctcattggattgccgctagcatcatcctcgagttctttctgatggtccttctgattcccgagccggaccgccagagaacgcctcaggataatcagctcgcctacgtggttatcggcctgctgttcatgattctcacagtggccgctaacgagatggggcttctggaaaccaccaaaaaggacctgggaatcggccacgtcgccgtggagaatcaccatcacgcggccatgctcgatgtcgacctgcatcccgcttctgcctggacactttacgctgtggccaccacaattatcacgcctatgatgcggcacaccattgaaaacacaaccgcgaacatctccctgacagccatcgctaatcaagccgctattctcatggggctggataaaggatggcccatcagcaagatggacattggcgttcctctgctcgcccttggctgctattctcaggtgaaccccctgaccctgacggctgccgtcctcatgctggtggcgcattacgccatcattgggccgggacttcaggctaaggccacccgcgaggctcagaaacggacagccgccggcatcatgaagaatcctaccgttgatgggatcgtggcgattgacctggaccccgtcgtgtatgatgctaaatttgaaaagcagctcggacagatcatgctgctgattctctgtacaagccagatccttctgatgcggaccacgtgggccctgtgcgagtccattacactcgctaccggccccctgacaaccctttgggaggggtctcctggaaaattctggaacaccacaatcgccgtgagcatggccaatatcttccgcggctcctacctggctggcgccgggctcgcgtttagcctgatgaagtccctgggaggcgggagacggggaacgggcgcccaaggggaaaccctcggagagaagtggaaacgccagcttaaccagctgtctaagagcgagttcaatacatataaaagatccggcattatggaggttgaccggtctgaagctaaggagggcctgaaaagaggggagaccacaaagcacgccgtcagccgcggaaccgctaagctccggtggtttgtggaaagaaacctggtgaaaccggagggcaaggtcatcgatcttgggtgtggacgcggcgggtggtcctactattgcgccggactgaaaaaggttacggaagtgaaaggctacacaaagggcgggcccggacacgaggaacctattcccatggcgacctacggctggaatctcgtgaaactgcattctgggaaggacgtcttctttatccctcccgagaagtgtgataccctgctctgcgacattggagagagctcccctaacccgacaatcgaagagggccggacccttagagtgctgaaaatggttgaaccctggctgcgcgggaatcagttctgtattaagatcctcaacccttatatgcccagcgtggtcgagacactggagcaaatgcagcggaaacacggaggcatgcttgtgagaaatcctctgtctcgcaactccacgcatgaaatgtactgggttagctgcggcaccgggaatatcgtgtctgccgtcaacatgacatcccggatgctcctgaatagatttaccatggctcaccgcaagcccacatatgagcgggatgtggacctgggagccggcaccagacacgtggctgtcgaaccggaggttgccaacctcgatattatcgggcagcgcattgaaaacatcaaacatgagcacaagagcacgtggcattacgacgaggataatccttataagacctgggcttaccacggatcttatgaagtgaaaccctccggcagcgcctccagcatggtgaacggggtcgtgaagctgcttacaaaaccctgggacgttattcctatggtgacccagatcgcgatgacagacaccacacccttcggacaacagagagtctttaaggagaaagtggatacccggacgcctaaggccaagcgcggcacagctcagatcatggaagttaccgccaaatggctgtggggcttcctctctagaaataagaaaccgcggatttgtaccagagaggaatttacacggaaggtgcgcagcaacgctgccatcggggccgtcttcgtggacgagaatcaatggaactccgcgaaagaggctgttgaagatgagagattttgggacctggtgcatcgggaacgcgagcttcacaagcagggaaagtgcgccacgtgcgtctacaatatgatgggcaaaagagaaaagaaactgggggagttcggaaaggccaaaggctctcgggctatttggtacatgtggctcggggcccgcttcctggagtttgaagctctgggcttcatgaacgaggatcactggtttagcagagaaaattccctctctggagtggagggcgaggggctgcataaacttggatatatcctgcgggacattagcaaaatccccggcgggaacatgtacgccgatgacaccgcgggatgggatacacgcatcaccgaagacgatctccagaatgaggccaagattacagacatcatggaacctgagcacgctctgcttgccaagtccattttcaaactgacctatcagaacaaggtcgtgagagttcaacggcccgctaaaaatggcacagtgatggatgtcatctctcgcagagaccagcgggggagcggccaggtgggaacctacggcctcaacacgtttaccaatatggaagcccagctgattcgccaaatggagtccgaggggatcttcagcccttctgaactggagacacccaacctcgcgggaagagtgctggactggcttgaaaagcatggcgttgagcggctgaaaagaatggccatctccggggatgactgtgtggtcaagccgattgatgaccgctttgctgccgctctcaccgccctgaacgatatgggaaaggtgcggaaagacatccctcagtgggaacccagcaagggctggaatgattggcagcaggttcctttctgctctcaccactttcatcaacttattatgaaagacgggagagagatcgtggtcccctgtcgcaaccaggatgagctggtgggccgggctagagtctcccagggagccggctggagcctccgcgaaacagcgtgcctggggaagtcctatgcccagatgtggcaactgatgtacttccaccggagagacctccgcctggctgccaatgccatttgttctgctgtgcctgttgattgggtgcccaccagccggacgacatggtccatccatgcccaccatcagtggatgaccacagaggacatgcttagcgtctggaacagagtgtggattgaagagaatccgtggatggaagacaaaacccacatctcttcctggggagatgttccttatctgggcaagcgcgaggaccagtggtgcgggagcctcatcggactgacggcgcgggctacctgggccacaaacattcaagtggccatcaatcaggtcagacggcttattggcaacgagaattacctggattacatgacctctatgaagagatttaaaaacgaaagcgaccccgagggggctctctggtga

SEQ ID NO: 19179 - RNA, 9879 nt, synthetic construct
  misc_feature 1..9879: note = derived and/or modified CDS sequence (opt5) from DENV-1__GU131738__SS-prME
  source 1..9879: mol_type = other RNA
agcgtgaccatgctgctcatgctgatgcccaccgcccttgctttccacctgacgaccagaggaggggagcctcatatgatcgtgaccaagcaggaacggggaaaatccctcctgtttaagacctctgccggcgttaatatgtgcacgcttattgcgatggacctgggggagctctgtgaagataccatgacgtacaaatgcccccgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttatccagaacggacggctgattacagctaatcccatcgtgacggacaaagagaagcctgtcaacattgaagccgagccgccctttggcgagagctatatcgtgattggggccggagaaaaagctcttaagctctcttggttcaagaaaggcagctccatcgggaagatgtttgaggccaccgctagaggcgcccgccggatggcgatcctgggagatacagcctgggacttcggctctgtcgggggagtttttaccagcgtcggcaaactggtgcatcagattttcgggacagcttacggagtgctcttttccggcgtcagctggaccatgaagatcgggattggcgtgctgcttacgtggctgggactcaattctagatccaccagcctgtctatgacatgtatcgccgttggcctggtgaccctttacctcggggtcatggtgcaggctgattccggatgcgttattaactggaaaggccgcgaactgaagtgtgggagcggaatcttcgtgacaaatgaggtccacacctggacagaacaatataagtttcaggccgactcccctaaacggctgtctgcggccattggcaaggcttgggaggagggggtgtgcggcatcagaagcgccacccgcctcgaaaacatcatgtggaaacagatttccaacgagctgaatcatatccttctggaaaacgacatgaagttcacggttgtggtcggagatgtggtgggcattctcgctcaggggaaaaagatgatccggccgcaacccatggagcacaaatactcttggaaaagctggggaaaggccaagattatcggcgccgacgtccagaatacaacctttatcattgatgggcctaacacccccgaatgtcctgacgatcagagagcttggaatatctgggaggttgaggactatggattcggcatttttacaaccaacatctggctgaagctgcgcgattcctacacacaggtgtgcgaccaccggcttatgagcgcggccattaaagattctaaggctgtgcatgccgacatgggctattggatcgaatccgagaaaaatgaaacatggaagctcgccagagctagcttcatcgaggtcaagacctgtatttggcccaaatctcacacactgtggtccaacggggtgctggaaagcgagatgatcattccgaagatctacggaggccctatttctcaacataattatcgccccgggtacttcacccagacagccggaccttggcacctcggcaaactggagcttgattttgacctgtgcgaagggaccacggttgtggtcgatgagcactgcggaaaccggggccccagcctcagaaccacaaccgtgacaggcaagatcatccatgaatggtgttgccggtcctgtaccctgcctcccctgcgcttcaaaggggaggacggatgctggtacggcatggagattagaccggttaaggaaaaggaggaaaatcttgtgaaaagcatggtctctgcggggtccggagaggtggacagcttttccctcggcctgctgtgtatctctattatgatcgaagaggttatgcggagcagatggtcccgcaagatgctcatgacggggacactggctgtgttccttctgctcattatgggacagctgacctggaacgatctgatccggctttgcattatggtcggcgccaatgcctctgacagaatgggcatggggacaacctatctggctctcatggccacctttaaaatgcgccctatgttcgcggtgggactgctctttagacggctgacaagccgcgaggtgcttctgctcacgatcggcctgtccctggtcgcttctgttgaacttcccaacagcctggaggaactcggggatggactggccatgggcatcatgattctcaagctgcttaccgacttccaatcccaccagctgtgggccacactcctgagcctgacctttatcaaaacaaccctttctctgcattacgcttggaagacgatggccatggtgctctccattgtgagcctgttccccctctgtctgtctacaacctcccagaagaccacatggcttcctgtcctgctggggagcctcggatgcaaaccgctgaccatgtttcttatcacagagaataagatttggggcagaaaatcttggcccctgaacgaaggcatcatggctgtgggggttgtgtccatcctcctgagctccctcctgaagaacgatgtccctcttgccggacccctgattgcgggcgggatgctgatcgcctgttatgtgattagcggatctagcgctgacctctccctggagaaagccgctgaggtttcttgggaagaggaagccgagcacagcggcgcctcccataatatccttgtggaagtccaggatgacgggacgatgaagattaaagatgaggagcgggacgataccctgacaatcctcctgaaggctaccctcctggcggtgtctggagtctaccctcttagcatccccgccacactgttcgtgtggtatttttggcaaaagaaaaagcagcgctccggcgttctgtgggacaccccttctcccccggaagtggagagagctgtcctcgatgacggcatttaccggatcatgcagcgcgggctgcttggaagaagccaggtgggcgttggggtgttccaagaaaacgtcttccacacgatgtggcacgtgacccggggagccgtgctgatgtatcagggcaaacgcctcgagccttcctgggccagcgttaagaaagacctgatttcttacgggggaggctggagactccagggctcctggaatacaggggaggaagtccaggtgatcgctgtggagcccggaaagaaccctaagaatgtccaaaccgcccccggcacatttaaaaccccggaaggggaggtgggagcgattgctctggatttcaagcctggcacaagcgggtctcccatcgttaaccgggaaggaaaaattgtgggcctttacggcaatggggtcgtgacgacctccggaacatatgttagcgccatcgcccaggctaaggcctcccaggagggccctctgcccgagatcgaagacgaggtgtttagaaaacgcaacctgaccattatggatctccatcccgggtctggaaagacccggagatacctgcctgcgatcgtccgcgaagctattaagcggaaacttagaacactgatcctcgccccgacgcgcgtggttgccagcgagatggctgaagccctgaagggcatgcccattcggtatcaaaccacagctgtgaaatccgagcacaccgggaaggagatcgtcgacctgatgtgccatgccacattcaccatgagactccttagccctgtgcgcgtgcccaattacaacatgatcattatggatgaagcgcactttacggacccttcttccatcgccgctcggggctatattagcacaagagtcggaatgggcgaggccgctgccatcttcatgaccgccacaccccctgggtctgttgaggcttttccgcagagcaatgcggtgattcaggatgaggaacgggacatccccggacgctcctggaactctggctacgagtggatcacagatttccctgggaaaaccgtgtggtttggacccacaattaagagcggcaatgacatcgccaactgtctgagaaagaatgggaaacgggtcattcagctgtcccgcaagaccttcgatacggagtatcagaagaccaagaacaacgactgggactacgtgggcaccacagatatctctgaaatgggagctaattttagagccgaccgggttattgatcctagacgctgcctcaaacccgtgatcctgaaggacggcccggagcgggtcattcttgccgggcctatgcccgtgaccgttgctagcgccgcgcagagacgcggacggatcggcagaaaccataataaggaaggggatcagtacatctatatgggacagcccctgaacaatgacgaggatcacgctcactggacggaggccaaaatgctcctggacaacattaatacccctgaaggcatcattcccgccctgttcgagcctgaacgcgagaagtccgctgccatcgatggggaataccggctcagaggcgaggcgcgcaaaacattcgtggagcttatgagacggggagacctgccggtctggctgagctataaggtggcctctgaaggctttcaatactccgatcgcagatggtgcttcgacggggagcggaacaatcaggtcctcgaagagaacatggatgtggaaatttggaccaaagagggagagcgcaagaaactgagaccccggtggcttgacgctagaacatatagcgaccctctggccctccgcgaatttaaggagttcgctgccggccggagatccgtttctggggatctgatcctggaaatcggaaagctcccccagcatcttacccagcgcgctcaaaatgccctggacaacctggtgatgctccacaatagcgagcagggcggccgggcgtacagacatgccatggaggaactgcctgatacaattgagacccttatgctgctcgctctgatcgccgtgctgacagggggagtcacactctttttcctttccggccgggggctgggaaaaacctctattggcctgctctgtgttatggctagctccgtgctgctttggatggccagcgtggaaccccactggatcgccgcttctattatcctggagtttttcctcatggtcctgctgatcccggaacctgaccgccagagaacaccccaggataaccaactcgcgtatgtggttattgggcttctgtttatgatcctgacagtggccgctaatgagatgggactcctggagaccacaaagaaagaccttggcattggccacgtcgccgtggaaaaccatcaccatgccacgatgctggatgtcgacctccaccctgcttccgcctggaccctgtacgcggtggccacaaccatcattacacccatgatgcggcataccatcgagaacacgaccgctaatattagcctgacagccatcgctaaccaggccgcgatcctcatggggcttgataagggatggcctatttctaaaatggacatcggcgttcccctgctggccctcgggtgctactcccaggtgaatccgctgacccttacagctgccgtcctgatgctcgtggctcactatgccattatcggacctggcctgcaagctaaggccacccgcgaagcgcagaagagaacggccgctgggattatgaaaaaccccacagttgatggaatcgtggccatcgacctggatcccgtcgtgtacgacgctaagttcgagaaacagctcggccagattatgcttctgatcctgtgtaccagccaaattctcctgatgcggacaacctgggccctttgcgaatctatcaccctggccacaggccctctcacgaccctgtgggaggggagcccgggaaagttttggaatacaaccattgcggtgtccatggctaacatcttccgcggctcttatctggccggggctggactcgcctttagccttatgaaatccctgggcgggggaagacggggcacaggcgcccagggggagaccctgggagaaaagtggaagcgccagctcaatcagctgagcaaatccgagttcaacatctacaagagatctggcattatggaagttgaccggagcgaggctaaagaagggcttaagagaggagagacgacacgccacgccgtctcccggggcaccgcgaaactgagatggttcgtggagcgcaatctcgtgaagcccgaagggaaggtcatcgatctgggatgtggccggggcgggtggtcttattactgcgccggactgaaaaaggttaccgaggtgaaaggctatacaaaagggggacctggccatgaggaacccattcctatggctacctacgggtggaacctcgtgaaacttcacagcggaaaggacgtctttttcacaccccctgaaaaatgtgatacgctgctgtgcgacatcggcgagtcctctccgaatcccaccattgaggaaggcagaacactccgcgtgctgaagatggttgagccttggcttcgggggaaccaattttgtatcaagattctgaatccctacatgcctagcgtggtcgaaaccctcgagcagatgcagagaaaacatggaggcatgctggtgcgcaaccccctgtcccggaatagcacacacgagatgtattgggtttcttgcgggaccggaaacatcgtgtccgccgtcaatatgacgagcagaatgctcctgaaccgcttcaccatggctcaccggaagccgacatacgaaagagatgtggaccttggcgccgggacccgccatgtggcggtcgagcctgaagttgccaacctggatatcattggacagagaatcgagaatattaaacacgaacataagtctacatggcactatgacgaggataacccctacaaaacctgggcttatcatggctcctacgaggtgaagcccagcggctctgcctccagcatggtgaatggggtcgtgaagctcctgacaaaaccttgggacgttatccccatggtgacccaaattgctatgacggatacaaccccttttggacagcagcgggtcttcaaggaaaaagtggacacccgcacaccgaaggccaaaagaggcacggctcaaatcatggaggttaccgcccggtggctttgggggtttctgtccagaaacaagaagccccggatctgtacacgcgaagagttcaccagaaaagtgcggagcaatgcggccattggagctgtctttgtggacgaaaaccagtggaactctgccaaggaggctgttgaggatgaacgcttctgggacctcggccagaaagagagagaactgcacaagcaggggaaatgcgccacatgcgtgtataacatgatgggcaagcgggagaagaaactgggagaatttggcaaggccaaagggagccgcgcgatctggtacatgtggctcggagctagattcctggagtttgaggcccttggcttcatgaatgaagatcactggttctcccgggagaactctctgagcggggtcgaaggagagggcctccataagctggggtacattcttcgcgacatctccaaaattcctggcggaaatatgtatgccgatgacaccgctggctgggatacaagaatcaccgaggacgatctgcaaaacgaagccaagatcacggacattatggagcccgaacacgctctcctggccacctctatctttaaactgacataccagaataaggtggtccgggtgcagcgccctgcgaagaacgggaccgttatggatgtgattagcagacgggaccagcgcggatccggccaagtcgggacatatggactcaataccttcacgaacatggaggcccagctgatcagacagatggaatctgagggcatttttcttcccagcgagctggaaacaccgaacctcgctgagcgggtgctggattggcttgaaaaatacggggtggagagactgaagcgcatggccatctccggcgacgactgtgttgtgaaacctatcgatgaccggttcgctaccgccctcacagcgctgaatgatatgggaaaggtcagaaaagacattccccagtgggaacctagcaagggctggaacgattggcaacaggtgcccttttgctctcatcacttccaccagctgatcatgaaggacgggcgcgagattgttgtgccttgtcggaatcaggatgagctcgtcggcagagcccgcgtgtcccaaggcgctgggtggagcctgcgggaaaccgcctgccttggaaaatcttatgctcagatgtggcagctgatgtactttcatagacgcgacctccggctggccgctaacgccatctgttccgcggtccccgtggattgggttccgacgagcagaaccacatggtccattcacgcccatcaccaatggatgaccacagaggacatgctttctgtgtggaatcgcgtctggatcgaagagaacccttggatggaagataagacccatgtgagctcctggggcgacgttccctatctggggaaacgggaggaccagtggtgcggcagcctcattggactgacagctagagccacctgggcctctaatatccaggtggctatcaaccaggtccggagactgattggcaatgagaactacctcgattacatgacgtccatgaagcgcttcaaaaatgaaggggaccccgagggagccctgtggtga

SEQ ID NO: 19180 - RNA, 9879 nt, synthetic construct
  misc_feature 1..9879: note = derived and/or modified CDS sequence (opt5) from DENV-1__JF937604__SS-prME
  source 1..9879: mol_type = other RNA
agcgtgaccatgctgctcatgctgatgcccacagcccttgctttccacctgacgacccggggcggggaacctcatatgatcgtctccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcaccggcgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagacgttcgggaccgcctacggagtgctcttttccggcgtcagctggacaatgaagattgggatcggcgtgctgcttacctggctgggactcaattctagatccacaagcctgtctatgacctgtattgctgttggcctggtgacactttacctcggggtcatggtgcaggccgattccggatgcgttatcaactggaaaggccgcgaactgaagtgtgggagcggaattttcgtgaccaatgaggtccacacgtggacagaacaatataagtttcaggctgactcccctaaacggctgtctgccgcgatcggcaaggcctgggaggagggggtgtgcggcattagaagcgctacccgcctcgaaaacatcatgtggaaacagatctccaacgagctgaatcatattcttctggaaaacgacatgaagttcaccgttgtggtcggagatgtggccggcatcctcgctcaggggaaaaagatgattcggccgcaacccatggagtacaaatattcttggaaaagctggggaaaggccaagatcattggcgccgacgtgcagaatacaacctttatcatcgatgggcctaacacgcccgaatgtcctgacgatcagagagcttggaatatttgggaggtcgaggactacggattcggcatctttacaaccaacatttggctgaagctgcgcgattcctatacacaggtttgcgaccaccggcttatgagcgcggccatcaaagattctaaggctgtgcacgccgacatgggctactggattgaatccgagaaaaatgaaacctggaagctcgccagagctagcttcatcgaggtgaagacatgtatctggcccaaatctcataccctgtggtccaacggggtcctggaaagcgagatgattatcccgaagatttatggaggccctatctctcaacacaattaccgccccgggtacttcacgcagaccgccggaccttggcatctcggcaaactggagcttgattttgacctgtgcgaagggacaaccgtggttgtggatgagcactgcggaaaccggggccccagcctcagaacaaccacggtcacaggcaagattatccacgaatggtgttgccggtcctgtaccctgcctcccctgcgcttcagaggggaggacggatgctggtatggcatggagatccggccggtgaaagaaaaggaggaaaatcttgttaagagcatggtgtctgcggggtccggagaggtcgacagcttttccctcggcctgctgtgtatttctatcatgattgaagaggtgatgagaagccgctggtcccggaaaatgctcatgacagggaccctggctgttttctttcttctgatcatgggacagctcacctggaacgatctgattagactgtgcatcatggtgggcgccaatgcctctgaccgcatgggcatggggacaacgtaccttgctctgatggccaccttcaagatgagacctatgtttgcggtcggactcctgttccggcgcctcacaagcagagaggtgctgcttctgaccattggcctctccctggtggcttctgtcgaactgcccaacagccttgaggaactgggggatggactcgccatgggcatcatgatcctgaaactcctgacagactttcaatcctatcagctttgggccaccctgctcagcctgacgttcattaagacaaccttttctctgcattacgcttggaaaaccatggccatggttctttccatcgtgagcctgttccccctctgtctgtctacaacctcccagaagacaacgtggctccctgtgctgcttgggagcctgggatgcaagccgctgaccatgtttctcattgctgagaataaaatctggggccggcgctcttggcccctgaacgaaggcattatggccgtcgggatcgtgtccatccttctgagctccctcctgaagaacgatgttcctctcgcgggacccctgattgccggcgggatgcttatcgcttgttatgtgattagcggatctagcgccgacctgtccctggagaaagctgccgaggtctcttgggaagaggaagccgagcacagcggcgcttcccataatatcctcgtggaagttcaggatgacgggacaatgaagattaaagatgaggagagagacgataccctgacaatccttctgaaggcgaccctcctggccgtgtctggagtctaccctctcagcatccccgctacgctgttcgtgtggtatttctggcagaagaagaagcagcggtccggcgtcctttgggacaccccttctcccccggaagtggagcgcgccgttctggatgacggcatttacagaatcatgcagcgggggctgctcggacgcagccaggtgggcgtcggggtgtttcaagaaaacgttttccacacaatgtggcatgtgaccagaggagccgtcctgatgtaccagggcaaacggcttgagccttcctgggctagcgtgaagaaagacctgatttcttatgggggaggctggagactccagggcttttggaatacaggggaggaagtgcaggttatcgccgtcgagcccggaaagaaccctaaaaatgtgcaaaccgcgcccggcacattcaagacgccggaaggggaggtgggagctattgccctggattttaagcctggcacctccgggagccccatcgtcaaccgcgaaggaaaaattgtgggcctctacggcaatggggttgtgacaacctctggaacctatgtctccgccatcgctcaggccaaggcgagccaggagggccctctgcccgagatcgaagacgaggtgttccggaaaagaaaccttacaattatggatctgcaccccgggtccggaaagacgcgccggtacctgcctgctatcgttagagaagccattaaacgcaagctccggaccctgatccttgccccgacaagagtggtcgcttctgagatggccgaagctctgaagggcatgcccattcgctatcaaaccacagccgtgaaaagcgagcacaccgggaaggagatcgttgacctcatgtgccatgcgacgtttacaatgcggctgctgtcccctgtgagagtccccaattacaacatgatcattatggatgaagcccacttcaccgaccctagctctatcgctgcccggggctatatttccacccgcgtgggaatgggcgaggctgccgccatctttatgacagctacaccccctgggagcgtggaagcgttcccgcagtctaatgccgtcattcaggatgaggaaagagacatccccgagcggagctggaactccggatacgagtggatcacagattttcctggcaaaaccgtttggttcgtgccctctattaagagcgggaatgacatcgctaactgtctccgcaaaaatggaaagagagtgattcagctttcccggaagacgttcgatacagaataccagaagaccaagaacaacgactgggactatgtcgtgacaaccgatatctctgagatgggcgccaattttagagccgaccgcgttattgatcctcggagatgcctgaaacccgtgatcctgaaggacgggccggaacgcgtcattctcgctggccctatgcccgtgacggttgccagcgcggctcagcggagaggacgcatcggccggaaccataataaagagggggatcagtacatctatatgggacagcccctgaacaatgacgaggatcacgcccattggaccgaagccaagatgcttctggacaacattaatacacctgagggcatcattcccgctctcttcgaacctgagagagaaaagtccgccgcgatcgatggggagtaccgcctgagaggagaggcccggaaaacctttgtggaactgatgcgcagaggcgacctcccggtctggcttagctataaggtggcttctgaggggttccaatactccgatcggcgctggtgctttgacggcgaaagaaacaatcaggtcctggaggaaaacatggatgtggagatttggacaaaagagggagaacggaagaaactgagaccccgctggctcgacgcccggacctatgctgaccctctggcccttagagagttcaaggaatttgctgccggccgccggagcgtttccggggatctgatcctcgagatcggaaaactgccccagcacctgacacagagagcgcaaaatgccctcgacaaccttgtgatgctgcacaattctgaacagggcgggcgggcttaccgccatgccatggaggagctgcctgataccattgaaacgctcatgctgcttgctctgatcgccgtgctcacaggaggcgtcaccctgttctttctgagcggcagagggctcggaaagacctccattggccttctgtgtgttatggcctctagcgtgctgctctggatggcttccgtggagccccactggatcgcggccagcattatcctggagttctttcttatggtcctgctcatcccggagcctgaccggcagcgcacaccccaggataaccaactggcttacgtggttattgggctcctgttcatgatccttaccgtggccgccaatgagatgggactgctggaaacaacgaagaaagacctcggcattgggcatgtcgctgtggagaaccaccaccatgccgcgatgctggatgtcgaccttcaccctgcctctgcttggaccctgtatgccgtggctacaaccatcattacacccatgatgagacataccatcgaaaacacgaccgccaatatttccctcacagcgatcgccaaccaggctgccatcctgatgggactggataagggctggcctattagcaaaatggacatcggcgttcccctccttgctctggggtgctactctcaggtgaatccgctgaccctcacagccgctgtcctgatgcttgtggcccactatgcgattatcggacctggcctgcaagccaaggctacccgggaggcccagaaacgcacggctgccgggattatgaagaaccccacagttgatggaatcgtggccatcgacctcgatcccgtcgtgtacgacgcgaagtttgaaaaacagctgggccagattatgctgctcatcctttgtacctcccaaattctgctgatgagaacaacctgggctctctgcgagagcatcaccctggccacagggcctcttacgaccctgtgggagggatctccgggcaagttctggaatacaaccattgctgtgagcatggccaacatcttccggggctcctatctcgccggggctggactggccttttctctgatgaaaagcctcggcgggggacgcagaggcacaggggcgcagggagaaacccttggcgagaagtggaaacggcagctgaatcagctgtccaagagcgagttcaacacgtacaagaaatccggcatcatggaggttgacagatctgaagccaaggaggggctcaaacgcggagagacaaccaagcatgctgtcagccggggcaccgccaaactgagatggtttgtggaacgcaatcttgtgaagcccgaggggaaggtcattgatctgggatgtggcagagggggatggtcctattactgcgctggcctcaaaaaggttacagaagtgaaaggctacaccaaagggggacctggccacgaggaacccatccctatggccacatatgggtggaacctggtgaaactgcactctggaaaggacgtcttctttattccccctgagaaatgtgatacgctcctttgcgacatcggcgagagctccccgaatcccaccattgaagaggggagaacactgcgcgtgctgaagatggttgaaccttggctccggggaaaccaattctgtatcaagattctgaatccctacatgccttctgtggtcgagacccttgagcagatgcagagaaaacatggcggcatgctggtgcgcaaccccctcagcagaaattccacacacgaaatgtattgggttagctgcgggaccggaaacatcgtgtctgcggtcaatatgacgtccagaatgctgctgaaccgctttaccatggcccatcggaagccgacatacgagagagatgtggacctcggcgctgggacccgccacgtggccgtcgaacctgaggttgctaacctggatatcattggacagagaatcgaaaatattaaacacgagcataagagcacatggcactatgacgaggataacccctacaaaacctgggcctatcatggctcttacgaagtgaagccctccgggagcgcttcttccatggtgaatggagtcgtgaaacttctgacaaaaccttgggacgttatccccatggtgacccaaattgccatgacggatacaacccctttcggccagcagcgggtctttaaggagaaagtggacacccgcacaccgaaggcgaaacaaggcacggcccagatcatggaagttaccgctaagtggctctgggggttcctgagcagaaacaagaaaccccggatctgtacaagagaggaatttacccggaaggtgcgctccaatgccgctattggagccgtcttcgtggacgagaaccagtggaatagcgccaaagaggcggttgaagatgagagattttgggaccttgtgcaccgggaacgcgagctgcataagcagggcaaatgcgctacatgcgtctacaacatgatggggaagagagaaaagaaactcggagagttcggcaaggccaaagggtctcgggccatctggtatatgtggctgggcgctcgcttcctggagtttgaagccctcggattcatgaatgaggatcactggtttagcagagaaaactccctgtctggcgtggagggggagggacttcacaagctgggctacattctccgggacatcagccaaattcctgggggaaatatgtatgctgatgacaccgccggctgggatacacgcatcaccgaagacgatctgcagaacgaggcgagaatcacggacattatggaacccgagcatgcccttctggctaaatccatcttcaagctcacctaccagaataaagtcgtgcgggttcagcgccctgccaagaacgggacagtgatggatgtcatttctagacgggaccaacgcggcagcggacaggtgggcacctatgggctgaatacatttaccaacatggaagctcagctgatcagacagatggagtccgagggaattttctctcccagcgaactcgagacgccgaacctggccgaacgggtgcttgattggctggagaagtacggcgttgaaagactcaaacgcatggcgatctccggggacgactgtgtggtcaagcctatcgatgaccggtttgccacagctctgaccgcccttaatgatatgggaaaagtgagaaaggacattccccaatgggagcctagcaaaggctggaacgattggcagcaggttcccttctgctctcaccattttcaccagctgatcatgaaggacgggcgcgagattgtggtcccttgtcggaatcaagatgaactcgtgggcagagctcgcgtctcccagggagccggctggagcctgcgggagacagcttgcctggggaagtcttatgcccagatgtggcaactcatgtacttccacagacgcgacctgcggcttgcggccaacgctatctgttccgccgtgcccgttgattggattccgaccagcagaacgacctggtccatccatgcccaccatcagtggatgacaaccgaagacatgctgtctgtgtggaatcgcgtctggattgaggaaaacccttggatggaggataaaacacacatcagctcctggggagacgtgccctacctcggcaagcgggaggaccagtggtgcgggagcctgatcggacttaccgctagagccacatgggcgaccaatattcaggttgctatcaaccaagtgcggagactgattggcaatgaaaactatctcgattacatgacgtctatgaaacgctttaagaatgagtccgaccccgaaggggccctgtggtga

SEQ ID NO: 19181 - RNA, 9879 nt, synthetic construct
  misc_feature 1..9879: note = derived and/or modified CDS sequence (opt5) from DENV-1__JF937605__SS-prME
  source 1..9879: mol_type = other RNA
agcgtgaccatgctgctcatgctgatgcccaccgcccttgctttccacctgacgaccagaggcggggagcctcatatgatcgtctccaagcaggaacggggaaaatctctcctgtttaagaccagcgccggcgttaacatgtgcacccttattgcgatggacctgggggagctctgtgaagatacaatgacctacaaatgcccgagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacactgcaagagacctggaatcgccaggacctcctggtgaccttcaaaacagctcacgcgaagaagcaggaagtcgtggttctgggatctcaagagggcgccatgcacacggctctcaccggggccacagaaattcagaccagcggaacaaccacgatctttgccggccatctgaaatgcagacttaagatggataaactgacactcaaggggatgtcctatgtgatgtgtaccggcagcttcaaactggagaaggaagtcgctgagacccagcacggaacagtgctggttcagattaagtacgagggcaccgacgccccgtgcaaaatccctttctctacacaagatgaaaagggggtgacgcagaacggacggcttatcaccgcgaatcccattgtcacagacaaagagaagcctgtgaacatcgaagctgagccgccctttggcgagtcctatattgtgatcggggccggagaaaaagccctcaagctgagctggttcaagaaaggctctagcattgggaagatgtttgaggctaccgccagaggcgctcgccggatggccatcctgggagatacagcgtgggacttcggctccatcgggggagtttttacctctgtcggcaaactcgtgcatcagattttcgggacggcctacggagtgctgtttagcggcgtctcctggaccatgaagatcgggattggcgtgcttctgacatggctcggactgaatagcagatctacctccctgagcatgacatgtatcgctgttggccttgtgaccctctacctgggggtcatggtgcaggccgattctggatgcgttattaactggaaaggccgcgaactgaagtgtgggtccggaatcttcgtgacaaatgaggtccacacctggacggaacaatataagtttcaggctgacagccctaaacggctctccgccgcgattggcaaggcctgggaggagggggtgtgcggcatcagatctgctacacgcctggaaaacatcatgtggaaacagattagcaacgagcttaatcatatcctgctcgaaaacgacatgaagttcaccgttgtggtcggagatgtggccggcattctggctcaggggaaaaagatgatccggccgcaacccatggagtacaaatattcctggaagtcttggggaaaggccaaaattatcggcgccgacgtgcagaataccacatttatcattgatgggcctaacacccccgaatgtcctgacgatcagagagcttggaatatctgggaggtcgaggactacggattcggcatttttacgacaaacatctggctgaaacttcgcgatagctatacccaggtttgcgaccaccggctcatgtccgcggccattaaagatagcaaggctgtgcacgccgacatgggctactggatcgaatctgagaaaaatgaaacatggaagctggccagagcttccttcatcgaggtgaagacctgtatttggcccaaaagccatacactgtggtctaacggggtcctcgaatccgagatgatcattccgaagatctatggaggccctattagccaacacaattaccgccccgggtacttcacccaggccgcgggaccttggcatctgggcaaacttgagctggattttgacctctgcgaagggacgaccgtggttgtggatgagcactgcggaaaccggggcccctctctgagaacaaccacagtcaccggcaagatcatccacgaatggtgttgccggagctgtacgctgcctccccttcgcttcagaggggaggacggatgctggtatggcatggagattcggccggtgaaagaaaaggaggaaaatctcgttaagtccatggtgagcgctgggtctggagaggtcgactcctttagcctgggcctgctctgtatctccattatgatcgaagaggtgatgagatctcgctggagccggagaatgctgatgacagggacccttgccgttttctttctgctcattatgggacagctgacatggaacgatctgatccgcctttgcattatggtgggcgccaatgcttccgacagaatgggcatggggaccacctacctggccctcatggcgacattcaaaatgcggcctatgtttgctgtcggactcctgttccgcagactgacgtctcgggaggtgcttctgctcaccatcggcctgagcctggtggcctccgtcgaacttcccaactctctggaggaactcggggatggactggccatgggcatcatgattctcaagctgcttacagactttcaaagccatcagctgtgggctaccctcctgtccctgacattcatcaaaaccacgtttagccttcactatgcctggaagacaatggctatggttctgtctattgtgtccctcttccccctgtgtctcagcaccacctctcagaaaacaacctggctgcctgtgcttctggggtccctgggatgcaagccgctcacaatgtttctgatcgccgagaataagatttggggccgcagaagctggccccttaacgaaggcatcatggcggtcgggatcgtgtctattctgctctccagcctgctcaaaaacgatgttcctctggccggaccccttatcgctggcgggatgctgattgcctgttacgtgatctccggaagctctgctgacctgagcctcgagaaggccgccaaagtctcctgggaggaagaggctgaacattctggcgcgagccacaatattctggtggaggttcaggatgacgggacgatgaagatcaaagatgaggaacgggacgatacccttacaatcctgctcaaggccaccctgctcgctgtgtccggagtctatcctctgtctattcccgccacacttttcgtgtggtacttctggcagaagaagaagcagcgcagcggcgtcctgtgggacacccctagccctcccgaggtggaaagagccgttctggatgacggcatctatcggattatgcagcgcgggctcctgggaagatctcaggtgggcgtcggggtgtttcaagagaacgttttccatacgatgtggcacgtgacccggggagctgtccttatgtaccagggcaaaagactggaacccagctgggccaatgtgaagaaagacctcatctcctacgggggaggctggcgcctgcagggcagctggaacacaggggaggaggtgcaggttattgcggtcgaacccggaaagaatcctaaaaacgtgcaaaccgctcccggcacatttaagaccccggagggggaagtgggagccatcgccctcgatttcaagcctggcacatctgggtcccccattgtcaatcgggagggaaaaatcgtgggcctgtatggcaacggggttgtgacgaccagcggaacatacgtctctgctatcgcccaggcgaaggcttcccaggaaggccctcttcccgagattgaggacgaagtgtttagaaaacgcaatctgaccatcatggatctgcaccccgggagcggaaagacccggagatatctccctgccattgttcgcgaggccatcaaacggaagctgagaacacttattctggctccgacgcgcgtggtcgcctccgaaatggctgaggccctcaagggcatgcccatccggtaccaaaccacagcggtgaaatctgaacataccgggaaggagatcgttgacctgatgtgccacgccacattcaccatgagactgctcagccctgtgcgggtccccaactataatatgattatcatggatgaggctcattttacggacccttccagcattgccgctcgcggctacatctctacaagagtgggaatgggcgaagccgccgctattttcatgaccgcgacaccccctgggtccgtggaggcctttccgcagagcaacgctgtcatccaggatgaggaacgggacatccccgaacgctcttggaatagcggatatgagtggattacagatttccctggcaaaaccgtttggtttgtgccctccatcaagtctgggaacgacattgccaattgtcttcgcaagaacggaaagcgggtgatccagctgagcagaaagacattcgataccgagtaccagaaaacgaagaacaatgactgggactacgtcgtgacaaccgatatttccgaaatgggcgccaacttccgcgctgaccgggttatcgatcctagacgctgcctgaaacccgtgattctcaaggacgggccggagcgggtcatcctggccggccctatgcccgtgacagttgcgtctgctgcccagagacgcggacggatcggcagaaatcacaacaaagaaggggatcagtatatttacatgggacagccccttaataacgacgaggatcatgcccactggaccgaggctaagatgctgctcgacaatatcaacacgcctgaaggcattatccccgccctgtttgagcctgaacgcgaaaagtccgcggccattgatggggaatatagactgcggggagaggctcgcaaaaccttcgtggagctcatgagacggggcgaccttccggtctggctgtcctacaaggtggccagcgaagggtttcaatattctgatcgcagatggtgcttcgacggcgagcggaataaccaggtcctggaagagaatatggatgtggaaatctggacaaaagagggagagagaaagaaactccgcccccggtggctggacgctagaacctactccgaccctcttgccctgcgcgaatttaaggagttcgctgccggccggagaagcgtttccggggatctcatcctggaaattggaaaactgccccagcacctcacacagcgggcgcaaaacgcccttgacaatctggtgatgctgcataactctgagcagggcgggcgcgcttatagacacgccatggaggagctccctgataccatcgagacactgatgcttctggctctcattgccgtgctgaccggaggcgtcacgctgtttttcctcagcggccgggggcttggaaagacatccatcggcctgctgtgtgttatggcctctagcgtgctcctgtggatggcttccgtggaaccccattggattgcggccagcatcatccttgagtttttcctgatggtcctcctgattccggaacctgaccgccagagaacaccccaggataatcaactggcttacgtggttatcgggctcctttttatgattctgaccgtggccgccaacgagatgggactgctcgagacaaccaagaaagacctgggcatcgggcacgtcgctgtggaaaaccaccatcacgccgcgatgcttgatgtcgacctgcatcctgcctctgcttggacactctacgccgtggctacgaccattatcacacccatgatgcggcacaccattgagaatacaaccgccaacatctccctgacggcgatcgccaatcaggctgccattctgatgggactcgataagggctggcctatcagcaaaatggacattggcgttccccttctggctctggggtgctattctcaggtgaacccgctcaccctgacagccgctgtccttatgctggtggcccattacgcgatcattggacctggcctccaagccaaggctacccgcgaagcccagaaaagaacagctgccgggatcatgaagaatcccaccgttgatggaatcgtggccattgacctggatcccgtcgtgtatgacgcgaagttcgagaaacagctgggccagatcatgctccttattctgtgtacgtcccaaatcctgctcatgcggacaacctgggctctgtgcgaaagcattacacttgccaccgggcctctgaccacactctgggagggatctccgggcaagttttggaacacgaccatcgctgtgagcatggccaatatcttccgcggctcctacctggccggggctggactggccttctctctcatgaaaagccttggcgggggaagacggggcacaggggcgcagggagagaccctgggcgaaaagtggaaaagacagctgaaccagctctccaagagcgagtttaatacatataagcgctccggcattatggaagttgaccggtctgaggccaaagaagggctgaagagaggagagaccacgaaacacgctgtcagccgcggcacagccaaacttcggtggttcgtggagagaaacctggtgaaacccgaagggaaggtcatcgatctcggatgtggccgcgggggatggtcctactattgcgctggcctgaagaaagttaccgaggtgaagggctacaccaaagggggacctggccacgaggagcccattcctatggccacatacgggtggaatctggtgaagctccattctggaaaagacgtctttttcattccccctgaaaagtgtgatacccttctgtgcgacatcggcgagagctccccgaaccccacaatcgaggaagggcggacgctgagagtgctcaaaatggttgagccttggctgcgcggaaatcaattttgtattaagatccttaacccctatatgccttctgtggtcgaaaccctggagcagatgcagcggaagcacggcggcatgctcgtgagaaatcccctgagccgcaactccacacatgagatgtactgggttagctgcgggaccggaaatatcgtgtctgcggtcaacatgacatcccggatgctgctcaacagattcaccatggcccaccgcaaaccgacgtatgaaagagatgtggacctgggcgctgggacccggcacgtggccgtcgagcctgaagttgctaatcttgatattatcggacagcgcattgagaacatcaagcatgaacacaaaagcacatggcattacgacgaggataatccctataagacctgggcctaccacggctcttatgaggtgaaaccctccgggagcgcttcttccatggtgaacggagtcgtgaagctgctcacaaagccttgggacgttattcccatggtgacccaaatcgccatgacagataccacgccttttggccagcagagagtcttcaaagaaaaggtggacacacggaccccgaaagcgaagagaggcaccgcccaaatcatggaggttacagctaaatggctgtgggggtttcttagccggaataagaagccccgcatttgtacgagagaagagttcacccggaaagtgcgctccaacgccgctatcggagccgtctttgtggacgaaaatcagtggaacagcgccaaggaggcggttgaggatgaaagattctgggacctggtgcatcgggagcgcgaactccacaaacagggcaagtgcgctacatgcgtctacaatatgatggggaaaagagagaagaagctgggagaatttggcaaagccaaggggtctcgggccatttggtacatgtggctgggcgctcgcttcctcgagttcgaggccctgggatttatgaacgaagatcactggttcagcagagaaaattccctttctggcgtggaaggggagggactgcataaactcggctatatcctgcgggacattagcaagatccctgggggaaacatgtacgctgatgacaccgccggctgggatacacgcatcaccgaggacgatcttcagaatgaagcgagaattacagacatcatggagcccgaacacgccctgctcgctaaatccatttttaagctgacctatcaaaacaaagtcgtgcgggttcagcgccctgccaagaatgggacggtgatggatgtcatctctagacgggaccagagaggcagcggacaggtgggcacctacgggctgaacacattcaccaacatggaggctcaactcattcgccagatggaatccgagggaatcttttctcccagcgagctggaaacaccgaatcttgccgagcgggtgctggattggctcgaaaagtatggcgttgagagactgaaacgcatggcgatctccggggacgactgtgtggtcaagcctattgatgaccggttcgccaccgctcttacggccctgaacgatatgggaaaagtgagaaaggacatcccccagtgggaacctagcaaaggctggaatgattggcagcaagttcccttttgctctcatcacttccaccagctcattatgaaggacgggcgcgagatcgtggtcccttgtcggaaccaggatgagctggtgggcagagctcgcgtctcccagggagccggctggagcctgcgggaaacagcttgcctcgggaagtcttacgcccaaatgtggcagctgatgtattttcatagacgcgaccttcggctggcggccaatgctatttgttccgccgtgcccgttgattggatcccgaccagcagaacaacctggtccattcacgcccatcaccagtggatgacgaccgaggacatgctctctgtgtggaaccgggtctggatcgaagagaatccttggatggaagataaaacacatatcagctcctggggagacgtgccctacctgggcaagagagaggaccaatggtgcgggagccttattggactgaccgctcgcgccacatgggcgaccaacatccaggttgctattaatcaggtgcggagactcatcggcaacgagaattacctggattatatgacatctatgaaacgcttcaagaacgaatccgaccccgagggggccctgtggtga

SEQ ID NO: 19182 - RNA, 9879 nt, synthetic construct
  misc_feature 1..9879: note = derived and/or modified CDS sequence (opt5) from DENV-1__JF937608__SS-prME
  source 1..9879: mol_type = other RNA
agcgtgaccatgctgctcatgctgatgcccaccgcgcttgctttccacctgacgacccggggaggggaacctcatatgatcgtgtccaagcaggaacggggaaagtctctcctgtttaagacaagcgccggcgttaacatgtgcacccttattgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagaaggttgaaacctgggccctgcggcaccccggcttcacagtgatcgctctttttctggcccatgcgattgggacctctatcacccagaagggaatcattttcatcctcctgatgcttgtcacacctagcatggccatgcgctgcgtgggcattgggtccagagattttgttgagggactgagcggcgctacgtgggtggacgtcgtgctcgagcacgggtcttgtgtgaccacaatggccaaagataagcccaccctggacatcgaactgctcaaaacagaggtcaccaaccctgctattctgcggaaactttgcatcgaagccaaaatttccaatacgacaaccgatagccgctgtccgacccaaggagaggcgacactggttgaagaacaggacgccaacttcgtgtgcagacggacctttgtggatcgcggctggggcaatgggtgtggactcttcggcaaggggtctctgatcacatgcgctaagtttaaatgcgtcacgaaacttgagggaaaaatcgtgcagtacgaaaacctgaagtattccgttattgtgaccgtccacacaggcgaccagcatcaagtggggaatgagagcaccgaacacggaacaaccgccacgatcacaccccaggctcctacaaccgagattcagctcacagactacggcgccctgaccctggattgttctcccagaacgggcctcgacttcaacgaaatggttctgcttacaatgaaagagaagtcctggctggtgcataaacagtggtttctcgatctgcctcttccctggaccagcggggcctccacatctcaagagacctggaatcggcaggacctgctcgtcaccttcaagacagctcacgcgaagaaacaggaagtggtcgtgctgggaagccaagagggcgccatgcacacggctctgaccggggccacagaaatccagacctccggaacaaccacgatttttgccggccatctcaagtgccgcctgaaaatggataaacttacactgaaagggatgagctatgttatgtgtaccggctctttcaagctcgagaaggaagtggctgagacccagcacggaacagtcctggtgcagatcaaatacgagggcaccgacgccccgtgcaagatccctttctccacacaagatgaaaaaggggttacgcagaacggaagactgattaccgcgaatcccatcgtgacagacaaggagaaacctgtcaacattgaagctgagccgccctttggcgagagctatatcgtgattggggccggagaaaaggcccttaagctctcttggttcaaaaagggcagctccatcgggaaaatgtttgaggctaccgcccggggcgctagacgcatggccatcctgggagatacagcgtgggacttcggctctattgggggagtgtttaccagcgttggcaagctggtccatcagatcttcgggacggcctacggagtgctcttttccggcgtgagctggaccatgaaaattgggatcggcgtcctgcttacatggctgggactcaattctcggtccaccagcctgtctatgacatgtattgctgtgggcctggttaccctttacctcggggtgatggtccaggccgattccggatgcgtgatcaactggaagggcagagaactgaagtgtgggagcggaattttcgttacaaatgaggtgcacacctggacggaacaatataaatttcaggctgactcccctaagcgcctgtctgccgcgatcggcaaagcctgggaggagggggtctgcggcatccggagcgctacaagactcgaaaacattatgtggaagcagatctccaacgagctgaatcatattcttctggaaaacgacatgaaattcaccgtggttgtgggagatgtcgccggcatcctcgctcaggggaagaaaatgattcgcccgcaacccatggagtacaagtattcttggaaaagctggggaaaggccaagatcatcggcgccgacgtgcagaataccacatttattatcgatgggcctaacacccccgaatgtcctgacgatcagcgggcttggaatatttgggaggtggaggactacggattcggcatctttacgacaaacatttggctgaaactgagagattcctatacccaggtctgcgaccaccgccttatgagcgcggccatcaaggattctaaagctgttcacgccgacatgggctactggatcgaatccgagaagaatgaaacatggaagctcgcccgggctagcttcattgaggtgaaaacctgtatctggcccaagtctcatacactgtggtccaacggggtgctggaaagcgagatgattatcccgaaaatttatggaggccctatctctcaacacaattacagacccgggtacttcacccagacggccggaccttggcatctcggcaagctggagcttgattttgacctgtgcgaagggaccacagtcgtggttgatgagcactgcggaaaccgcggccccagcctccggaccacaaccgtgacgggcaaaatcattcacgaatggtgttgcagatcctgtacactgcctcccctgcggttccgcggggaggacggatgctggtatggcatggagatcagaccggtcaaggaaaaggaggaaaatcttgtgaaaagcatggtttctgcggggtccggagaggtggacagcttttccctcggcctgctgtgtatttctatcatgattgaagaggtcatgcggagcagatggtcccgcaagatgctcatgaccgggacactggctgtgttccttctgctcatcatgggacagctgacctggaacgatctgattcggctttgcatcatggttggcgccaatgcctctgacagaatgggcatggggaccacatacctggctctcatggccacgtttaaaatgcgccctatgttcgcggtgggactgctctttagacggctgaccagccgcgaggtccttctgctcacaatcggcctgtccctggtggcttctgtggaacttcccaacagcctggaggaactcggggatggactggccatgggcattatgatcctcaagctgcttaccgacttccaatcccatcagctgtgggccacactcctgagcctgacctttattaaaacgacattctctcttcactatgcttggaagaccatggccatggtcctgtccatcgttagcctctttcccctgtgtctctctaccacatcccagaagaccacatggctgcctgtgcttctggggagcctgggatgcaaaccgctcacgatgttcctgattgctgagaataagatctggggcagacggtcttggccccttaacgaaggcatcatggccgtggggattgtctccatcctgctcagctccctgctcaaaaacgatgtgcctctggcgggaccccttattgccggcgggatgctgatcgcttgttacgttattagcggatctagcgccgacctgtccctcgagaaggctgccgaggtgtcttgggaagaggaagccgagcatagcggcgcttcccacaatatcctggtcgaagtgcaggatgacgggaccatgaaaatcaaggatgaggagcgcgacgatacacttaccattctgctcaaagcgacactgctcgccgtttctggagtgtatcctctgagcatccccgctaccctttttgtctggtacttctggcaaaagaagaaacagagatccggcgtgctgtgggacacgccttctcccccggaagtcgagcgggccgtgctggatgacggcatttatcgcatcatgcagagagggctcctgggacggagccaggttggcgtgggggtcttccaagaaaacgtgtttcataccatgtggcacgttacacgcggagccgtgcttatgtaccagggcaagagactggagccttcctgggctagcgtcaaaaaggacctcatttcttacgggggaggctggcggctgcagggctcctggaataccggggaggaagtccaggtgatcgccgttgagcccggcaagaaccctaagaatgtccaaacaacccccggcacattcaagacgccggaaggggaggtgggagcgattgctctcgattttaaacctggcaccagcgggtctcccatcgtgaacagagaaggaaagatcgtcggcctgtatggcaatggggtggttacaacctccggaacctacgtgagcgccattgcccaggctaaagcctcccaggagggccctcttcccgagatcgaagacgaggtcttccgcaagcggaacctgacaattatggatctgcaccccgggtctggaaaaacgagacgctatctccctgcgatcgtgcgggaagctattaagagaaagctgcgcacccttatcctggccccgacacgggttgtggccagcgagatggctgaagccctcaaaggcatgcccatcagataccaaaccacagctgtcaagtccgagcataccgggaaagagattgtggacctgatgtgccacgccacgtttacaatgcgcctgctcagccctgttcgggtgcccaattataacatgatcattatggatgaagcgcatttcaccgacccttcttccatcgccgctagaggctacattagcacccgggtcggaatgggcgaggccgctgccatctttatgacagccacaccccctgggtctgtggaggctttcccgcagagcaatgcggtgatccaggatgaggaacgcgacattcccgagagatcctggaactctggatatgagtggatcacagattttcctggcaagaccgtctggttcgttcccagcattaaatccgggaatgacatcgccaactgtcttcggaagaatggaaagcgcgtgattcagctgtctagaaaaacgtttgatacagaataccaaaagaccaaaaacaacgactgggactacgtggtcacaaccgatatcagcgagatgggcgctaatttccgggccgacagagtgattgatcctcgccggtgcctgaagcccgttatcctcaaagacgggccggaaagagtgatcctggccggccctatgcccgtcacggtggcttccgccgcgcagcgccggggaagaattggccgcaaccacaataaggagggggatcagtatatctacatgggacagccccttaacaatgacgaggatcatgctcactggaccgaagccaagatgctgctcgacaacattaatacacctgagggcatcattcccgccctgttcgaacctgagcgggaaaagagcgctgccatcgatggggagtatagactgcgcggagaggcgagaaagacctttgttgagctcatgcggcgcggcgaccttccggtgtggctgtcttacaaagtcgcctccgaggggttccaatatagcgatagacggtggtgctttgacggcgaacgcaacaatcaggtgctggaggaaaacatggatgtcgagatctggacaaaggagggagaacgcaagaagctccggcccagatggctggacgctcgcacctactccgaccctcttgccctgcgggagttcaaagaatttgctgccggcagacgctctgtgagcggggatctcattctggagatcggaaagctgccccagcacctcacacagcgggctcaaaatgcccttgacaacctggttatgctgcataattccgaacagggcgggagagcgtatcggcacgccatggaggagctccctgataccattgaaacgctgatgcttctggctctcatcgccgtgctgacaggaggcgtgaccctgttctttctctctggccgcgggcttggaaagaccagcattggcctgctgtgtgtcatggcttccagcgttctcctgtggatggcctctgtggagccccattggatcgccgcttccatcattcttgagttctttctgatggtgctcctgatcccggagcctgacagacagcggacaccccaggataaccaactggcgtacgtcgtgattgggctccttttcatgatcctgaccgttgccgctaatgagatgggactgctcgaaacaacgaaaaaggacctgggcattgggcacgtggccgtcggaaaccaccatcacgccgctatgcttgatgtggacctgcatcctgccagcgcgtggaccctctacgccgtcgctacaaccatcattacacccatgatgcgccacaccatcgagaacacgaccgccaatatctctctgacagctattgccaaccaggcggccatcctgatgggcctcgataaaggctggcctatttccaagatggacatcggggtgccccttctggctctgggatgctatagccaggttaatccgctcaccctgacagccgctgtgcttatgctggtcgcccattacgctattatcggccctgggctccaagccaaagcgaccagagaagcccagaagcggacggctgccggaatcatgaagaaccccacagtggatggcattgttgctatcgacctggatcccgtggtctatgacgccaaatttgagaagcagctggggcagattatgctccttatcctgtgtacctctcaaattctgctcatgcgcacaacctgggccctgtgcgaaagcatcacccttgcgacaggacctctgacgaccctctgggagggctccccgggcaaattctggaatacaaccatcgctgtgtctatggccaacatttttagagggagctacctggctggagccggcctggccttctccctcatgaaaagccttgggggaggccggcgcgggacaggagctcagggcgagaccctgggcgaaaaatggaagagacagctgaatcagctctccaagtctgagttcaacacgtataaacggagcgggatcatggaagtggacagatccgaggccaaggaaggactgaaacgcggcgagacaaccaagcacgcggtttctcgggggaccgccaaacttagatggtttgtcgagcgcaatctggtgaagcccgaaggaaaggtgattgatctcggctgtgggcggggaggctggagctactattgcgctggcctgaaaaaggtcacagaggttaaagggtacaccaagggaggccctgggcacgaagaacccatccctatggccacatacggatggaacctggtgaaactccattccggcaaggacgtgttctttattccccctgaaaaatgtgatacgcttctgtgcgacatcggggagtctagcccgaatcccaccattgaggaaggaagaacactgcgcgtcctcaagatggtggagccttggctgcggggcaaccaattctgtatcaagatccttaatccctatatgccttccgttgtggaaaccctggagcagatgcagagaaaacacggcgggatgctcgtccgcaaccccctgagcagaaattctacacatgagatgtactgggtgtcctgcggaaccggcaacattgttagcgctgtgaatatgacgtctagaatgctgctcaaccgctttaccatggcccaccggaagccgacatatgaaagagatgtcgacctgggggcgggaacccgccacgtggccgtggagcctgaagtcgctaaccttgatatcattggccagagaatcgagaatattaaacatgaacacaagtccacatggcattacgacgaggataacccctataaaacctgggcctaccacgggagctatgaggttaagccctctggatccgctagctccatggtgaatggcgtggtcaagctgctcacaaaaccttgggacgtgatccccatggttacccaaatcgccatgacggatacaacccctttcggccagcagcgggtgtttaaggaaaaagtcgacacccgcacaccgaaggctaaaagagggacggcccaaattatggaggtgaccgcgaagtggctgtggggattccttagccggaacaagaaacccagaatctgtacacgggaagagtttacccgcaaggttagatctaatgccgctattggcgccgtgttcgtcgacgaaaaccagtggaatagcgctaaagaggccgtggaggatgaacggttttgggacctggttcatcgcgagagagaactccacaagcaggggaaatgcgccacatgcgtgtacaacatgatgggaaagcgggagaagaaactgggcgagttcgggaaggcgaaaggctcccgcgctatctggtacatgtggctgggagccagatttctcgagttcgaggccctgggcttcatgaatgaagatcactggttttctcgggagaacagcctttccggggtcgaaggagagggcctgcataagctcgggtatattctgcgcgacatctctaaaatccctggaggcaatatgtacgctgatgacaccgccgggtgggatacaagaattaccgaggacgatcttcagaacgaagctcggatcacggacattatggagcccgaacacgccctgctcgccaagagcatcttcaaactgacctatcaaaataaggtggtccgcgtgcagagacctgccaagaacggcacagttatggatgtgatttcccggcgcgaccagagaggatctggccaggtcgggacctacggactgaatacatttaccaacatggaggctcaactcatccggcagatggaaagcgagggcatcttctcccccagcgagctggaaacgccgaaccttgccgagagagtgctggattggctcgaaaaatatggggtggagcgcctgaagcggatggctatttctggagacgactgtgttgtgaaacctatcgatgacagatttgccacagcgcttaccgccctgaatgatatgggcaaggtccgcaaagacattccccagtgggaaccttccaaggggtggaacgattggcagcaagtgcccttctgcagccatcactttcaccagctcatcatgaaggacggccgggagattgttgtgccttgtagaaatcaggatgagctggtcggacgcgctcgggtgtctcagggcgccgggtggtccctgagagaaacagcttgcctcggaaaaagctacgcccaaatgtggcagctgatgtatttccatcgccgggaccttagactggctgccaacgcgatctgttccgccgtccccgtggattggattccgacctctcgcacgacctggagcatccacgctcatcaccagtggatgacaaccgaggacatgctctccgtttggaatcgggtgtggatcgaagagaacccttggatggaagataagacacatattagctcttggggcgacgtcccctacctggggaaaagagaggaccaatggtgcggatcccttatcggcctgaccgcccgggccacatgggctaccaatattcaggtggccatcaaccaggttagacgcctcattgggaatgagaactacctggattatatgacgagcatgaagcggtttaaaaatgaatctgaccccgagggcgcgctgtggtga

SEQ ID NO: 19183 - RNA, 9879 nt, synthetic construct
  misc_feature 1..9879: note = derived and/or modified CDS sequence (opt5) from DENV-1__GU131739__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatggtcctgtccattgttagcctcttccccctgtgtctctctaccacatcccagaagaccacatggctgcctgtgcttctggggagcctgggatgcaagccgctcacgatgtttctgatcgctgagaataaaatttggggccggcgctcttggccccttaacgaaggcatcatggccgtggggatcgtctccattctgctcagctccctgctcaagaacgatgtgcctctggcgggaccccttatcgccggcgggatgctgattgcttgttacgttatcagcggatctagcgccgacctgtccctcgagaaagctgccgaggtgtcttgggaagaggaagccgagcatagcggcgcttcccacaatattctggtcgaagtgcaggatgacgggaccatgaagatcaaagatgaggagagagacgatacacctaccatccttctgaaggcgacactcctggccgtttctggagtgtatcccctcagcattcctgctaccctgttcgtctggtacttctggcagaagaagaagcagcggtccggcgtgctttgggacacgccctctccgcctgaagtcgagcgcgccgtgctggatgacggcatctatagaattatgcagcgggggctgctcggacgcagccaggttggcgtgggggtctttcaagaaaacgtgttccataccatgtggcacgttacaagaggagccgtgctgatgtaccagggcaaacggcttgagccctcctgggctagcgtcaagaaagacctgatctcttacgggggaggctggagactccagggctcctggaataccggggaggaagtccaggtgattgccgttgagcctggaaagaaccccaaaaatgtccaaacagcgccgggcacctttaagacacctgaaggggaggtgggagctatcgccctggatttcaagcccggcacgagcgggtctcctattgtgaaccgcgaaggaaaaatcgtcggcctctatggcaatggggtggttaccacatccggaacctacgtgagcgccatcgctcaggccaaggcgtcccaggagggccccctgcccgagattgaagacgaggtctttcggaaaagaaaccttaccatcatggatctgcaccctgggtctggaaagacacgccggtatctgccggctattgtgagagaagccatcaaacgcaagctccggacgctgattcttgcccccaccagagttgtggctagcgagatggccgaagctctgaagggcatgcctatccgctaccaaacaaccgccgtcaaatccgagcatacagggaaggagatcgtggacctcatgtgccacgcgaccttcacgatgcggctgctgagccccgttagagtgcctaattataacatgattatcatggatgaagcccattttacagacccctcttccattgctgcccggggctacatcagcacccgcgtcggaatgggcgaggctgccgccattttcatgaccgctacacctccggggtctgtggaagcgtttccccagagcaatgccgtgatccaggatgaggaaagagacatccctgagcggtcctggaactctggatatgagtggattaccgatttccccggcaaaacagtctggtttgttcctagcatcaagtccgggaatgacattgctaactgtctccgcaaaaatggaaagagagtgatccagctttctcggaagaccttcgatacggaataccagaagacaaagaacaacgactgggactacgtggtcaccacagatattagcgagatgggcgccaatttcagagccgaccgcgtgatcgatccccggagatgcctgaaaccggttattctgaaggacgggcctgaacgcgtgatcctcgctggccccatgcccgtcaccgtggcctccgcggctcagcggagaggacgcatcggccggaaccacaataaagagggggatcagtatatttacatgggacagcctctgaacaatgacgaggatcatgcccactggacggaagccaagatgcttctggacaacatcaatacccccgagggcattatccctgctctctttgaaccggagagagaaaagagcgccgcgattgatggggagtatcgcctgagaggagaggcccggaaaacattcgttgaactgatgcgcagaggcgacctccccgtgtggctttcttacaaggtcgcttccgaggggtttcaatatagcgatcggcgctggtgcttcgacggcgaaagaaacaatcaggtgctggaggaaaacatggatgtcgagatctggaccaaagagggagaacggaagaaactgagacctcgctggctcgacgcccggacatactccgaccccctggctcttagagagtttaaggagttcgccgctggccgccggtctgtgagcggggatctgatcctcgagattggaaaactgcctcagcacctgacccagagagcccaaaatgcgctcgacaaccttgttatgctgcataattccgaacagggcgggcgggcctatcgccacgctatggaggagctgcccgatacaatcgaaaccctcatgctgcttgccctgattgctgtgctcacgggaggcgtgacactgtttttcctgtctggcagagggctcggaaagaccagcatcggccttctgtgtgtcatggcctccagcgttctgctctggatggcctctgtggagccgcattggattgctgcgtccatcatcctggaatttttccttatggtgctgctcattcctgagcccgaccggcagcgcacccctcaggataaccaactggcctacgtcgtgatcgggctgctctttatgattcttacagttgctgccaatgagatgggactgctggaaaccacaaagaaagacctcggcatcgggcacgtggccgtcgagaaccaccatcacgctgccatgctggatgtggaccttcatcccgcgagcgcctggacgctgtacgctgtcgccaccacaattatcacccctatgatgagacacacaattgaaaacaccacggctaatatctctctcaccgccatcgcgaaccaggccgctattctgatgggactggataagggctggcccatctccaaaatggacattggcgtgccgctccttgccctggggtgctatagccaggttaatcctctgacactcaccgctgccgtgctgatgcttgtcgctcattacgccatcattggacccggcctgcaagcgaaggccacacgggaggctcagaaacgcaccgccgctgggatcatgaagaaccccacggtggatggaatcgttgccattgacctcgatcctgtggtctatgacgccaagttcgaaaaacagctgggccagatcatgctgctcattctttgtacatctcaaatcctgctgatgagaaccacatgggcgctctgcgagagcattaccctggctaccgggccgcttacaacgctgtgggagggatcccccggcaagttttggaataccacaatcgccgtgtctatggctaacatcttccggggcagctacctcgccggggccggactggctttctccctgatgaaaagcctcggcgggggacgcagaggcaccggggcccagggagaaacacttggcgagaagtggaaacggcagctgaatcagctgtccaagtctgaatttaacacctataagagaagcggcattatggaggtggaccgctccgaagcgaaagaggggctcaagcggggagagacgacaaaacacgccgtttctagaggcaccgctaagctgcgctggttcgtcgaacggaatcttgtgaaacctgaggggaaggtgatcgatctgggatgtggcagagggggatggagctactattgcgccggcctcaagaaagtcaccgaagttaagggctacacaaaagggggacccggccacgaggaacctattcccatggctacctacgggtggaacctggtgaagctgcattccggaaaagacgtgtttttcatccctccggagaagtgtgatacactcctttgcgacattggcgagtctagccccaatcctacgatcgaagaggggcgcaccctgcgggtcctgaaaatggtggaaccctggctcagaggaaaccaattttgtattaagatcctgaatccttatatgccctccgttgtggagacacttgagcagatgcagcgcaagcacggcggcatgctggtccggaacccgctcagcagaaattctacccatgaaatgtactgggtgtcctgcgggacaggaaacatcgttagcgccgtgaatatgacctctcgcatgctgctgaaccggttcacgatggcgcacagaaaacctacctatgagcgcgatgtcgacctcggcgccgggacaagacacgtggctgtggaacccgaggtcgccaacctggatattatcggacagcggattgaaaatatcaagcatgagcacaaatccacctggcattacgacgaggataacccctataagacatgggcttaccacggcagctatgaagttaaaccttctgggtccgccagctccatggtgaatggagtggtcaaacttctgaccaagccctgggacgtgattcctatggttacacaaatcgctatgaccgatacgacaccgtttggccagcagcgcgtgttcaaagagaaggtcgacaccagaacccccaaagccaagcggggcacagcgcaaatcatggaagtgacggccaaatggctctgggggtttctgagcagaaacaagaagcctcggatttgtacccgcgaggagttcacaagaaaagttcggtctaatgctgccatcggagctgtgtttgtcgacgagaaccagtggaatagcgccaaggaggccgtggaagatgagcgcttctgggaccttgttcatagagaacgggagctgcacaaacagggcaagtgcgcgacctgcgtgtacaacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtcgagggggagggacttcataaactgggctatatcctcagagacatttctaagatccccgggggaaatatgtacgccgatgacacagctggctgggatacccggatcacagaagacgatctgcagaacgaggcccgcattaccgacatcatggaacctgagcacgcgcttctggccaaaagcatttttaagctcacgtatcaaaataaagtggtcagagtgcagcggcccgctaagaacgggaccgttatggatgtgatctcccgcagagaccagcggggctctggacaggtcggcacatacgggctgaataccttcacaaacatggaagcccaactgattagacagatggagagcgagggaatcttttccccgagcgaactcgagacccctaacctggctgaacgcgtgcttgattggctggagaagtatggcgtggaacggctcaaaagaatggccatctctggggacgactgtgttgtgaagcccattgatgaccgcttcgcgacggccctgacagctcttaatgatatgggaaaagtccggaaggacatccctcagtgggagccctccaaaggctggaacgattggcagcaagtgcctttttgcagccatcacttccaccagctgattatgaaggacgggagagagatcgttgtgccctgtcgcaatcaggatgaactcgtcggccgggccagagtgtctcagggagctggctggtccctgcgcgagaccgcctgcctgggaaagagctacgctcaaatgtggcagctcatgtattttcatcggagagacctgcgccttgccgcgaacgccatttgttccgctgtcccggtggattggatccctacatctcggaccacgtggagcattcacgcccatcaccagtggatgaccacagaagacatgctgtccgtttggaatagagtgtggatcgaggaaaacccctggatggaggataaaacccatatcagctcttggggagacgtcccctacctcggcaagcgggaggaccaatggtgcgggtccctgattggacttacagccagagctacctgggccacaaatatccaggtggcgattaaccaggttcgccggctgatcggcaatgaaaactacctcgattatatgaccagcatgaaaagattcaagaatgagtctgaccctgaaggggctctgtggtga

SEQ ID NO: 19184 - RNA, 9879 nt, synthetic construct
  misc_feature 1..9879: note = derived and/or modified CDS sequence (opt5) from DENV-1__GU131740__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaagtgcccgagaatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgtgccgtgcaagattccttttagcacccaggatgaaaaaggggtcacacaaaacggacggctgatcacggcgaatcccatcgtgaccgacaaggagaaacctgtgaacattgaagctgagccgcccttcggcgagtcttatatcgttattggggccggagaaaaggccctgaaacttagctggtttaaaaagggctcctctatcgggaaaatgttcgaggctacagccagaggcgctcgccggatggccattctcggagataccgcgtgggactttggcagcatcgggggagtcttcacatccgtgggcaagctggtgcatcagatctttgggaccgcctacggagtcctgttcagcggcgtgtcttggacgatgaaaattgggatcggcgttctcctgacctggcttggactcaattccagaagcacatctctctccatgacctgtattgctgtgggcctggtcacactgtaccttggggtgatggttcaggccgatagcggatgcgtgatcaactggaagggccgcgaactcaagtgtgggtccggaatttttgtcaccaatgaggtgcacacatggaccgaacagtataaattccaagctgactctcctaagcggctgagcgccgcgatcggcaaagcctgggaggagggggtttgcggcattagatccgctacgcgcctggaaaacatcatgtggaagcagatctctaacgagctcaatcatattctgcttgaaaacgacatgaaatttacagtggtcgtgggagatgtggccggcatcctggctcaggggaagaaaatgattcggccgcagcccatggagtacaagtatagctggaagtcctggggaaaagccaagatcattggcgccgacgtccaaaataccaccttcatcatcgatgggcctaacacacccgaatgtcctgacgatcagagagcttggaatatttgggaggttgaggactacggatttggcatcttcaccacgaacatttggctcaaactgcgcgatagctatacacaggtgtgcgaccaccggctgatgtctgcggccatcaaggattccaaagctgtgcacgccgacatgggctactggattgaaagcgagaagaatgaaacctggaaacttgccagagcttctttcatcgaggtcaaaacatgtatctggcccaagtcccataccctctggagcaacggggtgctggaatctgagatgattatcccgaaaatttatggaggccctatcagccagcacaattaccgccccgggtactttacacaaaccgccggaccttggcatctgggcaagctcgagctggatttcgacctttgcgaagggacgaccgttgtggtcgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggttaaggaaaaagaggaaaatctggtgaagtctatggtctccgcggggagcggagaggtggactccttctctcttggcctcctgtgtattagcatcatgattgaagaggttatgcggtccagatggtctcgcaaaatgctgatgacagggaccctcgctgtgtttttcctgcttatcatgggacagctgacatggaacgatctcattcggctgtgcatcatggtcggcgccaatgccagcgacagaatgggcatggggaccacctacctggctcttatggccacatttaagatgcgccctatgttcgcggtgggactgctctttagacggctgacgtcccgcgaggtgctcctgcttaccattggcctgtctctcgtcgctagcgttgaactgcccaactccctggaggaacttggggatggactggccatgggcatcatgatcctcaaactgctcacagacttccagagccatcaactgtgggccacccttctgtcttttacattcattaagaccacgttttccctccactatgcttggaagacaatggccatggtgctgagcatcgtgtctctgttccccctttgtctgtccaccaccagccagaaaacaacctggctccctgtcctgctcgggtctctgggatgcaagccgcttacaatgttcctgattgctgagaataaagtgtggggcagaaagtcctggcccctgaacgaaggcatcatggccgttgggattgtgagcatcctcctgtccagccttctgaaaaacgatgtccctctcgcgggacccctgatcgccggcgggatgctcattgcttgttacgtgatctctggaagctccgccgacctgtctcttgagaaggctgccgaggttagctgggaagaggaagccgagcattccggcgcttctcacaatattctggtggaagtccaggatgacgggacgatgaaaatcaaggatgaggagcgggacgataccctgacaattctcctgaaggcgacccttctggccgtgagcggagtctatcctctctccatccccgctacactgtttgtgtggtacttctggcagaaaaagaaacaacgctctggcgttctctgggacaccccttcccctcccgaagtggagagagccgtcctggatgacggcatctatcggattatgcagcgcgggcttctgggaagatcccaggtgggcgttggggtgtttcaggaaaacgtcttccatacgatgtggcacgtgacccggggagccgtgctgatgtaccaaggcaagcgcctcgagcccagctgggcttctgttaaaaaggacctgatctcctacgggggaggctggagacttcagggcagctggaatacaggggaggaagtccaggtgattgccgtggagcccggaaagaaccctaaaaatgtccagaccgcgcccggcacatttaagacctctgaaggggaggtgggagctatcgccctggatttcaaaccgggcacatccgggagccctattgttaaccgggaaggaaagatcgtgggcctctatggcaatggggtcgtgacgacctccggaacatacgtttctgccattgctcaagccaaagcgagccaggagggccccctgcctgagatcgaagacgaggtgtttagaaagcgcaacctcaccatcatggatctgcaccccgggtccggaaagacccggagatatcttcccgctattgtccgcgaagccatcaaacggaagctgagaacactgattctcgcccctacgcgcgtggttgctagcgagatggccgaagctctgaaaggcatgccgatccggtaccagaccacagccgtgaagtctgagcataccgggaaagagattgtcgaccttatgtgccacgcgacattcaccatgagactgctctcccccgtgcgcgtgcctaattataacatgatcatcatggatgaagcccattttacggaccccagctctattgctgcccggggctacatcagcacaagagtcggaatgggcgaggctgccgccattttcatgaccgctacccctcccgggtccatggaagcgtttcctcaatctaatgccgttatccaggatgaggaacgggacattccggagcgcagctggaactccggatatgagtggatcacagatttccccggcaagaccgtgtggttcgtgccttctatcaagagcgggaatgacattgctaactgtctgcgcaagaatggaaagcgggtcatccagctgtcccgcaaaacatttgataccgaataccagaagacgaaaaacaacgactgggactacgtggttacaaccgatattagcgagatgggcgccaatttcagagccgaccgggtgatcgatcccagacgctgcctcaagcctgtcattcttaaggacgggcccgaacgggtgatcctggctggcccgatgcctgttacagtggcctctgcggctcaaagacgcggacggattggcagaaaccacaataaagagggggatcagtatatctacatgggacagcccctgaacaatgacgaggatcatgcccactggaccgaagccaagatgctcctggacaacatcaatacgcccgagggcattatccctgctctttttgaacccgagcgcgaaaaatccgccgcgattgatggggagtatcggctgagaggagaggcccgcaagaccttcgtcgaactcatgagacggggcgacctgcctgtgtggctgagctacaaagtcgcttccgaggggtttcagtattctgatcgcagatggtgcttcgacggcgaacggaacaatcaagtgctcgaggaaaacatggatgttgagatctggacaaaggagggagaacgcaagaaacttagaccgcggtggctggacgccagaacctacagcgaccccctggctctccgcgagtttaaagagttcgccgctggccggagatccgtgtctggggatctgattcttgagatcggaaaactgcctcagcacctcacacagcgcgcccagaatgcgctggacaacctggtgatgctccataatagcgaacaaggcgggcgggcctatagacacgctatggaggagcttcccgataccatcgaaacactgatgctgctcgccctgattgctgtccttaccggaggcgttacgctgtttttcctctccggccgggggctgggaaagacaagcatcggcctgctctgtgtgatggcctcttccgtgcttctgtggatggccagcgtcgagcctcattggattgctgcgtctatcattctggaatttttcctcatggtgctgcttatccccgagccggaccgccagagaacccctcaggataaccagctggcctacgttgtgatcgggctcctgtttatgattctgaccgtcgctgccaatgagatgggactccttgaaacaaccaaaaaggacctgggcatcgggcacgccgctgtggagaaccaccatcacgccgcgatgctggatgtcgacctccatcccgcctccgcttggacactgtacgccgtggctacgaccattatcacacctatgatgcggcacaccattgaaaacacaaccgccaatatcagccttacggcgattgccaaccaagctgccatcctgatgggactcgataaaggctggcccatctctaagatggacattggcgttcctctgctggctctcgggtgctatagccaggtgaatccccttaccctgacagccgctgtcctgatgctcgtggcccattacgcgatcattggaccgggcctgcaggccaaggctacccgcgaggcccagaagagaacagctgccgggatcatgaagaaccctaccgttgatggaattgtggccatcgaccttgatcccgtcgtgtatgacgcgaaattcgaaaagcagctgggccagatcatgctcctgattctgtgtacgtcccagatcctccttatgcggacaacctgggctctgtgcgagtctattacactggccaccgggcccctcaccacactgtgggagggaagccctggcaaattctggaatacgaccatcgctgtgtccatggccaacatttttcgcggcagctaccttgccggggctggactggccttctccctcatgaagtctctgggcgggggaagacggggcacaggggcgcaaggagaaaccctgggcgagaagtggaaacgccagctcaatcagcttagcaagtccgaatttaacacatataaaagatctggcatcatggaggttgaccggagcgaagccaaggaggggctgaaaagaggagagaccacgaagcacgctgtctcccgcggcacagccaagctgcggtggttcgtggaaagaaatctcgtgaaaccggaggggaaggtcatcgatctgggatgtggccgcgggggatggtcttactattgcgctggccttaaaaaggttaccgaagtgaaaggctacaccaaagggggacccggccacgaggaacctattcccatggccacatacgggtggaacctggtgaaactccatagcggaaaggacgtctttttcatccctcccgagaagtgtgataccctgctgtgcgacattggcgagtccagccctaatccgacaatcgaagaggggcggacgctcagagtgcttaaaatggttgaaccctggctgcgcggaaaccagttttgtattaagatcctgaatccttatatgccctctgtggtcgagaccctcgagcaaatgcagcggaaacacggcggcatgctggtgagaaaccctctttcccgcaatagcacacatgaaatgtactgggtttcttgcgggaccggaaacattgtgtccgcggtcaatatgacaagccggatgctgctcaacagattcaccatggcccaccgcaagcccacgtatgagcgggatgtggacctgggcgctgggaccagacacgtggccgtcgaaccggaggttgctaacctggatatcatcggacagcgcattgaaaatatcaaacatgagcacaagtctacatggcattacgacgaggataacccttataagacctgggcctaccacggctcctatgaagtgaaacccagcgggtccgctagctctatggtgaatggagtcgtgaagctcctgacaaaaccctgggacgttattcctatggtgacccagatcgccatgacagataccacgccctttggccaacagagagtcttcaaggagaaagtggacacacggacccctaaggcgaagcgcggcaccgcccagattatggaagttacagctaaatggctttgggggtttctgagcagaaacaagaaaccgcggatctgtacgagagaggagttcacccggaaggtgcgctccaatgccgctatcggagccgtctttgtggacgagaaccaatggaactctgccaaagaggcggttgaagatgagagattctgggacctcgtgcatcgggaacgcgagctgcacaagcagggcaagtgcgctacatgcgtctacaacatgatggggaaaagagaaaagaaacttggagagttcggcaaggccaaagggagccgggccatttggtacatgtggctgggcgctcgctttctcgagttcgaagccctgggatttatgaatgaggatcactggttctccagagaaaactctctgagcggcgtggagggggagggactccataagctgggctatatccttcgggacatttccaaaatccccgggggaaatatgtacgctgatgacaccgccggctgggatacacgcattaccgaagacgatctgcagaacgaggcgaagatcacagacatcatggaacctgagcacgccctcctggctaagtctatttttaaacttacctatcagaataaggtcgtgagagttcaacggcccgccaaaaacgggacggtgatggatgtcatcagccgcagagaccagcggggctccggacaggtgggcacctacgggctgaatacattcaccaacatggaagctcagctcattcgccaaatggagagcgagggaatcttttctccttccgaactggagacacccaacctggccggcagagtgctcgattggctggaaaagcatggggttgagcggcttaaaagaatggcgattagcggagacgactgtgtggtcaagccgatcgatgaccgcttcgccaccgctctgacggccctcaatgatatgggcaaggtgcggaaagacatccctcagtgggaaccctctaaggggtggaacgattggcagcaggttcctttttgctcccaccacttccatcaactgattatgaaagacggcagagagatcgtggtcccctgtcgcaatcaggatgagcttgtgggacgggctagagtcagccagggcgccgggtggtccctgcgcgaaacagcttgcctcggaaagtcttatgcccagatgtggcaactgatgtactttcaccggagagacctgcgcctcgcggccaacgctatttgtagcgccgtgcctgttgattgggtgcccacctcccggacaacctggagcatccatgcccaccatcagtggatgacgaccgaggacatgctgtctgtctggaatagagtgtggattgaagagaacccgtggatggaagataaaacacacatctccagctggggcgacgttccttatcttgggaagcgcgaggaccagtggtgcggatctctgattggcctcaccgctcgggccacatgggcgaccaatatccaagtggctatcaaccaggtcagacggctgattgggaatgagaactaccttgattacatgacaagcatgaagagattcaaaaatgaatccgaccccgagggcgccctgtggtga

SEQ ID NO: 19185 - RNA, 9879 nt, synthetic construct
  misc_feature 1..9879: note = derived and/or modified CDS sequence (opt5) from DENV-1__GU131741__SS-prME
  source 1..9879: mol_type = other RNA
agcgtgacaatgctgctgatgctgatgcccacggcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggtgtctacaagccaagagacctggaatcgcaaagaccttctggtcacatttaagaccgctcacgcgaagaaacaggaagtggttgtgctcggatcccaggagggcgccatgcacaccgctctgacaggggccacggaaattcaaaccagcggaacaaccacaatcttcgccggccatctgaagtgcagactcaaaatggataagctgacccttaaagggatgtcttatgtcatgtgtacgggctccttcaagctggagaaggaagtggctgagacacagcacggaaccgttctcgtgcagattaaatacgagggcaccgacgccccgtgcaagatcccttttagcacacaggatgaaaaaggggtcacccaaaacggacggctgatcacagcgaatcccattgtgacggacaaggagaaacctgtgaacatcgaagctgagccgcccttcggcgagtcttatattgttatcggggccggagaaaaggccctgaaacttagctggtttaaaaagggctcctctattgggaaaatgttcgaggctaccgccagaggcgctcgccggatggccatcctcggagatacagcgtgggactttggcagcatcgggggagtcttcacctccgtgggcaagctggtgcatcagatttttgggacagcctacggagtcctgttcagcggcgtgtcttggaccatgaaaatcgggattggcgttctcctgacgtggcttggactcaattccagaagcacctctctctccatgacatgtatcgctgtgggcctggtcaccctgtaccttggggtgatggttcaggccgatagcggatgcgtgattaactggaagggccgcgaactcaagtgtgggtccggaatctttgtcacaaatgaggtgcacacctggacagaacagtataaattccaagctgactctcctaagcggctgagcgccgcgattggcaaagcctgggaggagggggtttgcggcatcagatccgctacccgcctggaaaacatcatgtggaagcagatttctaacgagctcaatcatatcctgcttgaaaacgacatgaaatttacggtggtcgtgggagatgtggccggcattctggctcaggggaagaaaatgatccggccgcagcccatggagtacaagtatagctggaagtcctggggaaaagccaagattatcggcgccgacgtccaaaatacaaccttcatcattgatgggcctaacacccccgaatgtcctgacgatcagagagcttggaatatctgggaggttgaggactacggatttggcattttcacaaccaacatctggctcaaactgcgcgatagctatacacaggtgtgcgaccaccggctgatgtctgcggccattaaggattccaaagctgtgcacgccgacatgggctactggatcgaaagcgagaagaatgaaacatggaaacttgccagagcttctttcatcgaggtcaaaacctgtatttggcccaagtcccatacactctggagcaacggggtgctggaatctgagatgatcattccgaaaatctatggaggccctattagccagcacaattaccgccccgggtactttacccaaacagccggaccttggcatctgggcaagctcgagctggatttcgacctttgcgaagggaccacggttgtggtcgatgagcactgcggaaaccggggcccctccctgagaaccacaaccgtgacaggcaaaatcatccacgaatggtgttgccggagctgtaccctccctcccctgcgctttaagggggaggacggatgctggtatggcatggagattagaccggttaaggaaaaagaggaaaatctggtgaagtctatggtctccgcggggagcggagaggtggactccttctctcttggcctcctgtgtatcagcattatgatcgaagaggttatgcggtccagatggtctcgcaaaatgctgatgacggggacactcgctgtgtttttcctgcttattatgggacagctgacctggaacgatctcatccggctgtgcattatggtcggcgccaatgccagcgacagaatgggcatggggacaacctacctggctcttatggccacctttaagatgcgccctatgttcgcggtgggactgctctttagacggctgacatcccgcgaggtgctcctgcttacgatcggcctgtctctcgtcgctagcgttgaactgcccaactccctggaggaacttggggatggactggccatgggcatcatgattctcaaactgctcaccgacttccagagccatcaactgtgggccacacttctgtctctcacctttatcaagacaaccttctccctgcactatgcttggaagacgatggccatggtgctgagcattgtgtctctttttcccctgtgtctctccacaaccagccagaaaaccacatggctgcctgtcctcctggggtctcttggatgcaagccgctgaccatgttcctgatcgctgagaataaaatttggggcagaaagtcctggcccctcaacgaaggcatcatggccgtggggatcgttagcattctgctttccagcctgctcaaaaacgatgtgcctctggcgggacccctcatcgccggcgggatgctgattgcttgttacgtcatctctggaagctccgccgacctttctctggagaaggctgccgaggtgagctgggaagaggaagccgagcattccggcgcttctcacaatattctggttgaagtgcaggatgacgggacaatgaaaatcaaggatgaggagcgggacgatacgctcaccatcctgcttaaggcgacactgctcgccgtcagcggagtgtatcctctgtccattcccgctaccctcttcgtctggtacttttggcagaaaaagaaacaacgctctggcgtgctgtgggacacaccttcccctcccgaagttgagagagccgtgcttgatgacggcatctatcggattatgcagcgcgggctgctgggaagatcccaggtcggcgtgggggttttccaggaaaacgtgtttcataccatgtggcacgtcacgcggggagccgtgctcatgtaccaaggcaagcgcctggagcccagctgggcttctgtgaaaaaggaccttatctcctacgggggaggctggagactgcagggcagctggaataccggggaggaagttcaggtcattgccgtggagcccggaaagaaccctaaaaatgtgcagacagcgcccggcaccttcaagacatctgaaggggaggtcggagctatcgccctcgattttaaaccgggcacctccgggagccctattgtgaaccgggaaggaaagatcgttggcctgtatggcaatggggtggtcacaacgtccggaacctacgtgtctgccatcgctcaagccaaagcgagccaggagggccccctccctgagattgaagacgaggttttcagaaagcgcaacctgacaatcatggatcttcaccccgggtccggaaagacccggagatatctgcccgctattgtgcgcgaagccatcaaacggaagctgagaaccctcattctggcccctacacgcgtcgtggctagcgagatggccgaagctcttaaaggcatgccgatccggtaccagacgaccgccgttaagtctgagcatacagggaaagagatcgtggacctgatgtgccacgcgacctttacaatgagactcctgtcccccgtccgcgtgcctaattataacatgattatcatggatgaagcccatttcaccgaccccagctctattgctgcccggggctacatcagcacgagagtgggaatgggcgaggctgccgccatttttatgacagctacccctcccgggtccgtcgaagcgttccctcaatctaatgccgttatccaggatgaggaacgggacatcccggagcgcagctggaactccggatatgagtggattaccgattttcccggcaagacagtgtggttcgtgccttctatcaagagcgggaatgacattgctaactgtctgcgcaagaatggaaagcgggtcatccagctctcccgcaaaaccttcgatacagaataccagaagaccaaaaacaacgactgggactacgtggttacgacagatattagcgagatgggcgccaattttagagccgaccgggtgatcgatcccagacgctgccttaagcctgtcattctgaaggacgggcccgaacgggtgatcctggctggcccgatgcctgttaccgtggcctctgcggctcaaagacgcggacggatcggcagaaaccacaataaagagggggatcagtatatttacatgggacagcccctcaacaatgacgaggatcatgcccactggacagaagccaagatgctgcttgacaacatcaatacccccgagggcattatccctgctctgttcgaacccgagcgcgaaaaatccgccgcgattgatggggagtatcggctcagaggagaggcccgcaagacgtttgtcgaactgatgagacggggcgacctgcctgtgtggctcagctacaaagtcgcttccgaggggttccagtattctgatcgcagatggtgctttgacggcgaacggaacaatcaagtgcttgaggaaaacatggatgttgagatctggaccaaggagggagaacgcaaaaagctgagaccgcggtggctggacgccagaacatacagcgaccccctcgctctgcgcgagttcaaggaatttgccgctggccggagatccgtgtctggggatcttatcctggagattggaaaactccctcagcacctgacccagcgcgcccagaatgcgctggacaacctcgtgatgcttcataatagcgaacaaggcgggcgggcctatagacacgctatggaggagctgcccgatacaatcgaaaccctgatgctcctggcccttattgctgtcctgacaggaggcgttaccctcttctttctgtccggccgggggctgggaaagacgagcatcggcctcctttgtgtgatggcctcttccgtgctgctgtggatggccagcgtcgagcctcattggattgctgcgtctatcatcctcgagttctttctgatggtgcttctgattcccgagccggaccgccagagaacacctcaggataaccagctcgcctacgttgtgatcgggctgctgttcatgattctcaccgtcgctgccaatgagatgggacttctggaaaccaccaagaaggacctgggcatcgggcacgtggccgtcgagaaccaccatcacgctgccatgctcgatgtggacctgcatcccgcgtccgcctggaccctttacgctgttgccacaacgattatcacccctatgatgcggcacacaattgaaaacaccacagctaatatcagcctgaccgccatcgcgaaccaagccgctattctcatgggactggataaaggctggcccatctctaagatggacattggcgtgcctctgctcgcccttgggtgctatagccaggtcaatcccctgacgctgaccgctgccgtgctcatgctggttgctcattacgccatcattggaccgggccttcaggcgaaggccacacgcgaggctcagaagagaaccgccgctgggatcatgaagaaccctacagtggatggaatcgtcgccattgacctggatcccgtggtgtatgacgccaaatttgaaaagcagctcggccagatcatgctgctgattctctgtacctcccagatccttctgatgcggacgacatgggcgctgtgcgagtctattaccctcgctacagggcccctgaccaccctttgggagggaagccctggcaaattctggaatacaacgatcgccgtttccatggctaacatcttccgcggcagctacctggccggggccggactcgctttttccctgatgaagtctctgggcgggggaagacggggcaccggggcccaaggagaaacactcggcgagaagtggaaacgccagcttaatcagctgagcaagtccgagttcaacacctataaaagatctggcattatggaggtcgaccggagcgaagcgaaggaggggctgaaaagaggagagacaaccaagcacgccgtgtcccgcggcacggctaagctccggtggtttgtggaaagaaatctggtcaaaccggaggggaaggttatcgatcttggatgtggccgcgggggatggtcttactattgcgccggcctgaaaaaggtgacagaagtgaaaggctacaccaaagggggacccggccacgaggaacctattcccatggctacctacgggtggaacctcgtcaaactgcatagcggaaaggacgtgttctttatccctcccgagaagtgtgatacactgctctgcgacattggcgagtccagccctaatccgaccatcgaagaggggcggacacttagagttctgaaaatggtggaaccctggctgcgcggaaaccagttctgtattaagatcctcaatccttatatgccctctgtcgtggagacgctggagcaaatgcagcggaaacacggcggcatgcttgttagaaaccctctgtcccgcaatagcacccatgaaatgtactgggtgtcttgcgggacaggaaacatcgtctccgccgtgaatatgaccagccggatgctcctgaacagatttacaatggcgcaccgcaagcccacctatgagcgggatgtggacctgggcgccgggacgagacacgtcgctgttgaaccggaggtggccaacctcgatattatcggacagcgcattgaaaatatcaaacatgagcacaagtctacctggcattacgacgaggataacccttataagacatgggcttaccacggctcctatgaagtgaaacccagcgggtccgccagctctatggtcaatggagtggttaagctgcttaccaaaccctgggacgtgattcctatggtcacacagatcgctatgaccgatacaacccccttcggccaacagagagtgtttaaggagaaagttgacacgcggacacctaaggccaagcgcggcaccgcgcagatcatggaagtgaccgccaaatggctgtgggggttcctcagcagaaacaagaaaccgcggatttgtacaagagaggaatttacgcggaaggtccgctccaatgctgccatcggagctgtgttcgttgacgagaaccaatggaactctgccaaagaggccgtggaagatgagagattttgggacctggtccatcgggaacgcgagcttcacaagcagggcaagtgcgcgacctgcgtgtacaacatgatggggaaaagagaaaagaaactgggagagttcggcaaggctaaagggagccgggccatttggtacatgtggctcggcgcccgcttcctggagtttgaagctctgggattcatgaatgaggatcactggttttccagagaaaactctctcagcggcgtcgagggggagggactgcataaacttggctatatcctgcgggacatttccaaaatccccgggggaaatatgtacgccgatgacacagctggctgggatacccgcatcacagaagacgatctccagaacgaggccaagattaccgacatcatggaacctgagcacgcgctgcttgccaagtctattttcaaactgacatatcagaataaggtggttagagtgcaacggcccgctaaaaacgggaccgtcatggatgtgatcagccgcagagaccagcggggctccggacaggtgggcacgtacgggctcaatacctttacaaacatggaagcccagctgattcgccaaatggagagcgagggaatcttctctccttccgaactggagacccccaacctcgctggcagagttctggattggcttgaaaagcatggggtggagcggctgaaaagaatggccatcagcggagacgactgtgtcgtgaagccgattgatgaccgctttgcgacagccctcaccgctctgaatgatatgggcaaggttcggaaagacatccctcagtgggaaccctctaaggggtggaacgattggcaacaggtgcctttctgctcccaccactttcatcaacttattatgaaagacggcagagagatcgtcgtgccctgtcgcaatcaggatgagctggtcggacgggccagagtgagccagggcgctgggtggtccctccgcgaaacggcctgcctgggaaagtcttatgctcagatgtggcaactgatgtacttccaccggagagacctccgcctggccgcgaacgccatttgtagcgctgttcctgtggattgggtccccacatcccggaccacatggagcatccatgcccaccatcagtggatgaccacggaggacatgctttctgtgtggaatagagtttggattgaagagaacccgtggatggaagataaaacccacatctccagctggggcgacgtgccttatctggggaagcgcgaggaccagtggtgcggatctctcatcggcctgacagcccgggctacctgggccacaaatattcaagtcgcgatcaaccaggtgagacggcttattgggaatgagaactacctggattacatgaccagcatgaagagatttaaaaatgaatccgaccccgagggcgctctctggtga

SEQ ID NO: 19186 - RNA, 9879 nt, synthetic construct
  misc_feature 1..9879: note = derived and/or modified CDS sequence (opt5) from DENV-1__GU131743__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggagttaacatgtgcacccttattgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacgtcgctgtggagaaccaccatcacgccgcgatgctggatgtcgaccttcatcctgccagcgcttggacactgtacgccgtggctacgaccattatcacacccatgatgcggcacaccattgaaaacacaaccgccaatatctctctcacggcgatcgccaaccaggctgccattctgatgggactggataaaggctggcctatctccaagatggacattggcgttcccctccttgctctggggtgctatagccaggtgaatccgctgaccctcacagccgctgtcctgatgcttgtggcccattacgcgatcattggacctggcctgcaagccaaagctacccgcgaggcccagaagagaacagctgccgggatcatgaaaaaccccaccgttgatggaatcgtggccattgacctcgatcccgtcgtgtatgacgcgaagttcgaaaagcagctgggccagatcatgctgctcattctttgtacgtctcaaatcctgctgatgcggacaacctgggctctctgcgagagcattacactggccaccgggcctcttaccacactgtgggagggatccccgggcaaattttggaatacgaccatcgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcattatggaggttgaccggtccgaagccaaggaggggctcaaaagaggagagaccacgaagcacgctgtctctcgcggcacagccaaactgcggtggttcgtggaaagaaatcttgtgaagcccgaggggaaagtcatcgatctgggatgtggccgcgggggatggagctactattgcgctggcctcaagaaggttaccgaagtgaaaggctacaccaaagggggacctggccacgaggaacccattcctatggccacatacgggtggaacctggtgaaactgcattccggaaaggacgtctttttcattccccctgagaaatgtgataccctcctttgcgacattggcgagtctagcccgaatcccacaatcgaagaggggcggacgctgagagtgctgaagatggttgaaccttggctccgcggaaaccaattttgtattaaaatcctgaatccctatatgccttccgtggtcgagacccttgagcagatgcagcggaagcacggcggcatgctggtgagaaaccccctcagccgcaattctacacatgaaatgtactgggtttcctgcgggaccggaaacatcgtgagcgcggtcaatatgacatctcggatgctgctgaacagattcaccatggcccaccgcaagccgacgtatgagagagatgtggacctcggcgctgggacccggcacgtggccgtcgaacctgaggttgctaacctggatgtgattggacagcgcatcgaaaatattaaacatgagcacaagtccacatggcattacgacgaggataacccctataaaacctgggcctaccacggcagctatgaagtgaagccctctgggtccgctagctccatggtcaatggagtggttaaacttctgacaaagccttgggacgtgatccccatggtcacccaaattgccatgacagataccacgccttttggccagcagagagtgttcaaggagaaagttgacacacggaccccgaaggcgaaaagaggcaccgcccaaatcatggaagtgacagctaagtggctctgggggtttctgagccggaacaaaaagccccgcatctgtacgagagaggagttcacccggaaggtccgctctaatgccgctattggagccgtgtttgttgacgagaaccagtggaatagcgccaaagaggcggtggaagatgagagattctgggaccttgtccatcgggaacgcgagctgcacaagcagggcaaatgcgctacatgcgtgtacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtcgagggggagggacttcataagctgggctatattctccgggacatctctaaaattcctgggggaaatatgtacgctgatgacaccgccggctgggatacacgcatcaccgaagacgatctgcagaacgaggcgagaatcacagacattatggaacccgagcacgcccttctggctaagagcatctttaaactcacctatcaaaataaggtggttcgggtgcagcgccctgccaaaaacgggacggtcatggatgtgatttccagacgggaccagagaggctctggacaggtgggcacctacgggctgaatacattcaccaacatggaagctcaactgatccgccagatggagagcgagggaatcttttcccccagcgaactcgagacaccgaacctggccgaacgggttcttgattggctgggcaagtatggggtggagagactcaagcgcatggcgatctctggagacgactgtgtcgtgaaacctatcgatgaccggttcgccaccgctctgacggcccttaatgatatgggcaaggttagaaaagacattccccagtgggaaccttccaaggggtggaacgattggcagcaagtgcccttttgcagccatcacttccaccagctgatcatgaaagacggccgcgagattgtcgtgccttgtcggaatcaggatgagctcgtcggcagagctcgcgtgtctcagggcgccgggtggtccctgcgggaaacagcttgcctgggaaagagctacgcccaaatgtggcagctcatgtattttcatagacgcgacctgcggcttgcggccaacgctatctgttccgccgttcccgtggattggattccgacctctagaacaacctggagcatccacgcccatcaccagtggatgacgaccgaggacatgctgtccgtctggaatcgggtgtggattgaagagaacccttggatggaagataagacacatatcagctcttggggcgacgttccctacctcgggaaaagagaggaccaatggtgcggatccctgatcggccttaccgctcgcgccacatgggcgaccaatattcaggtggctatcaaccaggtccggagactgattgggaatgagaactacctcgattatatgacaagcatgaagcgcttcaaaaatgaatctgaccccgagggcgccctgtggtga

SEQ ID NO: 19187 - RNA, 9879 nt, synthetic construct
  misc_feature 1..9879: note = derived and/or modified CDS sequence (opt5) from DENV-1__JN093516__SS-prME
  source 1..9879: mol_type = other RNA
agcgtgaccatgctgctgatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagaaggttgaaacatgggctctccggcaccccggctttaccgtgatcgccctgttccttgcgcatgccattgggacatctatcacccagaagggaatcatttttatcctgctcatgctggtcacccctagcatggctatgcgctgcgtgggcattgggtccagagatttcgttgagggacttagcggcgccacatgggtggacgtcgtgctggagcacgggtcttgtgtgacgaccatggctaaagataagcccacactcgacatcgaactgctgaaaaccgaggtcacaaaccctgccgttctccggaagctgtgcattgaagcgaaaatctccaataccacgacagatagccgctgtccgacccaaggagaggccacccttgtggaagaacaggacgctaactttgtgtgcagacggacattcgtcgatcgcggctggggcaatgggtgtggactgtttggcaaggggtctctcattacctgcgccaagttcaaatgcgtgacaaagctggagggaaaaacggttcagcacgaaaaccttaagtactccgtgatcgtcaccgtgcatacaggcgaccagcaccaagttgggaatgagagcaccgaacatggaacaaccgctacgatcacaccccaggccccttctacagagattcagctgaccgactatggcgccctcacactggattgttcccccagaaccggcctggactttaacgaaatggtgctcctgacgatgaaagaaaagagctggcttgtccacaaacagtggttcctggatctccctctgccctggacatccggggcttctaccagccaagagacatggaatcggaaggaccttctggtgacctttaagaccgcgcacgccaaaaagcaggaagtcgtggttctcggatcccaggagggcgctatgcatacagccctgacgggggccaccgaaatccaaacaagcggaaccacaaccattttcgctggccacctgaaatgccgcctcaagatggataaactgacgcttaaggggatgtcttacgtgatgtgtacaggctccttcaagctggagaaagaagtcgccgagacccagcatggaaccgtgctcgttcagatcaagtatgagggcacagacgcgccgtgcaaaattccttttagcacccaggatgaaaagggggtgacacaaaacggaagactgatcacggctaatcccatcgtcaccgacaaagagaagcctgtgaacattgaagccgagccgcccttcggcgagtcttacatcgtgattggggccggagaaaaggctctgaaacttagctggtttaagaaaggctcctctatcgggaagatgttcgaggccacaacccggggcgctagacgcatggccattctcggagatacagcgtgggactttggcagcatcgggggagttttcacctccgtcggcaaactggtgcaccagatctttgggacggcctatggagtgctgttcagcggcgtctcttggaccatgaagattgggatcggcgtgctcctgacatggcttggactcaattcccggagcacctctctctccatgacatgtattgctgttggcctggtgaccctgtaccttggggtcatggtgcaggccgatagcggatgcgttatcaactggaagggcagagaactcaaatgtgggtccggaatttttgtgacaaatgaggtccatacctggacggaacagtacaagttccaagctgactctcctaaacgcctgagcgccgcgatcggcaaggcctgggaggagggggtgtgcggcattcggtccgctacaagactggaaaacatcatgtggaaacagatctctaacgagctcaatcacattctgcttgaaaacgacatgaagtttaccgttgtggtcggagatgtggccggcatcctggctcaggggaaaaagatgattcgcccgcagcccatggagtataagtacagctggaaatcctggggaaaggccaaaatcattggcgccgacgtgcaaaataccacattcatcatcgatgggcctaacacccccgaatgtcctgacgatcagcgggcttggaatatttgggaggtcgaggactatggatttggcatcttcacgacaaacatttggctcaagctgagagatagctacacccaggtttgcgaccaccgcctgatgtctgcggccatcaaagattccaaggctgtgcatgccgacatgggctattggattgaaagcgagaagaatgaaacatggaaacttgcccgggcttctttcatcgaggtgaagacctgtatctggcccaaatcccacacactctggagcaacggggtcctggaatctgagatgattatcccgaagatttacggaggccctatcagccagcataattatagacccgggtactttacccaaacggccggaccttggcacctgggcaaactcgagctggatttcgacctttgcgaagggaccacagtggttgtggatgagcactgcggaaaccgcggcccctccctgcggaccacaaccgtcacgggcaagattatccatgaatggtgttgcagaagctgtacactccctcccctgcggtttaagggggaggacggatgctggtacggcatggagatccgcccggtgaaagaaaaggaggaaaatctggttaaatctatggtgtccgcggggagcggagaggtcgactccttctctcttggcctcctgtgtattagcatcatgattgaagaggtgatgagatcccggtggtctagaaagatgctgatgaccgggacactcgctgtctttttcctgcttatcatgggacagctgacctggaacgatctcattcgcctgtgcatcatggtgggcgccaatgccagcgaccggatgggcatggggaccacatatctggctcttatggccacgtttaaaatgagacctatgttcgcggtcggactgctctttcgcagactgacctcccgggaggtgctcctgcttacaattggcctgtctctcgtggctagcgtcgaactgcccaactccctggaggaacttggggatggactggccatgggcatcatgatcctcaagctgctcaccgacttccagagccaccaactgtgggccacacttctgtctctcacctttattaagacgacattctccctgcattacgcttggaaaaccatggccatggttctgagcatcgtgtctctttttcccctgtgtctctccaccacaagccagaagaccacatggctgcctgtgctcctggggtctcttggatgcaaaccgctgacgatgttcctgattgctgagaataagatctggggccgcaaatcctggcccctcaacgaaggcattatggccgtcgggatcgtgagcatcctgctttccagcctgctcaagaacgatgttcctctggcgggacccctcattgccggcgggatgctgatcgcttgttatgtgatttctggaagctccgccgacctttctctggagaaagctgccgaggtcagctgggaagaggaagccgagcactccggcgcttctcataatatcctggtggaagttcaggatgacgggaccatgaagattaaggatgaggagagagacgatacactcaccatcctgcttaaagcgacactgctcgccgtgagcggagtctaccctctgtccatccccgctaccctcttcgtgtggtatttttggcagaagaaaaagcaacggtctggcgtcctgtgggacacgcctagccctcccgaagtggagcgcgccgttcttgatgacggcatttacagaatcatgcagcgggggctgctgggacgctcccaggtgggcgtcggggtgttccaggaaaacgtttttcacaccatgtggcacgtgacaagaggagccgtcctcatgtatcaaggcaaacggctggagcccagctgggcttctgtgaagaaggaccttatttcctacgggggaggctggcgcctgcagggcagctggaataccggggaggaagtgcaggttatcgccgtcgagcccggcaaaaatcctaagaatgtgcagacagcgcccggcaccttcaaaacatctgaaggggaggtgggagctattgccctcgattttaagccgggcacgtccgggagccctatcgtcaacagagaaggaaaaattgtgggcctgtacggcaatggggttgtgaccacatccggaacctatgtctctgccatcgctcaagccaaggcgagccaggagggccccctccctgagatcgaagacgaggtgttccggaagagaaacctgaccattatggatcttcatcccgggtccggaaaaacacgccggtacctgcccgctatcgttagagaagccattaagcgcaaactgcggacgctcatcctggcccctaccagagtggtcgctagcgagatggccgaagctcttaagggcatgccgattcgctatcagacaaccgccgtgaaatctgagcacacagggaaggagatcgttgacctgatgtgccatgcgacctttacgatgcggctcctgtcccccgtgagagtccctaattacaacatgatcattatggatgaagcccacttcacagaccccagctctatcgctgcccgcggctatattagcacccgggtgggaatgggcgaggctgccgccatctttatgaccgctacacctcccgggtccgtggaagcgttccctcaatctaatgccgtcattcaggatgaggaaagagacatcccggagcggagctggaactccggatacgagtggatcaccgattttcccggcaagacagtttggttcgtgccttctattaaaagcgggaatgacatcgctaactgtctgcgcaagaatggaaaaagagtgattcagctctcccggaagaccttcgatacggaatatcagaaaacaaagaacaacgactgggactacgtcgtgaccacagatatcagcgagatgggcgccaattttcgcgccgacagagttattgatccccggagatgccttaagcctgtgatcctgaaagacgggcccgaacgcgtcattctggctggcccgatgcctgtgaccgttgcctctgcggctcaacggagaggacgcatcggccggaaccataataaggagggggatcagtacatctatatgggacagcccctcaacaatgacgaggatcacgcccactggacggaagccaaaatgctgcttgacaacattaatacccccgagggcatcattcctgctctgttcgaacccgagagagaaaagtccgccgcgatcgatggggagtaccgcctccggggagaggccagaaaaacatttgtggaactgatgcgcagaggcgacctgcctgtctggctcagctataaggtggcttccgaggggttccagtactctgatcggcgctggtgctttgacggcgaaagaaacaatcaagtccttgaggaaaacatggatgtggagatttggaccaaagagggagaacggaagaagctgcgcccgagatggctggacgcccggacatatagcgaccccctcgctctgagagagttcaaagaatttgccgctggccgccggtccgtttctggggatcttatcctggagatcggaaagctccctcagcatctgacccagagagcccagaatgcgctggacaacctcgtgatgcttcacaatagcgaacaaggcgggcgcgcctaccggcatgctatggaggagctgcccgatacaattgaaaccctgatgctcctggcccttatcgctgtgctgacgggaggcgtcacactcttctttctgtccggcagagggctgggaaaaaccagcattggcctcctttgtgttatggcctcttccgccctgctgtggatggctagcgtggagcctcactggatcgcggcctctattatcctcgagttctttctgatggtgcttctgatccccgagccggaccggcagcgcacccctcaggataaccagctcgcttatgtcgtgattgggctgctgttcatgatcctcacagttgccgccaatgagatgggacttctggaaaccacaaagaaagacctgggcattgggcacgtggctgtcgagaaccatcaccatgccacgatgctcgatgtggacctgcaccccgcgtccgcctggaccctttacgctgtcgccacaaccatcattacacctatgatgagacataccatcgaaaacacgaccgctaatattagcctgacagccatcgcgaaccaagccgctatcctcatgggactggataagggctggcccatttctaagatggacatcggcgtgcctctgctcgcccttgggtgctacagccaggttaatcccctgaccctgacagctgccgtgctcatgctggtcgctcactatgccattatcggaccgggccttcaggcgaaagccacccgggaggctcaaaagcgcacggccgctgggattatgaaaaaccctacagtggatggaatcgttgccatcgacctggatcccgtggtctacgacgccaagtttgaaaaacagctcggccagattatgctgctgatcctctgtacctcccagattcttctgatgagaacaacctgggcgctgtgcgagtctatcaccctcgctacagggcccctgacgaccctttgggagggaagccctggcaagttctggaatacaaccattgccgtgtccatggctaacatcttccggggcagctatctggccggggccggactcgctttttccctgatgaagtctctgggcgggggacgcagaggcacaggggcccaaggagaaaccctcggcgagaaatggaagcggcagcttaatcagctgagcaaatccgagttcaacacgtacaagcgctctggcatcatggaggtggacagaagcgaagcgaaagaggggctgaagcggggagagacaaccaagcacgccgtttccagaggcaccgctaaactccgctggtttgtcgaacggaatctggtgaagccggaggggaaagtgattgatcttggatgtggcagagggggatggtcttattactgcgccggcctgaagaaagtcacagaagttaagggctataccaaagggggacccggccatgaggaacctatccccatggctacatacgggtggaacctcgtgaagctgcacagcggaaaggacgtgttctttattcctcccgagaaatgtgatacgctgctctgcgacatcggcgagtccagccctaatccgaccattgaagaggggcgcacacttcgggtcctgaagatggtggaaccctggctgagaggaaaccagttctgtatcaaaattctcaatccttacatgccctctgttgtggagaccctggagcaaatgcagcgcaagcatggcggcatgcttgtccggaaccctctgtccagaaatagcacacacgaaatgtattgggtgtcttgcgggaccggaaacatcgtttccgccgtgaatatgacgagccgcatgctcctgaaccggtttaccatggcgcacagaaaacccacatacgagcgcgatgtcgacctgggcgccgggacccggcatgtggctgtggaaccggaggtcgccaacctcgatatcattggacagagaatcgaaaatattaagcacgagcataagtctacatggcactatgacgaggataacccttacaaaacctgggcttatcatggctcctacgaagttaagcccagcgggtccgccagctctatggtgaatggagtggtcaaactgcttacaaagccctgggacgtgatccctatggttacccagattgctatgacggatacaacccccttcggccaacagcgcgtgtttaaagagaaggtcgacaccagaacacctaaggccaaacggggcacggcgcagatcatggaagtgaccgccaagtggctgtgggggttcctcagccgcaacaaaaagccgagaatctgtacacgggaggaatttaccagaaaagttcggtccaatgctgccattggagctgtgttcgtcgacgagaaccaatggaactctgccaaggaggccgtggaagatgagcgcttttgggacctggttcacagagaacgggagcttcacaagcagggcaaatgcgcgacatgcgtgtataacatgatggggaagcgcgagaaaaagctgggagagttcggcaaagctaaggggagcagagccatctggtacatgtggctcggcgcccggttcctggagtttgaagctctgggattcatgaatgaggatcattggttttcccgcgaaaactctctcagcggcgtcgagggggagggactgcacaaacttggctacattctgagagacatctccaagattcccgggggaaatatgtatgccgatgacaccgctggctgggatacacggatcaccgaagacgatctccagaacgaggccaagatcacggacattatggaacctgagcatgcgctgcttgccaaatctatcttcaagctgacctaccagaataaagtggtccgcgtgcaaagacccgctaagaacgggacagttatggatgtgattagccggcgcgaccagagaggctccggacaggtcggcacctatgggctcaatacatttaccaacatggaagcccagctgatccggcaaatggagagcgagggaattttctctccttccgaactggagacgcccaacctcgctggccgcgtgctggattggcttgaaaaacacggggtggagagactgaagcggatggccatcagcggagacgactgtgttgtgaagccgatcgatgacagatttgcgacagccctcaccgctctgaatgatatgggcaaagtccgcaaggacattcctcagtgggaaccctctaaagggtggaacgattggcaacaggtgcctttctgctcccaccattttcaccaacttatcatgaaggacggccgggagattgttgtgccctgtagaaatcaggatgagctggtcggacgcgcccgggtgagccagggcgctgggtggtccctcagagaaacagcctgcctgggaaaatcttacgctcagatgtggcaactgatgtatttccatcgccgggacctcagactggccgcgaacgccatctgtagcgctgtccctgtggagtgggttcccacctcccgcacgacctggagcattcacgcccatcaccagtggatgacaaccgaagatatgctttctgtgtggaatcgggtctggatcgaggaaaacccgtggatggaggacaagacacacatttccagctggggcgatgtgccttacctggggaagagagaggaccagtggtgcggatctctcatcggcctgaccgcccgcgctacatgggccaccaatatccaagttgcgattaaccaggtgcggagacttatcgggaatgaaaactatctggactacatgacgagcatgaaacggtttaagaatgagtccgatcccgaaggcgctctctggtga

SEQ ID NO: 19188 - RNA, 9879 nt, synthetic construct
  misc_feature 1..9879: note = derived and/or modified CDS sequence (opt5) from DENV-1__GU131746__SS-prME
  source 1..9879: mol_type = other RNA
agcgtgaccatgctgctcatgctgatgcccacagcccttgctttccacctgacgacccggggcggggaacctcatatgatcgtgtccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcaccggcgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctggggagcctgggatgcaagccgctcacgatgtttctgattgctgagaataaaatctggggccggcgctcttggccccttaacgaaggcatcatggccgtggggattgtgtccatcctgctcagctccctgctcaagaacgatgtccctctggcgggaccccttattgccggcgggatgctgatcgcttgttacgtgattagcggatctagcgccgacctgtccctcgagaaagctgccgaggtttcttgggaagaggaagccgagcatagcggcgcttcccacaatatcctggtggaagtccaggatgacgggaccatgaagatcaaagatgaggagagagacgatacacttaccattctgctcaaggcgacactgctcgccgtgtctggagtttatcctctgagcatccccgctacccttttcgtgtggtacttctggcagaagaagaagcagcggtccggcgtcctgtgggacacgccttctcccccggaagtggagcgcgccgtcctggatgacggcatttatagaatcatgcagcgggggctcctgggacgcagccaggtgggcgttggggtgtttcaagaaaacgtcttccataccatgtggcacgtgacaagaggagccgttcttatgtaccagggcaaacggctggagccttcctgggctagcgtgaagaaagacctcatttcttacgggggaggctggagactgcagggctcctggaataccggggaggaagtccaggtgatcgccgtggagcccggaaagaaccctaaaaatgttcaaacagcgcccggcacctttaagacaccggaaggggaggtcggagctattgccctcgatttcaagcctggcacgagcgggtctcccatcgtgaaccgcgaaggaaaaatcgtgggcctgtatggcaatggggtcgtgaccacatccggaacctacgttagcgccattgctcaggccaaggcgtcccaggagggccctcttcccgagatcgaagacgaggtgtttcggaaaagaaacctgaccattatggatctgcaccccgggtctggaaagacacgccggtatctccctgctatcgtcagagaagccattaaacgcaagctgcggacgcttatcctggccccgaccagagtggttgctagcgagatggccgaagctctcaagggcatgcccatccgctaccaaacaaccgccgtgaaatccgagcatacagggaaggagattgtcgacctgatgtgccacgcgaccttcacgatgcggctgctcagccctgtgagagttcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgtgatccaggatgaggaaagagacattcccgagcggtcctggaactctggatatgagtggatcaccgatttccctggcaaaacagtgtggtttgtccccagcattaagtccgggaatgacatcgctaactgtcttcgcaaaaatggaaagagagttattcagctgtctcggaagaccttcgatacggaataccagaagaccaagaacaacgactgggactacgtggtgaccacagatatcagcgagatgggcgccaatttcagagccgaccgcgtcattgatcctcggagatgcctgaaacccgtgatcctcaaggacgggccggaacgcgttatcctggctggccctatgcccgtgaccgtcgcctccgcggctcagcggagaggacgcattggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgcccggacatactccgaccctcttgctctgagagagtttaaggagttcgccgctggccgccggtctgtcagcggggatctcattctggagatcggaaaactgccccagcacctcacccagaaggcccaaaatgcgcttgacaacctggtgatgctgcataattccgaacagggcgggagagcctatcggcacgctatggaggagctccctgatacaattgaaaccctgatgcttctggccctcatcgctgttctgacgggaggcgtgacactgtttttcctctctggccgcgggcttggaaagaccagcattggcctgctgtgtgtgatggcctccagcgtcctcctgtggatggcctctgttgagccccattggatcgctgcgtccatcattcttgaatttttcctgatggtgctcctgatcccggagcctgacagacagcggacaccccaggataaccaactggcctacgtggtcattgggctcctttttatgatcctgacagtggctgccaatgagatgggactgctcgaaaccaccaagaaggacctgggcattgggcacgttgccgtggagaaccaccatcacgctgccatgcttgatgtcgacctgcatcctgcgagcgcctggacgctctacgctgtggccaccacaatcattacccccatgatgcgccacacaatcgaaaacaccacggctaatatctctctgaccgccattgcgaaccaggccgctatcctgatgggactcgataaaggctggcctatttccaagatggacatcggcgtcccccttctggccctggggtgctatagccaggtgaatccgctcacactgaccgctgccgttcttatgctggtggctcattacgccattatcggacctggcctccaagcgaaagccacaagagaggctcagaagcggaccgccgctgggatcatgaagaaccccacggtcgatggaattgtggccatcgacctggatcccgttgtgtatgacgccaaattcgaaaagcagctgggccagattatgctccttatcctgtgtacatctcaaattctgctcatgcgcaccacatgggcgctgtgcgagagcatcacccttgctaccgggcctctgacaacgctctgggagggatccccgggcaaattttggaataccacaatcgccgtctctatggctaacattttcagaggcagctacctggccggggccggactggctttctccctcatgaaaagccttggcgggggacggcgcggcaccggggcccagggagaaacactgggcgagaaatggaagagacagctgaatcagctctccaagtctgaatttaacacctataaacggagcggcatcatggaggtggacagatccgaagcgaaggaggggctgaaacgcggagagacgacaaagcacgccgtgtctcggggcaccgctaaacttagatggttcgttgaacgcaatctggtcaagcccgaggggaaggtgattgatctcggatgtggcagagggggatggagctactattgcgccggcctgaaaaaggtgaccgaagtcaaaggctacacaaaagggggacctggccacgaggaacccatccctatggctacctacgggtggaacctggttaaactccattccggaaaggacgtgtttttcattccccctgagaaatgtgatacacttctgtgcgacatcggcgagtctagcccgaatcccacgattgaagaggggagaaccctgcgcgtgctcaagatggtcgaaccttggctgcggggaaaccaattttgtatcaagatccttaatccctatatgccttccgtggttgagacactggagcagatgcagagaaaacacggcggcatgctcgtgcgcaaccccctgagcagaaattctacccatgaaatgtactgggtctcctgcgggacaggaaacattgtgagcgccgttaatatgacctctagaatgctgctcaaccgcttcacgatggcgcaccggaagccgacctatgagagagatgtggacctgggcgccgggacacgccacgtcgctgtggaacctgaggtggccaaccttgatatcattggacagagaatcgaaaatattaaacatgagcacaagtccacctggcattacgacgaggataacccctataaaacatgggcttaccacggcagctatgaagtcaagccctctgggtccgccagctccatggttaatggagtggtgaagctgctcaccaaaccttgggacgtcatccccatggtgacacaaatcgctatgaccgatacgacaccttttggccagcagcgggttttcaaggagaaagtggacacccgcaccccgaaggccaaaagaggcacagcgcaaattatggaagtcacggccaagtggctgtgggggtttcttagccggaacaagaaacccagaatctgtacccgggaggagttcacacgcaaggtgagatctaatgctgccattggagctgtttttgtggacgagaaccagtggaatagcgccaaagaggccgtcgaagatgagcggttctgggacctggtgcatcgcgaaagagagctccacaagcagggcaaatgcgcgacctgcgtttacaacatgatggggaagcgggaaaagaaactgggagagtttggcaaggctaaagggtcccgcgccatctggtacatgtggctgggcgccagattcctcgagttcgaagctctgggatttatgaatgaggatcactggttctctcgggaaaacagcctttccggcgtggagggggagggactgcataagctcggctatattctgcgcgacatctctaaaatccctgggggaaatatgtacgccgatgacacagctggctgggataccagaattacagaagacgatcttcagaacgaggcccggatcaccgacattatggaacccgagcacgcgctgctcgccaagagcatctttaaactgacgtatcaaaataaggtcgtgcgcgtccagagacctgctaagaacgggaccgtgatggatgttatttcccggcgcgaccagagaggctctggacaggtgggcacatacgggctgaataccttcacaaacatggaagcccaactcatccggcagatggagagcgagggaatcttttcccccagcgaactggagaccccgaaccttgctgaaagagtcctggattggctcgagaaatatggcgtggaacgcctgaagcggatggccatttctggggacgactgtgtggttaaacctatcgatgacagattcgcgacggcccttacagctctgaatgatatgggaaaggtgcgcaaagacattccccagtgggagccttccaagggctggaacgattggcagcaagtccccttttgcagccatcacttccaccagctcatcatgaaggacgggcgggagattgtggttccttgtagaaatcaggatgaactggtgggccgcgcccgggtctctcagggagctggctggtccctgagagagaccgcctgcctcgggaaaagctacgctcaaatgtggcagctgatgtattttcatcgccgggaccttagactggccgcgaacgccatctgttccgctgtgcccgtcgattggattccgacatctcgcaccacgtggagcatccacgcccatcaccagtggatgaccacagaagacatgctctccgtgtggaatcgggtttggatcgaggaaaacccttggatggaggataagacccatattagctcttggggagacgtgccctacctgggcaaaagagaggaccaatggtgcgggtcccttatcggactgacagcccgggctacctgggccacaaatattcaggtcgcgatcaaccaggtgagacgcctcattggcaatgaaaactacctggattatatgaccagcatgaagcggttcaaaaatgagtctgaccccgaaggggctctgtggtga

SEQ ID NO: 19189 - RNA, 9879 nt, synthetic construct
  misc_feature 1..9879: note = derived and/or modified CDS sequence (opt5) from DENV-1__JF937609__SS-prME
  source 1..9879: mol_type = other RNA
agcgtgaccatgctgctcatgctgatgcccacagcccttgctttccacctgacgaccagaggaggggaacctcatatgatcgtgtccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacaacccccggcacattcaagacgccggaaggggaggtgggagcgattgctctcgattttaagcctggcaccagcgggtctcccatcgtgaaccgcgaaggaaaaatcgtcggcctgtatggcaatggggtggttacaacctccggaacctacgtgagcgccattgcccaggctaaggcctcccaggagggccctcttcccgagatcgaagacgaggtcttccggaaaagaaacctgacaattatggatctgcaccccgggtctggaaagacgcgccggtatctccctgcgatcgtgagagaagctattaaacgcaagctgcggacccttatcctggccccgacaagagttgtggccagcgagatggctgaagccctcaagggcatgcccatccgctaccaaaccacagctgtcaaatccgagcataccgggaaggagattgtggacctgatgtgccacgccacgtttacaatgcggctgctcagccctgttagagtgcccaattataacatgatcattatggatgaagcgcatttcaccgacccttcttccatcgccgctcggggctacattagcacccgcgtcggaatgggcgaggccgctgccatctttatgacagccacaccccctgggtctgtggaggctttcccgcagagcaatgcggtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacgtttgatacagaataccagaaaaccaagaacaacgactgggactacgtggtcacaaccgatatcagcgagatgggcgctaatttcagagccgaccgcgtgattgatcctcggagatgcctgaaacccgttatcctcaaggacgggccggaacgcgtgatcctggccggccctatgcccgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacctgagggcatcattcccgccctgttcgaacctgagagagaaaagagcgctgccatcgatggggagtatcgcctgagaggagaggcgcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagctcaaaatgcccttgacaacctggttatgctgcataattccgaacagggcgggcgggcgtatcgccacgccatggaggagctccctgataccattgaaacgctgatgcttctggctctcatcgccgtgctgacaggaggcgtgaccctgttctttctctctggcagagggcttggaaagaccagcattggcctgctgtgtgtcatggcttccagcgttctcctgtggatggcctctgtggagccccattggatcgccgcttccatcattcttgagttctttctgatggtgctcctgatcccggagcctgaccggcagcgcacaccccaggataaccaactggcgtacgtcgtgattgggctccttttcatgatcctgaccgttgccgctaatgagatgggactgctcgaaacaacgaagaaagacctgggcattgggcacgtggccgtcggaaaccaccatcacgccgctatgcttgatgtggacctgcatcctgccagcgcgtggaccctctacgccgtcgctacaaccatcattacacccatgatgagacacaccatcgagaacacgaccgccaatatctctctgacagctattgccaaccaggcggccatcctgatgggcctcgataagggctggcctatttccaaaatggacatcggggtgccccttctggctctgggatgctatagccaggttaatccgctcaccctgacagccgctgtgcttatgctggtcgcccattacgctattatcggccctgggctccaagccaaggcgacccgggaagcccagaaacgcacggctgccggaatcatgaagaaccccacagtggatggcattgttgctatcgacctggatcccgtggtctatgacgccaagtttgagaaacagctggggcagattatgctccttatcctgtgtacctctcaaattctgctcatgagaacaacctgggccctgtgcgaaagcatcacccttgcgacaggacctctgacgaccctctgggagggctccccgggcaagttctggaatacaaccatcgctgtgtctatggccaacatttttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggatcatggaagtggaccgctccgaggccaaagaaggactgaagcggggcgagacaaccaaacacgcggtttctagagggaccgccaaacttcgctggtttgtcgagcggaatctggtgaaacccgaaggaaaggtgattgatctcggctgtgggagaggaggctggagctactattgcgctggcctgaagaaagtcacagaggttaaggggtacaccaaaggaggccctgggcacgaagaacccatccctatggccacatacggatggaacctggtgaagctccattccggcaaagacgtgttctttattccccctgaaaagtgtgatacgcttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgctgtgaatatgacgtctcgcatgctgctcaaccggtttaccatggcccacagaaaaccgacatatgaacgcgatgtcgacctgggggcgggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacggatacaacccctttcggccagcagcgcgtgtttaaagaaaaggtcgacaccagaacaccgaaagctaagcgggggacggcccaaattatggaggtgaccgcgaaatggctgtggggattccttagcagaaacaagaagccccggatctgtacacgcgaagagtttaccagaaaagttcggtctaatgccgctattggcgccgtgttcgtcgacgaaaaccagtggaatagcgctaaggaggccgtggaggatgaacgcttttgggacctggttcatagagagcgggaactccacaaacaggggaagtgcgccacatgcgtgtacaacatgatgggaaaacgcgagaagaagctgggcgagttcgggaaagcgaagggctccagagctatctggtacatgtggctgggagcccggtttctcgagttcgaggccctgggcttcatgaatgaagatcactggttttctcgcgagaacagcctttccggggtcgaaggagagggcctgcataaactcgggtatattctgagagacatctctaagatccctggaggcaatatgtacgctgatgacaccgccgggtgggatacacggattaccgaggacgatcttcagaacgaagctcgcatcacggacattatggagcccgaacacgccctgctcgcgagaagcatcttcaaactgacctatcaaaataaggtggtccgggtgcagcgccctgccaaaaacggcacagttatggatgtgatttccagacgggaccagagaggatctggccaggtcgggacctacggactgaatacatttaccaacatggaggctcaactcatccgccagatggaaagcgagggcatcttctcccccagcgagctggaaacgccgaaccttgccgagcgggtgctggattggctcgaaaagtatggggtggagagactgaagcgcatggctatttctggagacgactgtgttgtgaaacctatcgatgaccggtttgccacagcgcttaccgccctgaatgatatgggcaaggtcagaaaagacattccccagtgggaaccttccaaggggtggaacgattggcagcaagtgcccttctgcagccatcactttcaccagctcatcatgaaagacggccgcgagattgttgtgccttgtcggaatcaggatgagctggtcggcagagctcgcgtgtctcagggcgccgggtggtccctgcgggaaacagcttgcctcggaaagagctacgcccaaatgtggcagctgatgtatttccatagacgcgaccttcggctggctgccaacgcgatctgttccgccgtccccgtggattggattccgacctctagaacgacctggagcatccacgctcatcaccagtggatgacaaccgaggacatgctctccgtttggaatcgggtgtggatcgaagagaacccttggatggaagataagacacatattagctcttggggcgacgtcccctacctggggaaaagagaggaccaatggtgcggatcccttatcggcctgaccgcccgcgccacatgggctaccaatattcaggtggccatcaaccaggttcggagactcattgggaatgagaactacctggattatatgacgagcatgaagcgctttaaaaatgaatctgaccccgagggcgcgctgtggtga

SEQ ID NO: 19190 - RNA, 9879 nt, synthetic construct
  misc_feature 1..9879: note = derived and/or modified CDS sequence (opt5) from DENV-1__KF921949__SS-prME
  source 1..9879: mol_type = other RNA
agcgtgaccatgctgctcatgctgatgcccaccgcccttgctttccacctgacgacccggggaggggaacctcatatgatcgtctccaagcaggaacggggaaaatctctcctgtttaagacaagcgccggcgttaacatgtgcacccttatcgcgatggacctgggggagctctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcagaaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtgaccggcattctcgcccaggggaagaaaatgatcagaccgcaacccatggagtacaagtattcttggaaaagctggggaaaggctaagattatcggcgccgacgtgcagaatacaacctttatcattgatgggcctaacacgcccgaatgtcctgacgatcagcgcgcctggaatatctgggaggtcgaggactacggattcggcatttttacaaccaacatctggctgaaactgcgggattcctatacacaggtttgcgaccacagacttatgagcgctgcgattaaggattctaaagccgtgcacgctgacatgggctactggatcgaatccgagaagaatgaaacctggaaactcgcccgcgccagcttcatcgaggtgaagacatgtatttggcccaagtctcataccctgtggtccaacggggtcctggaaagcgagatgatcattccgaaaatctatggaggccctatttctcaacacaattaccggcccgggtacttcacgcagaccgctggaccttggcatctcggcaagctggagcttgattttgacctgtgcgaagggacaaccgtggttgtggatgagcactgcggaaacagaggccccagcctccggacaaccacggtcacaggcaaaatcatccacgaatggtgttgccgctcctgtaccctgcctcccctgagattcagaggggaagacggatgctggtatggcatggagattagaccggtgaaggaaaaagaggaaaatcttgttaagagcatggtgtctgccgggtccggagaggtcgacagcttttccctcggcctgctgtgtatctctattatgatcgaagaggtgatgcgcagccggtggtccagaaagatgctcatgacagggaccctggcggttttccttctgctcattatgggacagctgacctggaacgatctgatccgcctttgcattatggtgggcgctaatgcctctgacagaatgggcatggggacaacgtacctggccctcatggctacctttaaaatgcggcctatgttcgccgtcggactgctctttcgcagactgacaagccgggaggtgcttctgctcaccatcggcctgtccctggtggcgtctgtcgaacttcccaacagcctggaggaactcggggatggactggctatgggcatcatgattctcaagctgcttacagacttccaatcccatcagctgtgggccaccctcctgagcctgacgtttatcaaaacaaccttctctcttcactatgcctggaagaccatggctatggttctgtccattgtgagcctctttcccctgtgtctctctacaacctcccagaaaacaacgtggctgcctgtgcttctggggagcctgggatgcaagccgctcaccatgttcctgatcgccgagaataagatttggggccgcagatcttggccccttaacgaaggcatcatggctgtcgggatcgtgtccattctgctcagctccctgctcaaaaacgatgttcctctggccggaccccttatcgcgggcgggatgctgattgcctgttacgtgatcagcggatctagcgctgacctgtccctcgagaaggccgctgaggtctcttgggaagaggaagccgagcatagcggcgcctcccacaatattctggtggaagttcaggatgacgggacaatgaaaatcaaggatgaggagcgggacgatacccttacaatcctgctcaaagctaccctgctcgcggtgtctggagtctatcctctgagcattcccgccacgctttttgtgtggtacttctggcaaaagaaaaagcagcgctccggcgtcctgtgggacaccccttctcccccggaagtggagagagctgttctggatgacggcatctatcggattatgcagcgcgggctcctgggaagaagccaggtgggcgtcggggtgttccaagaaaacgtttttcatacaatgtggcacgtgacccggggagccgtccttatgtaccagggcaagagactggagccttcctgggccagcgtgaaaaaggacctcatctcttacgggggaggctggcgcctgcagggctcctggaatacaggggaggaagtgcaggttattgctgtcgagcccggcaagaaccctaagaatgtgcaaaccgcccccggcacattcaaaacgccggaaggggaggtgggagcgatcgctctcgattttaagcctggcaccagcgggtctcccattgtcaaccgggaaggaaagatcgtgggcctgtatggcaatggggttgtgacaacctccggaacctacgtcagcgccatcgcccaggctaaagcctcccaggagggccctcttcccgagattgaagacgaggtgttcagaaagcgcaacctgacaatcatggatctgcaccccgggtctggaaaaacgcggagatatctccctgcgattgttcgcgaagctatcaagcggaaactgagaacccttattctggccccgacacgcgtggtcgccagcgagatggctgaagccctcaagggcatgcccatccggtaccaaaccacagctgtgaagtccgagcataccgggaaagagatcgttgacctgatgtgccacgccacgtttacaatgagactgctcagccctgtgcgggtccccaattataacatgattatcatggatgaagcgcatttcaccgacccttcttccattgccgctcgcggctacatcagcaccagagtgggaatgggcgaggccgctgccatttttatgacagccacaccccctgggtctgtggaggctttcccgcagagcaatgcggtcatccaggatgaggaacgggacatccccgagcgctcctggaactctggatatgagtggattacagattttcctggcaagaccgtttggttcgtgcccagcatcaaatccgggaatgacattgccaactgtcttagaaagaatggaaaacgggtgatccagctgtctagaaagacgtttgatacagaataccaaaagaccaaaaacaacgactgggactacgtcgtgacaaccgatattagcgagatgggcgctaatttccgcgccgaccgggttatcgatcctagacgctgcctgaagcccgtgattctcaaagacgggccggaacgggtcatcctggccggccctatgcccgtgacggttgcttccgccgcgcagagacgcggacggatcggcagaaaccacaataaggagggggatcagtatatttacatgggacagccccttaacaatgacgaggatcatgctcactggaccgaagccaaaatgctgctcgacaacatcaatacacctgagggcattatccccgccctgttcgaacctgagcgcgaaaagagcgctgccattgatggggagtatagactgcggggagaggcgcgcaagacctttgtggaactcatgagacggggcgaccttccggtctggctgtcttacaaagtggcctccgaggggttccaatatagcgatcgcagatggtgctttgacggcgaacggaacaatcaggtcctggaggaaaacatggatgtggagatctggacaaaggagggagaacgcaagaagctccgcccccggtggctggacgctagaacctactccgaccctcttgccctgcgcgagttcaaagaatttgctgccggccggagatctgttagcggggatctcatcctggagattggaaagctgccccagcacctcacacagcgggctcaaaatgcccttgacaacctggtgatgctgcataattccgaacagggcgggcgcgcgtatagacacgccatggaggagctccctgataccatcgaaacgctgatgcttctggctctcattgccgtgctgacaggaggcgtcaccctgttctttctctctggccgggggcttggaaaaaccagcatcggcctgctgtgtgttatggcttccagcgtgctcctgtggatggcctctgtggagccccattggattgccgcttccatcatccttgagttctttctgatggtcctcctgattccggagcctgaccgccagagaacaccccaggataaccaactggcgtacgtggttatcgggctccttttcatgattctgaccgtggccgctaatgagatgggactgctcgaaacaacgaagaaggacctgggcatcgggcacgtcgccgtggagaaccaccatcacgccgctatgcttgatgtcgacctgcatcctgccagcgcgtggaccctctacgccgtggctacaaccattatcacacccatgatgcggcacaccattgaaaacacgaccgccaatatctctctgacagctatcgccaaccaggcggccattctgatgggactcgataaaggctggcctatctccaagatggacattggcgttccccttctggctctggggtgctatagccaggtgaatccgctcaccctgacagccgctgtccttatgctggtggcccattacgctatcattggacctggcctccaagccaaagcgacccgcgaggcccagaagagaacggctgccgggatcatgaaaaaccccacagttgatggaatcgtggctattgacctggatcccgtcgtgtatgacgccaagtttgaaaagcagctgggccagatcatgctccttattctgtgtacctctcaaatcctgctcatgcggacaacctgggccctgtgcgagagcattacccttgcgacagggcctctgacgaccctctgggagggatccccgggcaaattctggaatacaaccatcgctgtgtctatggccaacatctttcgcggcagctacctggctggggccggactggccttctccctcatgaaaagccttggcgggggaagacggggcacaggggctcagggagaaaccctgggcgagaaatggaagagacagctgaatcagctctccaaatctgagttcaacacgtataagcgcagcggcattatggaggttgaccggtccgaagccaaggaggggctgaaaagaggagagacaaccaagcacgcggtctctcgcggcaccgccaaacttcggtggtttgtggaaagaaatctggtgaagcccgaggggaaagtcatcgatctcggatgtggccgcgggggatggagctactattgcgctggcctgaagaaggttacagaagtgaaaggctacaccaaaggcgggcctgggcacgaggaacccattcctatggccacatacgggtggaacctggtgaaactccattccggaaaggacgtcttctttattccccctgagaaatgtgatacgcttctgtgcgacattggcgagtctagcccgaatcccaccatcgaagaggggcggacactgagagtgctcaagatggttgaaccttggctgcgcggaaaccaattctgtattaaaatccttaatccctatatgccttccgtggtcgagaccctggagcagatgcagcggaagcacggcggcatgctcgtgagaaaccccctgagccgcaattctacacatgaaatgtactgggtttcctgcgggaccggaaacatcgtgagcgctgtcaatatgacgtctcggatgctgctcaacagatttaccatggcccaccgcaagccgacatatgagagagatgtggacctgggcgcggggacccggcacgtggccgtcgaacctgaggttgctaaccttgatattatcggacagcgcattgaaaatatcaaacatgagcacaagtccacatggcattacgacgaggataacccctataaaacctgggcctaccacggcagctatgaagtgaagccctctgggtccgctagctccatggtgaatggagtcgtgaaactgctcacaaagccttgggacgttattcccatggtgacccaaatcgccatgacggatacaacccctttcggccagcagagagtctttaaggagaaagtggacacccggacaccgaaggctaaaagaggcacggcccaaatcatggaagttaccgcgaagtggctgtgggggttccttagccggaacaaaaagccccgcatttgtacaagagaggaatttaccaagaaagtgcggtctaatgccgctatcggagccgtcttcgtggacgagaaccagtggaatagcgctaaggaggccgttgaagatgagcgcttttgggacctggtgcatagagaacgggagctccacaaacagggcaagtgcgccacatgcgtctacaacatgatggggaaacgcgaaaagaagctgggagagttcggcaaagcgaaggggtccagagctatttggtacatgtggctgggcgcccggtttctcgagttcgaagccctgggattcatgaatgaggatcactggttttctcgcgaaaacagcctttccggcgtggagggggagggactgcataaactcggctatatcctgagagacatttctaagatccctgggggaaatatgtacgctgatgacaccgccggctgggatacacggatcaccgaagacgatcttcagaacgaggctcgcattacggacatcatggaacccgagcacgccctgctcgcgaaaagcattttcaagctgacctatcaaaataaagtcgtgagagttcagcggcctgccaagaacgggacagtgatggatgtcatctcccgcagagaccagcggggctctggacaggtgggcacctacgggctgaatacatttaccaacatggaagctcaactcattagacagatggagagcgagggaatcttctcccccagcgaactggagacgccgaaccttgccgaacgcgtgctggattggctcgagaagtatggcgttgaacggctgaaaagaatggctatctctggggacgactgtgtggtcaagcctattgatgaccgctttgccacagcgcttaccgccctgaatgatatgggaaaagtgcggaaggacatcccccagtgggagccttccaaaggctggaacgattggcagcaagttcccttctgcagccatcactttcaccagctcattatgaaggacgggagagagatcgtggtcccttgtcgcaatcaggatgaactggtgggccgggctagagtctctcagggagccggctggtccctgcgcgagacagcttgcctcggaaagagctacgcccaaatgtggcagctgatgtatttccatcggagagaccttcgcctggctgccaacgcgatttgttccgccgtgcccgttgattggatcccgacctctcggacgacctggagcattcacgctcatcaccagtggatgacaaccgaagacatgctctccgtgtggaatagagtctggatcgaggaaaacccttggatggaggataaaacacatatcagctcttggggagacgtgccctacctgggcaagcgggaggaccaatggtgcgggtcccttattggactgaccgccagagccacatgggctaccaatatccaggttgccattaaccaggtgcgccggctcatcggcaatgaaaactacctggattatatgacgagcatgaaaagatttaagaatgagtctgaccccgaaggggcgctgtggtga

SEQ ID NO: 19191 - RNA, 9879 nt, synthetic construct
  misc_feature 1..9879: note = derived and/or modified CDS sequence (opt5) from DENV-1__GU131747__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggagctctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgccggcaaactcgttcatcagattttcgggacggcttacggagtcctgttttccggcgtgagctggaccatgaagatcgggattggcgtgcttctgacatggctcggactcaattctagatccaccagcctgtctatgacatgtatcgccgtcggccttgtgaccctctacctgggggttatggtgcaggctgattccggatgcgtcattaactggaaaggccgcgaactgaagtgtgggagcggaatcttcgtgacaaatgaggttcacacctggacggaacaatataagtttcaggccgactcccctaaacggctctctgcggccattggcaaggcttgggaggagggggtgtgcggcatcagaagcgccacacgcctggaaaacatcatgtggaaacagatttccaacgagcttaatcatatcctgctcgaaaacgacatgaagttcaccgtcgtggttggagatgtggctggcattctggcccaggggaaaaagatgatccggccgcaacccatggagtacaaatattcttggaaaagctggggaaaggccaagattatcggcgctgacgtccagaataccacatttatcattgatgggcctaacacccccgaatgtcctgacgatcagagagcgtggaatatctgggaggtggaggactacggattcggcatttttacgacaaacatctggctgaaacttcgcgattcctatacccaggtgtgcgaccaccggctcatgagcgccgctattaaagattctagagccgtccacgccgacatgggctactggatcgaatccgagaagaatgaaacatggaaactggctcgcgccagcttcatcgaggttaagacctgtatttggcccaagtctcatacactgtggtccaacggggtgctcgaaagcgagatgatcattccgaaaatctatggaggccctatttctcaacacaattaccggcccgggtacttcacccagacggcgggaccttggcatctgggcaaacttgagctggattttgacctctgcgaagggaccacagtggtcgtggatgagcactgcggaaacagaggccccagcctgcggaccacaaccgttacgggcaaaatcatccacgaatggtgttgccgctcctgtacactgcctccccttagattcagaggggaagacggatgctggtatggcatggagattcggccggtgaaggaaaaagaggaaaatctcgtcaagagcatggtgtctgctgggtccggagaggttgacagcttttccctgggcctgctctgtatctctattatgatcgaagaggtgatgcgcagccggtggtccagaaagatgctgatgaccgggacacttgccgtcttctttctgctcattatgggacagctgacctggaacgatctgatccgcctttgcattatggtgggcgccaatgcttctgacagaatgggcatggggaccacatacctggccctcatggcgacgttcaaaatgcggcctatgtttgctgttggactgctgttccgcagactgaccagccgggaggtgcttctgctcacaatcggcctgtccctggtcgcctctgtggaacttcccaacagcctggaggaactcggggatggactggccatgggcatcatgattctcaagctgcttaccgactttcaatcccatcagctgtgggctacactcctgagcctgaccttcatcaaaacgacattttctcttcactatgcctggaagaccatggctatggtgctgtccattgtcagcctcttccccctgtgtctctctaccacatcccagaaaaccacatggctgcctgtttttcttgggagcctgggatgcaagccgctgacgatgttcctcatcgccgagaataagatttggggccgcagatcttggcccctgaacgaaggcatcatggcggtggggatcgtgtccattcttctgagctccctcctgaaaaacgatgtccctctcgccggacccctgatcgctggcgggatgcttattgcctgttacgtgatcagcggatctagcgctgacctgtccctggagaaggccgccgaggtttcttgggaagaggaagctgagcatagcggcgcgtcccacaatattctcgtggaagtccaggatgacgggaccatgaaaatcaaggatgaggagcgggacgatacactgaccgtgcttctgaaagccacactcctggctgtttctggagtgtatcctctcagcatccccgccaccctgttcgtctggtacttttggcaaaagaaaaagcagcgctccggcgtgctttgggacacgccttctcccccggaagtcgagagagccgtgctggatgacggcatttatcggatcatgcagcgcgggctgctcggaagaagccaggttggcgtgggggtcttccaagaaaacgtgtttcataccatgtggcacgttacacggggagctgtgctgatgtaccagggcaagagacttgagccttcctgggccagcgtcaaaaaggacctgatttcttacgggggaggctggcgcctccagggctcctggaataccggggaggaagtccaggtgatcgcggttgagcccggcaagaaccctaagaatgtccaaacagctcccggcaccttcaaaacaccggaaggggaggtgggagccattgccctggattttaagcctggcacgagcgggtctcccatcgtgaaccgggaaggaaagattgtcggcctctatggcaatggggtggttaccacatccggaacctacgtgagcgctatcgcccaggcgaaggcttcccaggagggccctctgcccgagatcgaagacgaggtcttcagaaagcgcaaccttaccattatggatctgcaccccgggtctggaaaaacacggagatatctgcctgccatcgtgcgcgaagccattaagcggaaactcagaacgctgatccttgctccgacccgcgttgtggccagcgagatggctgaagccctgaagggcatgcccattcggtaccaaacaaccgcggtcaagtccgagcatacagggaaagagatcgtggacctcatgtgccacgccacctttacgatgagactgctgagccctgttcgggtgcccaattataacatgatcattatggatgaagctcatttcacagacccttcttccatcgccgctcgcggctacattagcaccagagtcggaatgggcgaggccgccgctatctttatgaccgcgacaccccctgggtctgtggaagccttcccgcagagcaatgctgtgattcaggatgaggaacgggacatccccgagcgctcctggaactctggatatgagtggatcaccgattttcctggcaagacagtctggttcgttcccagcattaaatccgggaatgacatcgccaactgtctcagaaagaatggaaaacgggtgattcagctttctagaaagaccttcgatacggaataccaaaagaccaagaacaacgactgggactacgtggtcaccacagatatcagcgagatgggcgccaattttcgcgctgaccgggtgattgatcctagacgctgcctgaagcccgttatcctgaaagacgggccggaacgggtgattctcgccggccctatgcccgtcaccgtggcgtccgctgcccagagacgcggacggatcggcagaaaccacaataaggagggggatcagtatatctacatgggacagcccctgaacaatgacgaggatcatgcccactggacggaagctaaaatgcttctggacaacattaatacccctgagggcatcattcccgccctcttcgaacctgagcgcgaaaagagcgcggccatcgatggggagtatagactgcggggagaggctcgcaagacatttgttgaactgatgagacggggcgacctcccggtgtggctttcttacaaagtcgcctccgaggggttccaatatagcgatcgcagatggtgctttgacggcgaacggaacaatcaggtgctggaggaaaacatggatgtcgagatttggaccaaggagggagaacgcaagaagctgcgcccccggtggctcgacgctagaacatactccgaccctctggcccttcgcgagttcaaagaatttgctgccggccggagatctgtgagcggggatctgatcctcgagatcggaaagctgccccagcacctgacccagcgggcgcaaaatgccctcgacaaccttgttatgctgcataattccgaacagggcgggcgcgcttatagacacgccatggaggagctgcctgatacaattgaaaccctcatgctgcttgctctgatcgccgtgctcacgggaggcgtgacactgttctttctgtctggccgggggctcggaaaaaccagcattggccttctgtgtgtcatggcctccagcgttctgctctggatggcttctgtggagccccattggatcgcggcctccattatcctggagttctttcttatggtgctgctcatcccggagcctgaccgccagagaacaccccaggataaccaactggcttacgtcgtgattgggctcctgttcatgatccttacagttgccgccaatgagatgggactgctggaaaccacaaagaaggacctcggcattgggcacgtggctgtcgagaaccaccatcacgccgcgatgctggatgtggaccttcatcctgccagcgcttggacgctgtacgccgtcgctaccacaatcattacccccatgatgcggcacacaatcgaaaacaccacggccaatatttctctcaccgcgatcgccaaccaggctgccatcctgatgggactggataaaggctggcctatttccaagatggacatcggcgtgcccctccttgctctggggtgctatagccaggttaatccgctgacactcaccgccgctgtgctgatgcttgtcgcccattacgcgattatcggacctggcctgcaagccaaagctacacgcgaggcccagaagagaaccgctgccgggattatgaaaaaccccacggtggatggaatcgttgccatcgacctcgatcccgtggtctatgacgcgaagtttgaaaagcagctgggccagattatgctgctcatcctttgtacatctcaaattctgctgatgcggaccacatgggctctctgcgagagcatcaccctggccaccgggcctcttacaacgctgtgggagggatccccgggcaaattctggaataccacaattgctgtgtctatggccaacatcttccgcggcagctacctcgccggggctggactggccttttccctgatgaaaagcctcggcgggggaagacggggcaccggggcgcagggagaaacacttggcgagaaatggaagagacagctgaatcagctgtccaaatctgagttcaacacctataagcgcagcggcatcatggaggtggaccggtccgaagccaaggaggggctcaaaagaggagagacgacaaagcacgctgtttctcgcggcaccgccaaactgcggtggtttgtcgaaagaaatcttgtgaagcccgaggggaaagtgattgatctgggatgtggccgcgggggatggagctactattgcgctggcctcaagaaggtcaccgaagttaaaggctacacaaaaggcgggcctgggcacgaggaacccatccctatggccacctacgggtggaacctggtgaaactgcattccggaaaggacgtgttctttattccccctgagaaatgtgatacactcctttgcgacatcggcgagtctagcccgaatcccacgattgaagaggggcggaccctgagagtcctgaagatggtggaaccttggctccgcggaaaccaattctgtatcaaaattctgaatccctatatgccttccgttgtggagacacttgagcagatgcagcggaagcacggcggcatgctggtcagaaaccccctcagccgcaattctacccatgaaatgtactgggtgtcctgcgggacaggaaacatcgttagcgcggtgaatatgacctctcggatgctgctgaacagatttacgatggcccaccgcaagccgacctatgagagagatgtcgacctcggcgctgggacacggcacgtggccgtggaacctgaggtcgctaacctggatatcattggacagcgcatcgaaaatattaaacatgagcacaagtccacctggcattacgacgaggataacccctataaaacatgggcctaccacggcagctatgaagttaagccctctgggtccgctagctccatggtgaatggagtggtcaaacttctgaccaagccttgggacgtgatccccatggttacacaaattgccatgaccgatacgacacctttcggccagcagagagtgtttaaggagaaagtcgacacccggaccccgaaggcgaaaagaggcacagcccaaatcatggaagtgacggctaagtggctctgggggttcctgagccggaacaaaaagccccgcatctgtaccagagaggaatttacacggaaggttcgctctaatgccgctattggagccgtgttcgtcgacgagaaccagtggaatagcgccaaagaggcggtggaagatgagagattttgggaccttgttcatcgggaacgcgagctgcacaagcagggcaaatgcgctacctgcgtgtacaacatgatggggaagagagagaaaaagctcggagagttcggcaaggccaaagggtcccgggccatctggtacatgtggctgggcgctcgcttcctggagtttgaagccctcggattcatgaatgaggatcactggttttctagagaaaacagcctgtccggcgtcgagggggagggacttcataagctgggctatattctccgggacatctctaaaattcctgggggaaatatgtacgctgatgacacagccggctgggatacccgcatcacagaagacgatctgcagaacgaggcgagaatcaccgacattatggaacccgagcacgcccttctggctaagagcatcttcaaactcacgtatcaaaataaggtggtccgggtgcagcgccctgccaaaaacgggaccgttatggatgtgatttccagacgggaccagagaggctctggacaggtcggcacatacgggctgaatacctttacaaacatggaagctcaactgatccgccagatggagagcgagggaattttctcccccagcgaactcgagaccccgaacctggccgaacgggtgcttgattggctggagaagcatggcgtggaaagactcaagcgcatggcgatctctggggacgactgtgttgtgaaacctatcgatgaccggtttgccacggctctgacagcccttaatgatatgggaaaggtcagaaaagacattccccagtgggagccttccaagggctggaacgattggcagcaagtgcccttctgcagccaccactttcatcagctgatcatgaaagacgggcgcgagattgttgtgccttgtcggaatcaggatgaactcgtcggcagagctcgcgtgtctcagggagccggctggtccctgcgggagaccgcttgcctgggaaagagctatgcccaaatgtggcagctcatgtacttccacagacgcgacctgcggcttgcggccaacgctatctgttccgccgtccccgtggattggattccgacatctagaaccacgtggagcatccatgcccaccatcagtggatgaccacagaagacatgctgtccgtttggaatcgggtgtggattgaggaaaacccttggatggaggataagacccacatcagctcttggggagacgtcccctatctcggcaaaagagaggaccaatggtgcgggtccctgatcggacttacagctcgcgccacctgggcgacaaatattcaggtggctatcaaccaggttcggagactgattggcaatgaaaactacctcgattacatgaccagcatgaagcgctttaaaaatgagtctgaccccgaaggggccctgtggtga

SEQ ID NO: 19192 - RNA, 9879 nt, synthetic construct
  misc_feature 1..9879: note = derived and/or modified CDS sequence (opt5) from DENV-1__GU131748__SS-prME
  source 1..9879: mol_type = other RNA
agcgtgaccatgctgttcatgctcgtgcccacagccctggcttttcaccttacgaccagaggcggggaacctcatatgatcgtttccaagcaggaacggggaaaatctctgctgttcaagacaagcgccggcgtgaacatgtgcaccctgatcgcgatggaccttggggagctgtgtgaagatacaatgacctacaaatgcccccgcatcacagagaccgaacccgacgatgtggactgttggtgcaatgctacggatacctgggtcacatatggaacctgttcccaaacaggcgagcacagacgggacaagcgctctgtggccctcgcccctcatgttgggctgggactggagaccagaacggaaacatggatgagctccgagggcgcttggaaacagattcagcgggtggaaacctgggccctccgccaccccggctttacagtcatcgctctgttccttgcccatgcgattgggacctctatcacccagaagggaatcatttttatcctgctcatgctggtgacacctagcatggccatgagatgcgttggcattgggtcccgggatttcgtggagggacttagcggcgctacgtgggtcgacgtggtgctggagcacgggtcttgtgtcaccacaatggccaaggataaacccaccctcgacatcgaactgctgaagacagaggttaccaaccctgctgtgctccgcaaactgtgcattgaagccaagatctccaatacgacaaccgatagcagatgtccgacccaaggagaggcgacacttgtggaagaacaagacgccaactttgtctgccggcgcaccttcgtggatagaggctggggcaatgggtgtggactgtttggcaaagggtctctcattacatgcgctaagttcaagtgcgttacgaaactggagggaaagatcgtgcagtacgaaaaccttaaatattccgtcatcgtgaccgttcacacaggcgaccagcatcaagtggggaatgagagcaccgaacacggaacaaccgccacgattacaccccaagctcctaccaccgagatccagctgacagactacggcgccctcaccctggattgttctccccggacgggcctggactttaacgaaatggtcctcctgacaatgaaggagaaatcctggcttgtgcataagcagtggttcctggatctccctctgccctggaccagcggggcctccacatctcaagagacctggaatcgccaggaccttctggtcacctttaaaacagctcacgcgaagaagcaggaagtggttgtgctcggaagccaagagggcgccatgcacacggctctgaccggggccacagaaattcagacctccggaacaaccacgatcttcgccggccatctgaaatgcagactcaagatggataaactgacacttaaggggatgagctatgtcatgtgtaccggctctttcaaactggagaaggaagtggctgagacccagcacggaacagttctcgtgcagattaagtacgagggcaccgacgccccgtgcaaaatccctttttccacacaagatgaaaagggggtcacgcagaacggacggctgatcaccgcgaatcccattgtgacagacaaagagaagcctgtgaacatcgaagctgagccgcccttcggcgagagctatattgttatcggggccggagaaaaagccctgaaactttcttggtttaagaaaggcagctccattgggaagatgttcgaggctaccgccagaggcgctcgccggatggccatcctcggagatacagcgtgggactttggctctatcgggggagtcttcaccagcgtgggcaaactggtgcatcagatttttgggacggcctacggagtcctgttctccggcgtgagctggaccatgaagatcgggattggcgttctcctgacatggcttggactcaattctagatccaccagcctctctatgacatgtatcgctgtgggcctggtcaccctgtaccttggggtgatggttcaggccgattccggatgcgtgattaactggaaaggccgcgaactcaagtgtgggagcggaatctttgtcacaaatgaggtgcacacctggacggaacaatataagttccaggctgactcccctaaacggctgtctgccgcgattggcaaggcctgggaggagggggtttgcggcatcagaagcgctacacgcctggaaaacatcatgtggaaacagatttccaacgagctcaatcatatcctgcttgaaaacgacatgaagtttaccgtggtcgtgggagatgtggccggcattctggctcaggggaaaaagatgatccggccgcaacccatggagtacaaatattcttggaaaagctggggaaaggccaagattatcggcgccgacgtccagaataccacattcatcattgatgggcctaacacccccgaatgtcctgacgatcagagagcttggaatatctgggaggttgaggactacggatttggcattttcacgacaaacatctggctcaagctgcgcgattcctatacccaggtgtgcgaccaccggctgatgagcgcggccattaaagattctaaggctgtgcacgccgacatgggctactggatcgaatccgagaaaaatgaaacatggaaacttgccagagctagcttcatcgaggtcaagacctgtatttggcccaaatctcatacactctggtccaacggggtgctggaaagcgagatgatcattccgaagatctatggaggccctatttctcaacacaattaccgccccgggtactttacccagacggccggaccttggcatctgggcaaactcgagctggatttcgacctttgcgaagggaccacagttgtggtcgatgagcactgcggaaaccggggccccagcctgagaaccacaaccgtgacgggcaagatcatccacgaatggtgttgccggtcctgtacactccctcccctgcgctttagaggggaggacggatgctggtatggcatggagattcggccggttaaagaaaaggaggaaaatctggtcaagagcatggtctctgcggggtccggagaggtggacagcttctcccttggcctcctgtgtatctctattatgatcgaagaggttatgagaagccgctggtcccggaaaatgctgatgaccgggacactcgctgtgtttttcctgcttattatgggacagctgacctggaacgatctcatcagactgtgcattatggtcggcgccaatgcctctgaccgcatgggcatggggaccacatacctggctcttatggccacgtttaagatgagacctatgttcgcggtgggactgctctttcggcgcctgaccagcagagaggtgctcctgcttacaatcggcctgtccctcgtcgcttctgttgaactgcccaacagcctggaggaacttggggatggactggccatgggcatcatgattctcaaactgctcaccgacttccaatcccatcagctgtgggccacacttctgagcctcacctttatcaagacgacattctctctgcactatgcttggaaaaccatggccatggtgctgtccattgtgagcctttttcccctgtgtctctctaccacatcccagaagaccacatggctgcctgtcctcctggggagccttggatgcaagccgctgacgatgttcctgatcgctgagaataaaatttggggccggcgctcttggcccctcaacgaaggcatcatggccgtggggatcgtttccattctgcttagctccctgctcaagaacgatgtgcctctggcgggacccctcatcgccggcgggatgctgattgcttgttacgtcatcagcggatctagcgccgacctttccctggagaaagctgccgaggtgtcttgggaagaggaagccgagcatagcggcgcttcccacaatattctggttgaagtgcaggatgacgggaccatgaagatcaaagatgaggagagagacgatacactcaccatcctgcttaaggcgacactgctcgccgtctctggagtgtatcctctgagcattcccgctaccctcttcgtctggcatttttggcagaagaagaagcagcggtccggcgtgctgtgggacacgccttctcccccggaagttgagcgcgccgtgcttgatgacggcatctacagaattatgcagcgggggctgctgggacgcagccaggtcggcgtgggggttttccaagaaaacgtgtttcacaccatgtggcacgtcacaagaggagccgtgctcatgtatcagggcaaacggctggagccttcctgggctagcgtgaagaaagaccttatctcttacgggggaggctggagactgcagggctcctggaataccggggaggaagttcaggtcattgccgtggagcccggaaagaaccctaaaaatgtgcaaacagcgcccggcaccttcaagacaccggaaggggaggtcggagctatcgccctcgattttaagcctggcacgagcgggtctcccattgtgaaccgcgaaggaaaaatcgttggcctgtacggcaatggggtggtcaccacatccggaacctatgtgagcgccatcgctcaggccaaggcgtcccaggagggccctctccccgagattgaagacgaggttttccggaaaagaaacctgaccatcatggatcttcatcccgggtctggaaagacacgccggtacctgcctgctattgtgagagaagccatcaaacgcaagctgcggacgctcattctggccccgaccagagtcgtggctagcgagatggccgaagctcttaagggcatgcccatccgctatcaaacaaccgccgttaaatccgagcacacagggaaggagatcgtggacctgatgtgccatgcgacctttacgatgcggctcctgagccctgtcagagtgcccaattacaacatgattatcatggatgaagcccacttcacagacccttcttccattgctgcccggggctatatcagcacccgcgtgggaatgggcgaggctgccgccatttttatgaccgctacaccccctgggtctgtcgaagcgttcccgcagagcaatgccgttatccaggatgaggaaagagacatccccgagcggtcctggaactctggatacgagtggattaccgattttcctggcaaaacagtgtggttcgtgcccagcatcaagtccgggaatgacattgctaactgtctgcgcaaaaatggaaagagagtcatccagctctctcggaagaccttcgatacggaatatcagaagaccaagaacaacgactgggactacgtggttaccacagatattagcgagatgggcgccaattttagagccgaccgcgtgatcgatcctcggagatgccttaaacccgtcattctgaaggacgggccggaacgcgtgatcctggctggccctatgcccgttaccgtggcctccgcggctcagcggagaggacgcatcggccggaaccataataaagagggggatcagtacatttatatgggacagcccctcaacaatgacgaggatcacgcccactggacggaagccaagatgctgcttgacaacatcaatacccctgagggcattatccccgctctgttcgaacctgagagagaaaagagcgccgcgattgatggggagtaccgcctcagaggagaggcccggaaaacatttgtcgaactgatgcgcagaggcgacctgccggtgtggctctcttataaggtcgcttccgaggggttccaatacagcgatcggcgctggtgctttgacggcgaaagaaacaatcaggtgcttgaggaaaacatggatgttgagatctggaccaaagagggagaacggaagaaactgagaccccgctggctggacgcccggacatattccgaccctctcgctctgagagagttcaaggaatttgccgctggccgccggtctgtgagcggggatcttatcctggagattggaaaactcccccagcatctgacccagagagcccaaaatgcgctggacaacctcgtgatgcttcacaattccgaacagggcgggcgggcctaccgccatgctatggaggagctgcctgatacaatcgaaaccctgatgctcctggcccttattgctgtcctgacgggaggcgttacactcttctttctgtctggcagagggctgggaaagaccagcatcggcctcctttgtgtgatggcctccagcgtgctgctgtggatggcctctgtcgagccccactggattgctgcgtccatcatcctcgagttctttctgatggtgcttctgattccggagcctgaccggcagcgcacaccccaggataaccaactcgcctatgttgtgatcgggctgctgttcatgattctcacagtcgctgccaatgagatgggacttctggaaaccacaaagaaagacctgggcatcgggcacgtggccgtcgagaaccatcaccatgctgccatgctcgatgtggacctgcaccctgcgagcgcctggacgctttacgctgttgccaccacaattatcacccccatgatgagacatacaattgaaaacaccacggctaatatctctctgaccgccatcgcgaaccaggccgctattctcatgggactggataagggctggcctatctccaaaatggacattggcgtgcccctgctcgcccttgggtgctacagccaggtcaatccgctgacactgaccgctgccgtgctcatgctggttgctcactatgccatcattggacctggccttcaagcgaaggccacacgggaggctcagaaacgcaccgccgctgggatcatgaagaaccccacggtggatggaatcgtcgccattgacctggatcccgtggtgtacgacgccaagtttgaaaaacagctcggccagatcatgctgctgattctctgtacatctcaaatccttctgatgagaaccacatgggcgctgtgcgagagcattaccctcgctaccgggcctctgacaacgctttgggagggatccccgggcaagttctggaataccacaatcgccgtttctatggctaacatcttccggggcagctatctggccggggccggactcgctttttccctgatgaaaagcctgggcgggggacgcagaggcaccggggcccagggagaaacactcggcgagaagtggaaacggcagcttaatcagctgtccaagtctgagttcaacacctacaagagaagcggcattatggaggtcgaccgctccgaagcgaaagaggggctgaagcggggagagacgacaaaacacgccgtgtctagaggcaccgctaagctccgctggtttgtggaacggaatctggtcaaacccgaggggaaggttatcgatcttggatgtggcagagggggatggagctattactgcgccggcctgaagaaagtgaccgaagtgaagggctatacaaaagggggacctggccatgaggaacccattcctatggctacctacgggtggaacctcgtcaagctgcactccggaaaagacgtgttctttattccccctgagaagtgtgatacactgctctgcgacattggcgagtctagcccgaatcccacgatcgaagaggggcgcacccttcgggttctgaaaatggtggaaccttggctgagaggaaaccaattctgtattaagatcctcaatccctacatgccttccgtcgtggagacactggagcagatgcagcgcaagcatggcggcatgcttgttcggaaccccctgagcagaaattctacccacgaaatgtattgggtgtcctgcgggacaggaaacatcgtcagcgccgtgaatatgacctctcgcatgctcctgaaccggtttacgatggcgcacagaaaaccgacctacgagcgcgatgtggacctgggcgccgggacaagacatgtcgctgttgaacctgaggtggccaacctcgatattatcggacagcggattgaaaatatcaagcacgagcataaatccacctggcactatgacgaggataacccctacaagacatgggcttatcatggcagctacgaagtgaaaccctctgggtccgccagctccatggtcaatggagtggttaagctgcttaccaagccttgggacgtgattcccatggtcacacaaatcgctatgaccgatacgacacctttcggccagcagcgcgtgtttaaagagaaggttgacaccagaaccccgaaagccaagcggggcacagcgcaaatcatggaagtgacggccaaatggctgtgggggttcctcagcagaaacaagaagccccggatttgtacccgcgaggaatttacaagaaaagtccggtctaatgctgccatcggagctgtgttcgttgacgagaaccagtggaatagcgccaaggaggccgtggaagatgagcgcttttgggacctggtccacagagaacgggagcttcacaaacagggcaagtgcgcgacctgcgtgtataacatgatggggaaacgcgaaaagaagctgggagagttcggcaaagctaaggggtccagagccatttggtacatgtggctcggcgcccggttcctggagtttgaagctctgggattcatgaatgaggatcattggttttctcgcgaaaacagcctctccggcgtcgagggggagggactgcacaaacttggctacatcctgagagacatttctaagatccctgggggaaatatgtatgccgatgacacagctggctgggatacccggatcacagaagacgatctccagaacgaggcccgcattaccgacatcatggaacccgagcatgcgctgcttgccaaaagcattttcaagctgacgtaccaaaataaagtggttagagtgcagcggcctgctaagaacgggaccgtcatggatgtgatctcccgcagagaccagcggggctctggacaggtgggcacatatgggctcaatacctttacaaacatggaagcccaactgattagacagatggagagcgagggaatcttctcccccagcgaactggagaccccgaacctcgctgaacgcgttctggattggcttgagaagtacggcgtgaaacggctgaagagaatggccatctctggggacgactgtgtcgtgaaacctattgatgaccgctttgcgacggccctcacagctctgaatgatatgggaaaggttcggaaagacatcccccagtgggaaccttccaagggctggaacgattggcagcaagtgcccttctgcagccaccactttcatcagcttattatgaaggacgggagagagatcgtcgtgccttgtcgcaatcaggatgagctggtcggccgggccagagtgtctcagggagctggctggtccctccgcgaaaccgcctgcctggggaaaagctatgctcaaatgtggcagctgatgtacttccaccggagagacctccgcctggccgcgaacgccatttgttccgctgttcccgtggattggatcccgacatctcggaccacgtggagcattcatgcccaccatcagtggatgaccacagaggacatgctttccgtctggaatagagtgtggatcgaagagaacccttggatggaagataagacccacatcagctcttggggagacgttccctatctgggcaaacgggaggaccaatggtgcgggtccctcattggactgacagccagagctacctgggccacaaatatccaggtggcgattaaccaggtccgccggcttatcggcaatgagaactacctggattacatgaccagcatgaagagatttaaaaatgaatctgaccccgagggggctctctggtga

SEQ ID NO: 19193 - RNA, 9879 nt, synthetic construct
  misc_feature 1..9879: note = derived and/or modified CDS sequence (opt5) from DENV-1__GQ868615__SS-prME
  source 1..9879: mol_type = other RNA
agcgtgaccatgctgctcatgctgatgcccacagcccttgctttccacctgacgaccagaggcggggaacctcatatgatcgtgtccaagcaggaacgggggaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctggggagcctgggatgcaagccgctcacgatgtttctgattgctgagaataaaatctggggccggcgctcttggccccttaacgaaggcatcatggccgtggggattgtgtccatcctgctcagctccctgctcaagaacgatgtccctctggcgggaccccttattgccggcgggatgctgatcgcttgttacgtgattagcggatctagcgccgacctgtccctcgagaaagctgccgaggtttcttgggaagaggaagccgagcatagcggcgcttcccacaatatcctggtggaagtccaggatgacgggaccatgaagatcaaagatgaggagagagacgatacacttaccattctgctcaaggcgacactgctcgccgtgtctggagtttatcctctgagcatccccgctacccttttcgtgtggtacttctggcagaagaagaagcagcggtccggcgtcctgtgggacacgccttctcccccggaagtggagcgcgccgtcctggatgacggcatttatagaatcatgcagcgggggctcctgggacgcagccaggtgggcgttggggtgtttcaagaaaacgtcttccataccatgtggcacgtgacaagaggagccgttcttatgtaccagggcaaacggctggagccttcctgggctagcgtgaagaaagacctcatttcttacgggggaggctggagactgcagggctcctggaataccggggaggaagtccaggtgatcgccgtggagcccggaaagaaccctaaaaatgttcaaacagcgcccggcacctttaagacaccggaaggggaggtcggagctattgccctcgatttcaagcctggcacgagcgggtctcccatcgtgaaccgcgaaggaaaaatcgtgggcctgtatggcaatggggtcgtgaccacatccggaacctacgttagcgccattgctcaggccaaggcgtcccaggagggccctcttcccgagatcgaagacgaggtgtttcggaaaagaaacctgaccattatggatctgcaccccgggtctggaaagacacgccggtatctccctgctatcgtcagagaagccattaaacgcaagctgcggacgcttatcctggccccgaccagagtggttgctagcgagatggccgaagctctcaagggcatgcccatccgctaccaaacaaccgccgtgaaatccgagcatacagggaaggagattgtcgacctgatgtgccacgcgaccttcacgatgcggctgctcagccctgtgagagttcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgtgatccaggatgaggaaagagacattcccgagcggtcctggaactctggatatgagtggatcaccgatttccctggcaaaacagtgtggtttgtccccagcattaagtccgggaatgacatcgctaactgtcttcgcaaaaatggaaagagagttattcagctgtctcggaagaccttcgatacggaataccagaagaccaagaacaacgactgggactacgtggtgaccacagatatcagcgagatgggcgccaatttcagagccgaccgcgtcattgatcctcggagatgcctgaaacccgtgatcctcaaggacgggccggaacgcgttatcctggctggccctatgcccgtgaccgtcgcctccgcggctcagcggagaggacgcattggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgtggaactcatgcgcagaggcgaccttccggtttggctgtcttacaaggtggcttccgaggggtttcaatatagcgatcggcgctggtgcttcgacggcgaaagaaacaatcaggtcctggaggaaaacatggatgtggagatctggaccaaagagggagaacggaagaaactcagaccccgctggctggacgcccggacatactccgaccctcttgctctgagagagtttaaggagttcgccgctggccgccggtctgtcagcggggatctcattctggagatcggaaaactgccccagcacctcacccagagagcccaaaatgcgcttgacaacctggtgatgctgcataattccgaacagggcgggcgggcctatcgccacgctatggaggagctccctgatacaattgaaaccctgatgcttctggccctcatcgctgttctgacgggaggcgtgacactgtttttcctctctggcagagggcttggaaagaccagcattggcctgctgtgtgtgatggcctccagcgtcctcctgtggatggcctctgttgagccccattggatcgctgcgtccatcattcttgaatttttcctgatggtgctcctgatcccggagcctgaccggcagcgcacaccccaggataaccaactggcctacgtggtcattgggctcctttttatgatcctgacagtggctgccaatgagatgggactgctcgaaaccacaaagaaagacctgggcattgggcacgttgccgtggagaaccaccatcacgctgccatgcttgatgtcgacctgcatcctgcgagcgcctggacgctctacgctgtggccaccacaatcattacccccatgatgagacacacaatcgaaaacaccacggctaatatctctctgaccgccattgcgaaccaggccgctatcctgatgggactcgataagggctggcctatttccaaaatggacatcggcgtcccccttctggccctggggtgctatagccaggtgaatccgctcacactgaccgctgccgttcttatgctggtggctcattacgccattatcggacctggcctccaagcgaaggccacacgggaggctcagaaacgcaccgccgctgggatcatgaagaaccccacggtcgatggaattgtggccatcgacctggatcccgttgtgtatgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaatcgccgtctctatggctaacattttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcatcatggaggtggaccgctccgaagcgaaagaggggctgaagcggggagagacgacaaaacacgccgtgtctagaggcaccgctaaacttcgctggttcgttgaacggaatctggtcaaacccgaggggaaggtgattgatctcggatgtggcagagggggatggagctactattgcgccggcctgaagaaagtgaccgaagtcaagggctacacaaaagggggacctggccacgaggaacccatccctatggctacctacgggtggaacctggttaagctccattccggaaaagacgtgtttttcattccccctgagaagtgtgatacacttctgtgcgacatcggcgagtctagcccgaatcccacgattgaagaggggcgcaccctgcgggtgctcaaaatggtcgaaccttggctgagaggaaaccaattttgtatcaagatccttaatccctatatgccttccgtggttgagacactggagcagatgcagcgcaagcacggcggcatgctcgtgcggaaccccctgagcagaaattctacccatgaaatgtactgggtctcctgcgggacaggaaacattgtgagcgccgttaatatgacctctcgcatgctgctcaaccggttcacgatggcgcacagaaaaccgacctatgagcgcgatgtggacctgggcgccgggacaagacacgtcgctgtggaacctgaggtggccaaccttgatatcattggacagcggatcgaaaatattaagcatgagcacaaatccacctggcattacgacgaggataacccctataagacatgggcttaccacggcagctatgaagtcaaaccctctgggtccgccagctccatggttaatggagtggtgaagctgctcaccaagccttgggacgtcatccccatggtgacacaaatcgctatgaccgatacgacaccttttggccagcagcgcgttttcaaagagaaggtggacaccagaaccccgaaagccaagcggggcacagcgcaaattatggaagtcacggccaaatggctgtgggggtttcttagcagaaacaagaagccccggatctgtacccgcgaggagttcacaagaaaagtgcggtctaatgctgccattggagctgtttttgtggacgagaaccagtggaatagcgccaaggaggccgtcgaagatgagcgcttctgggacctggtgcatagagaacgggagctccacaaacagggcaagtgcgcgacctgcgtttacaacatgatggggaaacgcgaaaagaagctgggagagtttggcaaagctaaggggtccagagccatctggtacatgtggctgggcgcccggttcctcgagttcgaagctctgggatttatgaatgaggatcactggttctctcgcgaaaacagcctttccggcgtggagggggagggactgcataaactcggctatattctgagagacatctctaagatccctgggggaaatatgtacgccgatgacacagctggctgggatacccggattacagaagacgatcttcagaacgaggcccgcatcaccgacattatggaacccgagcacgcgctgctcgccaaaagcatctttaagctgacgtatcaaaataaagtcgtgagagtccagcggcctgctaagaacgggaccgtgatggatgttatttcccgcagagaccagcggggctctggacaggtgggcacatacgggctgaataccttcacaaacatggaagcccaactcatcagacagatggagagcgagggaatcttttcccccagcgaactggagaccccgaaccttgctgaacgcgtcctggattggctcgagaagtatggcgtggaacggctgaaaagaatggccatttctggggacgactgtgtggttaagcctatcgatgaccgcttcgcgacggcccttacagctctgaatgatatgggaaaagtgcggaaggacattccccagtgggagccttccaaaggctggaacgattggcagcaagtccccttttgcagccatcacttccaccagctcatcatgaaggacgggagagagattgtggttccttgtcgcaatcaggatgaactggtgggccgggccagagtctctcagggagctggctggtccctgcgcgagaccgcctgcctcggaaagagctacgctcaaatgtggcagctgatgtattttcatcggagagaccttcgcctggccgcgaacgccatctgttccgctgtgcccgtcgattggattccgacatctcggaccacgtggagcatccacgcccatcaccagtggatgaccacagaagacatgctctccgtgtggaatagagtttggatcgaggaaaacccttggatggaggataaaacccatattagctcttggggagacgtgccctacctgggcaagcgggaggaccaatggtgcgggtcccttatcggactgacagccagagctacctgggccacaaatattcaggtcgcgatcaaccaggtgcgccggctcattggcaatgaaaactacctggattatatgaccagcatgaaaagattcaagaatgagtctgaccccgaaggggctctgtggtga

SEQ ID NO: 19194 - RNA, 9879 nt, synthetic construct
  misc_feature 1..9879: note = derived and/or modified CDS sequence (opt5) from DENV-1__GU131749__SS-prME
  source 1..9879: mol_type = other RNA
agcgtgaccatgctgctcatgctgatgcccacggcccttgctttccacctgacgacccggggcggggagcctcatatgatcgtctccaagcaggaacggggaaagtctctcctgtttaagaccagcgccggcgttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtttttacaagcgtcggcaaactcgtgcatcagatcttcgggaccgcttacagagtgctgttttccggagtcagctggacgatgaagattggcatcggggtgcttctgacctggctcggcctcaattctcgctccacaagcctgtctatgacctgtattgccgttggacttgtgacactctacctgggcgtcatggtgcaggctgactccgggtgcgttatcaactggaaaggacgggagctgaagtgtggcagcgggattttcgtgaccaatgaagtccacacatggaccgagcaatataagtttcaggccgattcccctaaaagactctctgcggccatcggaaaggcttgggaggaaggcgtgtgcgggattcgcagcgccacgcggctggagaacatcatgtggaaacagatctccaacgaacttaatcatattctgctcgagaacgacatgaagttcacagttgtggtcggcgacgtggctggaatcctggtgcagggcaaaaagatgattagaccgcaacccatggaatacaaatattcttggaaaagctgggggaaggccaaaatcattggagccgatgtccaaaattccacctttatcatcgacggccctaacacccccgagtgtcctgatgaccagcgcgcttggaatatttgggaggttgaagattacgggttcggaatctttacaaccaacatttggctgaaacttcgggacagctatacacaggtgtgcgatcacagactcatgtctgcggccatcaaagactccaaggctgtgcacgccgatatgggctactggattgagagcgagaagaatgagacatggaagctggcccgcgcttctttcatcgaagtcaagacctgtatctggcccaaatcccatacactgtggagcaacggcgtgctcgagtctgagatgattatcccgaagattcacgggggacctatcagccaacataattatcggcccggctacttcacccagacagccgggccttggcacctgggaaaacttgaactggactttgatctctgcgagggcaccacggttgtggtcgacgaacactgcgggaacagaggaccctccctgcggaccacaaccgtgacaggcaagattatccatgagtggtgttgccgcagctgtaccctgcctccccttagattccggggcgaggatgggtgctggtacggaatggaaatcagaccggttaaagagaaggaagagaatctcgtgaagtctatggtctccgcgggcagcggggaagtggactccttttctctgggactgctctgtattagcatcatgattgaggaggttatgcgctcccggtggtctagaaaaatgctgatgacgggcacacttgctgtgttctttctgctcatcatggggcagctgacctggaacgacctgattcgcctttgcatcatggtcggagccaatgccagcgatagaatgggcatgggcacaacctatctggctctcatggccaccttcaagatgcggcctatgtttgcggtggggctgctgttccgcagactgacatcccgggaagtgcttctgctcacgattggactgtctctggtcgctagcgttgagcttcccaactccctggaagaactgggcgacgggctggccatgggaatcatgatcctcaaactgcttaccgattttcaaagctaccagctgtgggccacactcctgtctctgaccttcattaagacaaccttttcccttcactatgcttggaaaacgatggccatggtgctgagcatcgtgtctctcttccccctgtgtctctccacaaccagccagaagaccacatggctgcctgtccttctgggctctctggggtgcaagccgctcaccatgtttctgattgctgaaaataaaatctggggacgcaagtcctggccccttaacgagggcattatggccgtgggcatcgttagcatcctgctctccagcctgctcaaaaacgacgtgcctctggcggggccccttattgccggaggcatgctgatcgcttgttacgtcatttctgggagctccgccgatctgtctctcgagaaggctgccgaagtgagctgggaggaagaggccgaacattccggagcttctcacaatatcctggttgaggtgcaggacgatggcacaatgaaaattaaggacgaggaaagagatgacacgcttaccatcctgctcaaagcgacactgctcgccgtcagcggggtgtatcctctgtccatccccgctacccttttcgtctggcatttctggcaaaagaagaaacagcggtctggagtgctgtgggatacacctagccctcccgaggttgaacgcgccgtgctggacgatggcatttacagaatcatgcagcggggcctcctggggcgctcccaggtcggagtgggcgtttttcaagagaacgtgttccacaccatgtggcacgtcacgagaggggccgtgcttatgtatcagggaaagcggctggagcccagctgggcttctgtgaaaaaggacctcatttcctacggcgggggatggagatttcagggcagctggaataccggcgaagaggttcaggtcatcgccgtggaacccgggaaaaaccctaagaatgtgcaaacagcgcccggaaccttcaagacaccggagggcgaagtcggggctattgccctggactttaaacctggaacctctggctcccccatcgtgaaccgcgaggggaagattgttggactctacggcaatggcgtggtcacaacgagcgggacctatgtgtccgccatcgctcaggccaaagcgtctcaggagggacctctgcccgaaatcgaggatgaagttttccggaagagaaaccttacaattatggacctgcatcccggcagcgggaaaacccgccggtacctgcctgctatcgtgagagaggccattaagcgcaagctccggaccctgatccttgccccgacaagagtcgtggcttccgaaatggccgaggctctgaaaggaatgcccattcgctatcaaacgaccgccgttaagagcgagcacacaggcaaagaaatcgtggatctcatgtgccatgcgacctttacaatgcggctgctgtctcctgtcagagtgcccaattacaacatgatcattatggacgaggcccacttcaccgatccttccagcatcgctgcccgggggtatatttctacgcgcgtgggcatgggagaagctgccgccatctttatgacagctacaccccctggcagcatggaggcgttcccgcagtccaatgccgtcattcaggacgaagagagagatatccccgagcggtcttggaacagcgggtacgaatggatcaccgactttcctggaaagacagtttggttcgtgccctccattaaagctggcaatgatatcgccaactgtctccgcaagaatgggaagagagtgattcagctttctcggaaaaccttcgacacagagtatcaaaagaccaaaaacaacgattgggactacgtcgtgacgacagacatcagcgaaatgggagccaattttagagctgatcgcgttattgaccctcggagatgcctgaagcccgtgatcctgaaagatggcccggagcgcgtcattctcgccgggcctatgcccgtgaccgttgcgtccgctgcccagcggagaggccgcatcggacggaaccataataaggagggcgaccagtacatctatatggggcagcccctgaacaatgatgaagaccacgcccactggacagaggctaagatgcttctggataacattaatacccctgaaggaatcattcccgccctcttcgagcctgaaagagagaaaagcgcggccatcgacggcgagtaccgcctgagaggggaagctcggaagacgtttgtggagctgatgcgcagaggagatctcccggtctggctttcttataaagtggcctccgaaggcttccaatacagcgaccggcgctggtgctttgatggggagagaaacaatcaggtcctggaagagaacatggacgtggagatttggaccaaggaaggcgagcggaaaaagctgagaccccgctggctcgatgctcggacatattccgaccctctggcccttagagagttcaaagagtttgctgccggacgccggtctgttagcggcgacctgatcctcgaaatcgggaagctgccccagcatctgacccagagagcgcaaaatgccctcgataaccttgtgatgctgcacaattccgagcagggaggccgggcttaccgccatgccatggaggaactgcctgacacaattgagaccctcatgctgcttgctctgatcgccgtgctcacagggggagtcaccctgttctttctgtctggcaagggcctcgggaaaacgagcattggacttctgtgtgttatggcctccagcgtgctgctctggatggcttctgtggaaccccactggatcgcggcctccattatcctggagttctttcttatggtcctgctcatcccggagcctgatagacagcggacaccccaggacaaccaactggcttatgtggttattggcctcctcttcatgatccttaccgtggccgccaatgaaatggggctgctggagaccacaaagaaagatctcggaattggccacgtcgctgtggaaaaccatcaccatgccgcgatgctggacgtcgatcttcaccctgccagcgcttggaccctgtacgccgtggctacaacgatcattacccccatgatgcgccatacaatcgagaacaccacagccaatatttctctcaccgcgatcgccaaccaggctgccatcctgatggggctggacaagggatggcctatttccaaaatggatatcggcgttcccctccttgctctgggctgctacagccaggtgaatccgctgacgctcaccgccgctgtcctgatgcttgtggcccactatgcgattatcgggcctggactgcaagccaaggctacaagagaagcccagaagcggaccgctgccggcattatgaaaaaccccacaatcgacgggatcgttgccattgatctcgaccccgtggtctacgatgcgaagtttgagaaacagctgggacagatcatgctgctcattctttgtacctctcaaatcctgctgatgcgcacgacatgggctctctgcgagagcattaccctggccacaggccctcttaccaccctgtgggaagggtccccgggaaagttctggaatacaacgatcgctgtgtctatggccaacatcttcagaggcagctatctcgccggcgctgggctggccttttccctgatgaaaagcctcggaggcgggcggcgcggaaccggcgcgcagggggagacacttggagaaaagtggaagagacagctgaatcagctgtccaaatctgagttcaacacctacaagcggagcggcattatggaagtggacagatccgaggccaaagagggcctcaagcgcggggaaacaaccaaacacgctgtttctcggggaacggccaagctgagatggtttgtcgagcgcaatcttgtgaagcccgaaggcaaagtgatcgacctggggtgtggacggggcgggtggagctattactgcgctggactcaagaaagtcacagaggttaagggctataccaaaggcgggcctggacatgaagaacccattcctatggccacctacggctggaacctggtgaagctgcactccgggaaagatgtgttctttattccccctgagaagtgtgacacactcctttgcgatatcggagaatctagcccgaatcccaccatcgaggaaggcagaacactgcgcgtcctgaagatggtggagccttggctccgggggaaccaattctgtattaaaatcctgaatccctacatgccttccgttgtggagacgcttgaacagatgcagagaaagcatggaggcatgctggtccgcaaccccctcagcagaaattctacccacgagatgtattgggtgtcctgcggcacagggaacatcgttagcgcgattaatatgacctctagaatgctgctgaaccgctttacaatggcccaccggaaaccgacctacgaaagagacgtggatctcggagctggcacgcgccatgtcgccgtggagcctgaagtggctaacctggacatcattgggcagagaatcgagaatattaagcacgagcataaatccacctggcactatgatgaagacaacccctacaagacatgggcctatcatggaagctacgaggtcaagccctctggctccgctagctccatggttaatggggtggtgaaacttctgaccaagccttgggatgtcatccccatggtgacacaaatcgccatgaccgacacaacccctttcggacagcagcgggtttttaaagaaaaggtggatacgcgcacaccgaaagcgaagagaggcaccgcccaaattatggaggtcaccgctcggtggctctggggcttcctgagcagaaacaagaaaccccggatctgtacacgcgaagagtttacgagaaaggtgcggtctaatgccgctattggggccgttttcgtggacgagaaccagtggaatagcgccaaagaagcggtcgaggacgatcgcttttgggaccttgtgcacagagaacgggagctgcacaagcagggaaaatgcgctacctgcgtttataacatgatgggcaagcgcgaaaagaaactcggggagttcggaaaggccaaaggctccagagccatctggtacatgtggctgggggctcggttcctggagtttgaagccctcggcttcatgaatgaggatcattggttttctcgcgaaaacagcctgtccggagtggagggcgaggggcttcacaagctgggatacattctcagagacatctctaaaatccctggcgggaatatgtatgctgatgacacagccggatgggatacccggattacagaagacgatctgcagaacgaggcgaagatcaccgacattatggaacccgagcatgcccttctggctaaaagcatcttcaagctcacataccaaaataaggtcgtgcgcgtccagagacctgccaaaaacggcaccgtgatggatgttatttcccggcgcgaccagagagggtctggccaggtgggaacgtatggcctgaatacctttacaaacatggaagctcaactgatccggcagatggagagcgaggggatcttcctccccaacgaactggagaccccgaatcttgccggaagagtcctggattggctcgaaaagtacggcgtggagcgcctgaaacggatggcgatttccggggacgactgtgtggttaagcctatcgatgacagatttgccacagctcttaccgccctgaacgatatgggaaaagtgcgcaaggacattccccagtgggaacctagcaagggctggaatgattggcagcaagtccccttctgctctcaccactttcatcagctcatcatgaaagacgggcgggagattgtggttccttgtagaaaccaggatgagctggtgggccgcgctcgggtctcccagggagccggctggagcctgagagaaacggcttgcctcgggaagtcttatgcccaaatgtggcagctgatgtacttccaccgccgggaccttagactggcggccaatgctatctgttccgccgtgcccgtcgattgggtgccgacaagccgcaccacatggtccattcatgcccaccatcagtggatgaccacggaggacatgctctctgtttggaaccgggtgtggatcgaagagaatccttggatggaagataaaaccagaatcagctcctgggaggacgtcccctatctgggaaagcgggaggaccaatggtgcggcagccttattgggctgacagctagagccacctgggcgacaaacatccaggtggctattaatcaggttcgccggctcatcggaaacgaaaattactctgattacatgacctccatgaaaagatttaagaacgagagcgaacccgagggcgccctgtggtga

SEQ ID NO: 19195 - RNA, 9879 nt, synthetic construct
  misc_feature 1..9879: note = derived and/or modified CDS sequence (opt5) from DENV-1__GU131750__SS-prME
  source 1..9879: mol_type = other RNA
agcgtgaccatgctgctgatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaggaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccagacggccggaccttggcatctcggcaaactggagcttgattttgacctgtgcgaagggaccacagtggttgtggatgagcactgcggaaaccggggccccagcctcagaaccacaaccgtcacgggcaagatcatccacgaatggtgttgccggtcctgtacactgcctcccctgcgcttcagaggggaggacggatgctggtatggcatggagattcggccggtgaaagaaaaggaggaaaatcttgttaagagcatggtgtctgcggggtccggagaggtcgacagcttttccctcggcctgctgtgtatctctattatgatcgaagaggtgatgagaagccgctggtcccggaaaatgctcatgaccgggacactggctgttttctttcttctgattatgggacagctcacctggaacgatctgatcagactgtgcattatggtgggcgccaatgcctctgaccgcatgggcatggggaccacataccttgctctgatggccacgttcaagatgagacctatgtttgcggtcggactcctgttccggcgcctcaccagcagagaggtgctgcttctgacaatcggcctctccctggtggcttctgtcgaactgcccaacagccttgaggaactgggggatggactcgccatgggcatcatgattctgaaactcctgaccgactttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttgggagcctgggatgcaagccgctgacgatgtttctcatcgctgagaataaaatttggggccggcgctcttggcccctgaacgaaggcatcatggccgtcgggatcgtgtccattcttctgagctccctcctgaagaacgatgttcctctcgcgggacccctgatcgccggcgggatgcttattgcttgttacgtgatcagcggatctagcgccgacctgtccattgagaaagctgccgaggtctcttgggaagaggaagccgagcatagcggcgcttcccacaatatcctggtggaagttcaggatgacgggaccatgaagatcaaagatgaggagagagacgatacactcaccattctgcttaaggcgacactgctcgccgtgtctggagtctatcctctgagcatccccgctaccctcttcgtgtggtacttctggcagaaaaagaagcagcggtccggcgtcctgtgggacacgccttctcccccggaagtgggccgcgccgttcttgatgacgggatttatagaatcatgcagcggggactgctgggccgcagccaggtgggggtcggagtgtttcaagagaacgttttccataccatgtggcacgtgacaagaggcgccgtcctcatgtaccaggggaaacggctggaaccttcctgggctagcgtgaagaaagaccttatttcttacggaggcggctggagactgcaggggtcctggaataccggagaggaggtgcaggttatcgccgtcgaacccggcaagaaccctaaaaatgtgcaaacagcgcccgggacctttaagacaccggagggagaagtgggcgctattgccctcgatttcaagcctgggacgagcggatctcccatcgtcaaccgcgagggcaaaatcgtgggcctgtatgggaatggagttgtgaccacatccggcacctacgtcagcgccattgctcaggccaaggcgtcccaggaagggcctctccccgagatcgaggacgaagtgtttcggaaaagaaacctgaccattatggatcttcaccccggatctggcaagacacgccggtatctgcctgctatcgttagagaggccattaaacgcaagctgcggacgctcatcctggccccgaccagagtggtcgctagcgaaatggccgaggctcttaaggggatgcccatccgctaccaaacaaccgccgtgaaatccgaacatacaggcaaggagattgttgacctgatgtgccacgcgaccttcacgatgcggctcctgagccctgtgagagtccccaattataacatgatcattatggatgaggcccattttacagacccttcttccatcgctgcccggggatacattagcacccgcgtgggcatgggggaagctgccgccatcttcatgaccgctacaccccctggatctgtggaggcgtttccgcagagcaatgccgtcatccaggatgaagagagagacattcccgaacggtcctggaactctggctatgagtggatcaccgatttccctgggaaaacagtttggtttgtgcccagcattaagtccggaaatgacatcgctaactgtctgcgcaaaaatggcaagagagtgattcagctctctcggaagaccttcgatacggagtaccagaaaaccaagaacaacgactgggactacgtcgtgaccacagatatcagcgaaatgggggccaatttcagagccgaccgcgttattgatcctcggagatgccttaaacccgtgatcctgaaggacggcccggagcgcgtcatcctggctggacctatgcccgtgaccgttgcctccgcggctcagcggagaggccgcattgggcggaaccacaataaagaaggagatcagtatatctacatgggccagcccctcaacaatgacgaggatcatgcccactggacggaggccaagatgctgcttgacaacattaatacccctgaagggatcattcccgctctgtttgagcctgaaagagaaaagagcgccgcgatcgatggagaatatcgcctcagaggcgaggcccggaaaacattcgtggagctgatgcgcagaggggacctgccggtctggctctcttacaaggtggcttccgaaggctttcaatatagcgatcggcgctggtgcttcgacggagagagaaacaatcaggtccttgaagagaacatggatgtggaaatctggaccaaagagggcgagcggaagaaactgagaccccgctggctggacgcccggacatactccgaccctctcgctctgagagaatttaaggagttcgccgctgggcgccggtctgttagcggagatcttattctggaaatcggcaaactcccccagcacctgatgcagagagcccaaaatgcgctggacaacctcgtgatgcttcataattccgagcaagggggacgggcctatcgccacgctatggaggaactgcctgataccattgagacactgatgctcctggcccttatcgctgtgctgaccggcggcgtcacgctctttttcctgtctgggagaggactgggcaagacaagcattgggctcctttgtgttatggcctccagcgtgctgctgtggatggcctctgtggaaccccattggatcgctgcgtccatcattctcgagtttttcctgatggtccttctgatcccggaacctgaccggcagcgcacaccccaggataaccaactcgcctacgtggttattggactgctgtttatgatcctcaccgtggctgccaatgagatgggccttctggagacaaccaagaaagacctggggattggacacgtcgccgtggaaaaccaccatcacgctgccatgctcgatgtcgacctgcatcctgcgagcgcctggacactttacgctgtggccacgaccatcattacacccatgatgagacacaccatcgagaacacaaccgctaatatctctctgacggccattgcgaaccaggccgctatcctcatgggcctggataagggctggcctatttccaaaatggacatcggggttcccctgctcgcccttggatgctatagccaggtgaatccgctgaccctgacagctgccgtcctcatgctggtggctcattacgccattatcggccctgggcttcaagcgaaggccacccgggaagctcagaaacgcacagccgctggaatcatgaagaaccccaccgttgatggcattgtggccatcgacctggatcccgtcgtgtatgacgccaagttcgagaaacagctcgggcagattatgctgctgatcctctgtacgtctcaaattcttctgatgagaacaacctgggcgctgtgcgaaagcatcacactcgctaccggacctctgaccacactttgggagggctccccgggcaagttttggaatacgaccatcgccgtgtctatggctaacattttccgggggagctacctggccggagccggcctcgctttctccctgatgaaaagcctcgggggaggccgcagagggacaggagcccagggcgagaccctcggcgaaaagtggaaacggcagcttaatcagctgtccaagtctgagtttaacacatataagagaagcgggatcatggaagttgaccgctccgaggcgaaagaaggactgaagcggggcgagaccacgaaacacgccgtctctagagggacagctaagctccgctggttcgtggagcggaatctggtgaaacccgaaggaaaggtcattgatcttggctgtgggagaggaggctggagctactattgcgccggcctgaagaaagttaccgaggtgaaggggtacaccaaaggaggccctgggcacgaggagcccatccctatggctacatacggatggaacctcgtgaagctgcattccggcaaagacgtctttttcattccccctgaaaagtgtgataccctgctctgcgacatcggggagtctagcccgaatcccacaattgaggaaggacgcacgcttcgggtgctgaaaatggttgagccttggctgagaggcaaccaattttgtatcaagatcctcaatccctatatgccttccgtggtcgaaaccctggagcagatgcagcgcaagcacggcgggatgcttgtgcggaaccccctgagcagaaattctacacatgagatgtactgggtttcctgcggaaccggcaacattgtgagcgccgtcaatatgacatctcgcatgctcctgaaccggttcaccatggcgcacagaaaaccgacgtatgaacgcgatgtggacctgggggccggaaccagacacgtggctgtcgagcctgaagttgccaacctcgatatcattggccagcggatcgagaatattaagcatgaacacaaatccacatggcattacgacgaggataacccctataagacctgggcttaccacgggagctatgaggtgaaaccctctggatccgccagctccatggtgaatggcgtcgtgaagctgcttacaaagccttgggacgttatccccatggtgacccaaatcgctatgacagataccacgccttttggccagcagcgcgtcttcaaagaaaaggtggacacaagaaccccgaaagccaagcgggggaccgcgcaaattatggaggttacagccaaatggctgtggggatttctcagcagaaacaagaagccccggatctgtacgcgcgaagagttcaccagaaaagtgcggtctaatgctgccattggcgctgtctttgtggacgaaaaccagtggaatagcgccaaggaggccgttgaggatgaacgcttctgggacctggtgcatagagagcgggaacttcacaaacaggggaagtgcgcgacatgcgtctacaacatgatgggaaaacgcgagaagaagctgggcgaatttgggaaagctaagggctccagagccatctggtacatgtggctcggagcccggttcctggagttcgaggctctgggctttatgaatgaagatcactggttctctcgcgagaacagcctctccggggtggaaggagagggcctgcataaacttgggtatattctgagagacatctctaagatccctggaggcaatatgtacgccgatgacaccgctgggtgggatacacggattaccgaggacgatctccagaacgaagcccgcatcacagacaccatggagcccgaacacgcgctgcttgccaaaagcatttttaagctgacgtatcaaaataaagtcgtgagagttcagcggcctgctaagaacggcaccgtgatggatgtcatctcccgcagagaccagcggggatctggccaggtggggacatacggactcaataccttcacaaacatggaggcccaactgattagacagatggaaagcgagggcatcttttcccccagcgagctggaaaccccgaacctcgctgagcgcgtgctggattggcttgaaaagtatggggttgagcggctgaaaagaatggccatctctggagacgactgtgtggtcaagcctattgatgaccgcttcgcgacggccctcacagctctgaatgatatgggcaaagtgcggaaggacatcccccagtgggaaccttccaaagggtggaacgattggcagcaagttcccttttgcagccatcacttccaccagcttattatgaaggacggcagagagatcgtggtcccttgtcgcaatcaggatgagctggtgggacgggccagagtctctcagggcgctgggtggtccctccgcgaaaccgcctgcctgggaaagagctacgctcaaatgtggcagctgatgtattttcatcggagagacctccgcctggccgcgaacgccatttgttccgctgtgcccgttgattggatcccgacatctcggaccacgtggagcattcacgcccatcaccagtggatgaccacagaggacatgctttccgtgtggaatagagtctggatcgaagagaacccttggatggaagataaaacccatatcagctcttggggcgacgtgccctacctggggaagcgggaggaccaatggtgcggatccctcattggcctgacagccagagctacctgggccacaaatatccaggttgcgattaaccaggtgcgccggcttatcgggaatgagaactacctggattatatgaccagcatgaaaagattcaagaatgaatctgaccccgagggcgctctctggtga

SEQ ID NO: 19196 - RNA, 9879 nt, synthetic construct
  misc_feature 1..9879: note = derived and/or modified CDS sequence (opt5) from DENV-1__GU131751__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaagcagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccattgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgccaggaccttctggtgacctttaaaacagcgcacgccaagaagcaggaagtcgtggttctcggatcccaagagggcgctatgcacaccgccctgaccggggccacagaaatccagacgagcggaaccacaaccattttcgctggccatctgaaatgcagactcaagatggataaactgacacttaaggggatgtcttatgtgatgtgtaccggctccttcaaactggagaaggaagtcgccgagacgcagcacggaacagtgctcgttcagatcaagtacgagggcaccgacgcgccgtgcaaaatcccttttagcacccaagatgaaaagggggtgacacagaacggacggctgattaccgctaatcccatcgtcacagacaaagagaagcctgtgaacattgaagccgagccgcccttcggcgagtcttatatcgtgattggggccggagaaaaagctctgaaacttagctggtttaagaaaggctcctctatcgggaagatgttcgaggccacggctagaggcgcccgccggatggcgatcctcggagataccgcctgggactttggcagcattgggggagttttcacatccgtcggcaaactggtgcatcagatctttgggaccgcttacggagtgctgttcagcggcgtctcttggacaatgaagattgggatcggcgtgctcctgacctggcttggactcaattccagaagcacgtctctctccatgacctgtattgccgttggcctggtgacactgtaccttggggtcatggtgcaggctgatagcggatgcgttatcaactggaaaggccgcgaactcaagtgtgggtccggaatttttgtgaccaatgaggtccacacatggaccgaacaatataagttccaggccgactctcctaaacggctgagcgcggccatcggcaaggcttgggaggagggggtgtgcggcatcagatccgccacacgcctggaaaacattatgtggaaacagatctctaacgagctcaatcatattctgcttgaaaacgacatgaagtttaccgttgtggtcggagatgtggctggcatcctggcccaggggaaaaaggtgattcggccgcaacccatggagcacaaatacagctggaagtcctggggaaaggccaaaatcatcggcgctgacgtccagaatacgacattcattatcgatgggcctaacacccccgaatgtcctgacgatcagagagcgtggaatatttgggaggttgaggactatggatttggcatcttcaccacaaacatttggctcaagctgcgcgatagctacacccaggtgtgcgaccaccggctgatgtctgccgctatcagagattccaaagccgtgcatgccgacatgggctattggatcgaaagcgagaagaatgaaacgtggaaacttgctcgcgcctctttcattgaggtcaagacatgtatctggcccaagtcccacaccctctggagcaacggggtgctggaatctgagatgattatcccgaaaatttacggaggccctatcagccaacataattatcggcccgggtactttacacagaccgcgggaccttggcacctgggcaagctcgagctggatttcgacctttgcgaagggacaaccgttgtggtcgatgagcactgcggaaacagaggcccctccctgcggacgaccacagtgaccggcaaaatcattcatgaatggtgttgccgcagctgtacactccctcccctgagatttaagggggaggacggatgctggtacggcatggagatccggccggttaaagaaaaggaggaaaatctggtgaagtctatggtctccgctgggagcggagaggtggactccttctctcttggcctcctgtgtattagcatcatgattgaagaggttatgagatccaaatggtctcgcaagatgctgatgaccgggacgctcgccgtgtttttcctgcttatcatgggacagctgacatggaacgatctcattcggctgtgcatcatggtcggcgccaatgctagcgacagaatgggcatggggaccacatatctggcccttatggcgacctttaaaatgcgccctatgttcgctgtgggactgctctttagacggctgacctcccgcgaggtgctcctgcttacaatcggcctgtctctcgtcgccagcgttgaactgcccaactccctggaggaacttggggatggactggccatgggcattatgatcctcaagctgctcacggacttccaaagccaccagctgtgggctacccttctgtctctcacatttattaaaaccacattctccctgcattacgcctggaagaccatggctatggtgctgagcatcgtgtctctttttcccctgtgtctctccacgacaagccagaagaccacctggctgcctgtcctcctggggtctcttggatgcaaaccgctgacaatgttcctgattgccgagaataagatctggggcagaaaatcctggcccctcaacgaaggcatcatggcggtggggattgttagcatcctgctttccagcctgctcaagaacgatgtgcctctggccggacccctcattgctggcgggatgctgatcgcctgttatgtcatttctggaagctccgctgacctttctctggagaaagccgccgaggtgagctgggaagaggaagctgagcactccggcgcgtctcataatatcctggttgaagtgcaggatgacgggaccatgaagatcaaagatgaggagcgggacgatacactcacgattctgcttaaggccaccctgctcgctgtcagcggagtgtaccctctgtccatccccgccacactcttcgtctggtatttttggcaaaagaaaaagcagcgctctggcgtgctgtgggacattccttcccctcccgaagttgagagagccgtgcttgatgacggcatctaccggattatgcagcgcgggctgctgggaagatcccaggtcggcgtgggggttttccaagaaaacgtgtttcacaccatgtggcacgtcacacggggagctgtgctcatgtatcagggcaaacgcctggagcccagctgggcctctgtgaagaaagaccttatctcctacgggggaggctggagactgcagggcagctggaataccggggaggaagttcaggtcattgcggtggagcccggaaagaaccctaagaatgtgcaaacggctcccggcaccttcaaaacatctgaaggggaggtcggagccatcgccctcgattttaagccgggcacctccgggagccctatcgtgaaccgggaaggaaaaattgttggcctgtacggcaatggggtggtcacaacctccggaacatatgtgtctgctatcgcccaggcgaaggctagccaggagggccccctccctgagattgaagacgaggttttcaaaaagagaaacctgacgatcatggatcttcatcccgggtccggaaagacccgccggtacctgcccgccattgtgagagaagccatcaaacgcaagctgcggacactcatcctggctcctaccagagtcgtggccagcgagatggctgaagcccttaaaggcatgccgattcgctatcaaaccacagcggttaagtctgagcacacggggaaagagatcgtggacctgatgtgccatgccacctttacaatgcggctcctgtcccccgtcagagtgcctaattacaacatgattatcatggatgaagctcacttcaccgaccccagctctattgccgctcgcggctatatcagcacacgggtgggaatgggcgaggccgccgctatctttatgaccgcgacgcctcccgggtccgtcgaagccttccctcagtctaatgctgttattcaggatgaggaaagagacatcccggagcggagctggaactccggatacgagtggattacagattttcccggcaagaccgtgtggttcgtgccttctatcaagagcgggaatgacattgccaactgtctgcgcaaaaatggaaagagagtcatccagctctcccggaaaaccttcgatacagaatatcaaaagaccaaaaacaacgactgggactacgtggttacaaccgatattagcgagatgggcgccaattttcgcgctgacagagtgatcgatccccggagatgccttaagcctgtcatcctgaaggacgggcccgaacgcgtgattctggccggcccgatgcctgttacggtggcgtctgctgcccagcggagaggacgcatcggccggaaccataataaagagggggatcagtacatttatatgggacagcccctcaacaatgacgaggatcacgcccactggacagaagctaagatgctgcttgacaacatcaatacccccgagggcattatccctgccctgttcgaacccgagagagaaaaatccgcggccatcgatggggagtaccgcctccggggagaggctagaaagacatttgtcgaactgatgcgcagaggcgacctgcctgtgtggctcagctataaagtcgcctccgaggggttccaatactctgatcggcgctggtgctttgacggcgaaagaaacaatcaggtgcttgaggaaaacatggatgttgagatttggaccaaggagggagaacggaaaaagctgcgcccgagatggctggacgctcggacgtatagcgaccccctcgccctgagagagttcaaggaatttgctgccggccgccggtccgtgtctggggatcttatcctggagattggaaaactccctcagcatctgacccagagagcgcaaaatgccctggacaacctcgtgatgcttcacaatagcgaacagggcgggcgcgcttaccggcatgccatggaggagctgcccgatacaatcgaaaccctgatgctcctggctcttattgccgtcctgacaggaggcgttaccctcttctttctgtccggcagagggctgggaaagacaagcatcggcctcctttgtgtgatggcctcttccgtgctgctgtggatggctagcgtcgagcctcactggatcgcggcctctattatcctcgagttctttctgatggtgcttctgattcccgagccggaccggcagcgcacccctcaggataaccaactcgcttatgttgtgatcgggctgctgttcatgattctcacggtcgccgccaatgagatgggacttctggaaacaaccaaaaaggacctgggcatcgggcacgtggctgtcgagaaccatcaccatgccgcgatgctcgatgtggacctgcaccccgcctccgcttggaccctttacgccgttgctacaaccattatcacacctatgatgagacatacgatcgaaaacaccacagccaatattagcctgaccgcgatcgccaaccaggctgccattctcatgggactggataaaggctggcccatctctaagatggacattggcgtgcctctgctcgctcttgggtgctacagccaggtcaatcccctgacactgaccgccacggtgctcatgctggttgctcactatgccatcatcggaccgggccttcaagcgaaggccacccgggaggctcagaaacgcacagccgctgggattatgaagaaccctaccgtggatggaatcgtcgccattgacctggatcccgtggtgtacgacgccaaatttgaaaagcagctcggccagatcatgctgctgattctctgtacatcccaaatccttctgatgagaaccacgtgggcgctgtgcgagtctatcacactcgctaccgggcccctgacaaccctttgggagggaagccctggcaaattctggaataccacaattgccgtttccatggctaacatcttccggggcagctatctggccggggccggactcgctttttccctgatgaagtctctgggcgggggacgcagaggcacgggggcccagggagaaaccctcggcgagaagtggaaacggcagcttaatcagctgagcaagtccgagttcaacacatacaaacgctctggcattatggaggtcgacagaagcgaagcgaaggaggggctgaaacggggagagaccacaaagcacgccgtgtccagaggcaccgctaagctccgctggtttgtggaacggaatctggtcaaaccggaggggaaggttatcgatcttggatgtggcagagggggatggtcttattactgcgccggcctgaaaaaggtgacggaagtgaaaggctatacaaaagggggacccggccatgaggaacctattcccatggctacctacgggtggaacctcgtcaaactgcacagcggaaaggacgtgttctttatccctcccgagaagtgtgataccctgctctgcgacattggcgagtccagccctaatccgacaatcgaagaggggcgcacccttcgggttctgaaaatggtggaaccctggctgagaggaaaccaattctgtatcaagattctcaatccttacatgccctctgtcgtggagacactggagcagatgcagcgcaaacatggcggcatgcttgttcggaaccctctgtccagaaatagcacgcacgaaatgtattgggtgtcttgcgggaccggaaacatcgtctccgccgtgaatatgacaagccgcatgctcctgaaccggtttaccatggcgcacagaaagcccacatacgagcgcgatgtggacctgggcgccgggacccggcatgtcgctgttgaaccggaggtggccaacctcgatattatcggacagagaattgaaaatatcaaacacgagcataagtctacgtggcactatgacgaggataacccttacaagacctgggcttatcatggctcctacgaagtgaaacccagcgggtccgccagctctatggtcaatggagtggttaagctgcttacaaaaccctgggacgtgatccctatggtcacccaaattgctatgacagataccacacccttcggccagcagcgcgtgtttaaggagaaagttgacaccagaacgcctaaggccaagcggggcacagcgcaaatcatggaagtgaccgccaaatggctgtgggggttcctcagccgcaacaagaaaccgagaatttgtacccgggaggaatttacaagaaaggtccggtccaatgctgccatcggagctgtgttcgttgacgagaaccagtggaactctgccaaagaggccgtggaagatgagcgcttttgggacctggtccacagagaacgggagcttcacaagcagggcaagtgcgcgacgtgcgtgtataacatgatggggaaacgcgaaaagaaactgggagagttcggcaaggctaaagggagcagagccatttggtacatgtggctcggcgcccggttcctggagtttgaagctctgggattcatgaatgaggatcattggttttcccgcgaaaactctctcagcggcgtcgagggggagggactgcacaaacttggctacatcctgagagacatctccaaaattcccgggggaaatatgtatgccgatgacaccgctggctgggatacacggatcaccgaagacgatctccagaacgaggccaagattacagacatcatggaacctgagcatgcgctgcttgccaagtctattttcaaactgacctaccaaaataaggtggttcgcgtgcagagacccgctaaaaacgggacagtcatggatgtgatcagccggcgcgaccagagaggctccggacaggtgggcacctatgggctcaatacgtttaccaacatggaagcccaactgatccggcagatggagagcgagggaattttctctccttccgaactggagacacccaacctcgctggccgcgttctggattggcttgaaaagtacggggtggagagactgaaacggatggccatcagcggagacgactgtgtcgtgaagccgattgatgacagatttgcgaccgccctcacagctctgaatgatatgggcaaggttcgcaaagacatccctcagtgggaaccctctaaggggtggaacgattggcagcaagtgcctttctgctcccaccactttcatcagcttattatgaaagacggccgggagatcgtcgtgccctgtagaaatcaggatgagctggtcggacgcgcccgggtgagccagggcgctgggtggtccctcagagaaaccgcctgcctgggaaagtcttatgctcaaatgtggcagctgatgtacttccaccgccgggacctcagactggccgcgaacgccatttgtagcgctgttcctgtggattgggtccccacgtcccgcacaacctggagcatccatgcccaccatcagtggatgacaaccgaggacatgctttctgtgtggaatcgggtttggatcgaagagaacccgtggatggaagataaaacgcacatttccagctggggcgacgtgccttatctggggaagagagaggaccaatggtgcggatctctcatcggcctgaccgcccgcgctacatgggccaccaatattcaggtcgcgatcaaccaggtgcggagacttattgggaatgagaactacctggattacatgacaagcatgaagcggtttaaaaatgaatccgaccccgagggcgctctctggtga

SEQ ID NO: 19197 - RNA, 9879 nt, synthetic construct
  misc_feature 1..9879: note = derived and/or modified CDS sequence (opt5) from DENV-1__GU131753__SS-prME
  source 1..9879: mol_type = other RNA
agcgtgaccatgctgctcatgctgatgcccacagcccttgctttccacctgacgaccagaggcggggaacctcatatgatcgtgacaaagcaggaacggggaaaatccctcctgtttaagacctctgccggcgttaacatgtgcacacttattgccatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgaccgccctttttctggcgcatgccatcgggacctccattacacagaagggaatcatcttcattctcctgatgcttgtcacgccttctatggctatgagatgcgtgggcatcgggagccgggattttgttgagggactgtccggcgccacctgggtggacgtcgtgctcgagcacgggagctgtgtgacaaccatggctaaggataaacccacactggacattgaactgctcaagaccgaggtcacgaaccctgccgttctgcgcaaactttgcatcgaagcgaagatttctaatacaaccaccgattccagatgtccgacacaaggagaggccaccctgatggaagaacaagacgctaacttcgtgtgccggcgcacatttgtggatagaggctggggcaatgggtgtggactcttcggcaaagggagcctgatcacgtgcgccaagtttaagtgcgtcaccaaacttgagggaaagattgtgcagtacgaaaacctgaaatattctgttatcgtgacagtccacaccggcgaccagcatcaagtggggaatgagtccacagaacacggaaccacggctaccatcacaccccaggcccctaccagcgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcttccacatctcaagagacctggaatcgccaggacctgctcgtcaccttcaaaacagcgcacgccaagaagcaggaagtggtcgtgctgggaagccaagagggcgctatgcacacggccctgaccggggccacagaaatccagacctccggaacaaccacgatttttgctggccatctcaaatgcagactgaagatggataaacttacactgaaggggatgagctatgttatgtgtaccggctctttcaaactcgagaaggaagtggccgagacccagcacggaacagtcctggtgcagatcaagtacgagggcaccgacgcgccgtgcaaaattcctttctccacacaagatgaaaagggggttacgcagaacggacggctgatcaccgctaatcccatcattacagacaaagagaagcctgtgaacatcgaagccgagccgccctttggcgagagctatattgtcatcggggccggagaaaaagctcttaagctctcttggttcaagaaaggcagctccattgggaagatgtttgaggccaccgctagaggcgcccgccggatggcgatcctgggagatacagcctgggacttcggctctatcgggggagtgtttaccagcattggcaaactggtgcatcagatcttcgggacggcttacggagttctcttttccggcgtcagctggaccatgaagattgggatcggcgtgctgcttacatggctgggactcaattctagatccaccagcctgtctatgacatgtattgccgtgggcctggtcaccctttacctcggggtgatggttcaggctgattccggatgcgtgatcaactggaaaggccgcgaactgaagtgtgggagcggaattttcgtcacaaatgaggtgcacacctggacggaacaatataagtttcaggccgactcccctaaacggctgtctgcggccatcggcaaggcttgggaggagggggtttgcggcatcagaagcgccacacgcctcgaaaacattatgtggaaacagatctccaacgagctgaatcatattcttctggaaaacgacatgaagttcaccgtggtcgtgggagatgttgtgggcatcctcgctcaggggaaaaagatgattcggccgcaacccatggagcacaaatactcttggaaaagctggggaaaggccaagatcatcggcgccgacgtccagaataccacatttattatcgatgggcctaacacccccgaatgtcctgacgatcagagagcttggaatatttgggaggtggaggactatggattcggcatctttacgacaaacatttggctgaagatgcgcgattcctacacccaggtgtgcgaccaccggctgatgagcgcggccatcaaagattctaaggctgtccatgccgacatgggctattggatcgaatccgagaaaaatgaaacatggaaacttgccagagctagcttcattgaggttaagacctgtatctggcccaaatctcacacactctggtccaacggggtgctggaaagcgagatgattatcccgaagatttacggaggccctatctctcaacataattatcgccccgggtacttcacccagacggccggaccttggcacctgggcaaactcgagctggattttgacctttgcgaagggaccacagtggtcgtggatgagcactgcggaaaccggggccccagcctgagaaccacaaccgttacgggcaagatcattcatgaatggtgttgccggtcctgtacactccctcccctgcgcttcaaaggggaggacggatgctggtacggcatggagatcagaccggtgaaggaaaaggaggaaaatctggtcaaaagcatggtgtctgcggggtccggagaggttgacagcttttcccttggcctcctgtgtatttctatcatgattgaagaggtgatgcggagcagatggtcccgcaagatgctgatgaccgggacactcgctgtcttcctgcttctgatcatgggacagctcacctggaacgatctgattcggctgtgcatcatggtgggcgccaatgcctctgacagaatgggcatggggaccacatatcttgctctgatggccacgtttaaaatgcgccctatgttcgcggttggactcctgtttagacggctcaccagccgcgaggtgctgcttctgacaatcggcctctccctggtcgcttctgtggaactgcccaacagccttgaggaactgggggatggactcgccatgggcattatgatcctgaagctcctgaccgacttccaatcccaccagctttgggccacactgctcagcctgacctttattaaaacgacactgtctcttcattacgcttggaagaccatggccatggtgctgtccatcgtcagcctcattcccctgtgtctctctaccacatcccagaagaccacatggctgcctgttcttctggggagcctgggatgcaaaccgctcacgatgttcctgatcgctgagaataagatctggggcagaaaatcttggccccttaacgaaggcattatggccgtgggggtggtctccatcctgctcagctccctgctcaagaacgatgtgcctctggcgggaccccttattgccggcgggatgctgatcgcttgttatgttattagcggatctagcgccgacctgtccctcgagaaagctgccgaggtgtcttgggaagaggaagccgagcacagcggcgcttcccataatatcctggtcgaagtgcaggatgacgggaccatgaagatcaaagatgaggagcgggacgatacacttaccattctgctcaaggcgacactgctcgccgtttctggagtgtaccctctgagcatccccgctaccctttttgtctggtatttctggcaaaagaaaaagcagcgctccggcgtgctgtgggacacgccttctcccccggaagtcgagagagccgtgctggatgacggcatttaccggatcatgcagcgcgggctcctgggaagaagccaggttggcgtgggggtctttcaagaaaacgtgttccacaccatgtggcacgttacacggggagccgtgcttatgtatcagggcaaacgcctggagccttcctgggctagcgtcaagaaagacctcatttcttacgggggaggctggagactgcagggctcctggaataccggggaggaagtccaggtgatcgccgttgagcccggaaagaaccctaagaatgtccaaacagcgcccggcaccttcaaaacaccggaaggggaggtgggagctattgccctcgattttaagcctggcacgagcgggtctcccatcgtgaaccgggaaggaaaaatcgtcggcctgtacggcaatggggtggttaccacatccggaacctatgtgagcgccattgctcaggccaaggcgtcccaggagggccctcttcccgagatcgaagacgaggtcttcagaaaacgcaacctgaccattatggatctgcatcccgggtctggaaagacacggagatacctccctgctatcgtgcgcgaagccatgaagcggaaactgagaacgcttattctggccccgacccgcgttgtggctagcgagatggccgaagctctcaagggcatgcccatccggtatcaaacaaccgccgtcaaatccgagcacacagggaaggagatcgtggacctgatgtgccatgcgacctttacgatgagactgctcagccctgttcgcgtgcccaattacaacatgattatcatggatgaagcccacttcacagacccttcttccattgctgcccggggctatatcagcaccagagtcggaatgggcgaggctgccgccatttttatgaccgctacaccccctgggtctgtggaagcgttcccgcagagcaatgccgtgatccaggatgaggaacgggacatccccgagcgctcctggaactctggatacgagtggattaccgattttcctggcaaaacagtctggttcgttcccagcatcaagtccgggaatgacattgctaactgtcttagaaagaatggaaaacgggtgatccagctgtctcgcaagacctttgatacggaatatcagaagacaaagaacaacgactgggactacgtggtcaccacagatattagcgagatgggcgccaatttcagagccgaccgggtgatcgatcctagacgctgcctgaaacccgttattctcaaggacgggccggaacgggtgatcctggctggccctatgcccgtcaccgtggcctccgcggctcagagacgcggacggatcggcagaaaccataataaggagggggatcagtacatttatatgggacagccccttaacaatgacgaggatcacgcccactggacggaagccaaaatgctgctcgacaacatcaatacccctgagggcattatccccgctctgtttgaacctgagcgcgaaaagagcgccgcgattgatggggagtaccggctgagaggagaggcccgcaaaacattcgttgaactcatgagacggggcgaccttccggtgtggctgtcttataaggtcgcttccgaggggttccaatacagcgatcgcagatggtgctttgacggcgaacggaacaatcaggtgctggaggaaaacatggatgtcgagatctggaccaaagagggagaacgcaagaaactcagaccccggtggctggacgccagaacatattccgaccctcttgctctgcgcgagttcaaggaatttgccgctggccggagatctgtgagcggggatctcatcctggagattggaaagctgccccagcatctcacccagcgcgcccaaaatgcgcttgacaacctggttatgctgcacaattccgaacagggcgggcgggcctacagacatgctatggaggagctccctgatacaatcgaaaccctgatgcttctggccctcattgctgtgctgacgggaggcgtgacactgttctttctctctggccgggggcttggaaaaaccagcatcggcctgctgtgtgtcaccgcctccagcgttctcctgtggatggcctctgtggagccccactggattgctgcgtccatcatccttgagttctttctgatggtgctcctgattccggagcctgaccgccagagaacaccccaggataaccaactggcctatgtcgtgatcgggctccttttcatgattctgaccgttgctgccaatgagatgggactgctcgaaacaacgaagaaagacctgggcatcgggcacgtggccgtcgagaaccatcaccatgctaccatgcttgatgtggacctgcaccctgccagcgcgtggacactctacgccgtcgctaccacaattatcacccccatgatgcggcatacgattgaaaacaccacagccaatatctctctgaccgctatcgccaaccaggcggccattctgatgggactcgataagggctggcctatctccaaaatggacattggcgtgccccttctggctctggggtgctacagccaggttaatccgctcacactgaccgccgctgtgcttatgctggtcgcccactatgctatcattggacctggcctccaagccaaggcgacgcgcgaggcccagaagagaacagctgccgggatcatgaaaaaccccaccgtggatggaatcgttgctattgacctggatcccgtggtctacgacgccaagtttgaaaaacagctgggccagatcatgctccttattctgtgtacatctcaaatcctgctcatgcggaccacctgggccctgtgcgagagcattacacttgcgacggggcctctgaccacactctgggagggatccccgggcaagttctggaataccacaatcgctgtgtctatggccaacatctttcgcggcagctatctggctggggccggactggccttctccctcatgaaaagccttggcgggggaagacggggcaccggggctcagggagaaacgctgggcgagaagtggaagcgccagctgaatcagctctccaaatctgaatttaacatttacaagagaagcggcatcatggaggtggaccggtccgaagccaaagaggggctgaagagaggagagacaaccaaacacgcggtttctcgcggcaccgccaaacttcggtggttcgtcgaaagaaatctggtgaagcccgaggggaaagtgattgatctcggatgtggccgcgggggatggagctattactgcgctggcctgaagaaagtcacagaagttaagggctataccaaagggggacctggccatgaggaacccatccctatggccacatacgggtggaacctggtgaagctccactccggaaaagacgtgttctttacgccccctgagaagtgtgatacccttctgtgcgacattggcgagtctagcccgaatcccacaatcgaagaggggcggaccctgagagtcctcaagatggtggaaccttggctgcgcggaaaccaattctgtattaaaatccttaatccctacatgccttccgttgtggagacactggagcagatgcagcggaagcatggcggcatgctcgtcagaaaccccctgagccgcaattctacccacgaaatgtattgggtgtcctgcgggacgggaaacatcgttagcgctgtgaatatgacctctcggatgctgctcaacagatttacaatggcccaccgcaaaccgacctacgagaaggatgtcgacctgggcgcggggacacggcatgtggccgtggaacctgaggtcgctaaccttgatattatcggacagagaattgaaaatatcaaacacgagcataagtccacctggcactatgacgaggataacccctacaagacatgggcctatcatggcagctacgaagttaaaccctctgggtccgctagctccatggtgaatggagtggtcaagctgctcaccaaaccttgggacgtgattcccatggttacgcaaatcgccatgacagataccacccctttcggccagcagcgcgtgtttaaggagaaagtcgacacaagaacgccgaaggctaagcggggcaccgtgcaaatcatggaagttacagcccgctggctgtgggggttccttagcagaaacaaaaagccccggatttgtaccagagaggaatttacacggaaagtgcgctctaatgcggccatcggagctgtcttcgtggacgagaaccagtggaatagcgccaaggaggctgttgaagatgagagattttgggacctggtgaaaaaggaacgggagctccacaagcagggcaaatgcgcgacctgcgtctataacatgatggggaagcgcgagaagaagctgggagagttcggcaaagccaaggggtccagagcgatttggtacatgtggctgggcgctcggtttctcgagttcgaagccctgggatttatgaatgaggatcactggttctctcgcgaaaacagcctttccggcgtggagggggagggactgcataaactcggctacatcctgagagacatttctaagatccctgggggaaatatgtatgccgatgacacagctggctgggatacccggatcacggaagacgatcttcagaacgaggccaagattaccgacatcatggaacccgagcacgctctgctcgccacaagcattttcaaactgacctaccaaaataaggtcgtgcgcgttcagagacctgcgaaaaacgggacagtgatggatgtcatctcccggcgcgaccagagaggctctggacaggtgggcacctatgggctgaatacgtttacaaacatggaagcccaactcattcggcagatggagagcgagggaatcttcctgccctccgaacttgagaccccgaacctggctgaacgcgtgtttgattggctcgagaagtacggcgttgaaagactgaaacggatggccatcagcggggacgactgtgtggtcaagcctattgatgacagattcgctacagcccttaccgcgctgaatgatatgggaaaggtgcgcaaagacatcccccagtgggagccttctaagggctggaacgattggcagcaagttcccttttgctcccatcacttccaccagctcattatgaaagacgggcgggagatcgtggtcccttgtagaaatcaggatgaactggtgggccgcgcccgggtcagccagggagctggctggtctctgagagagacggcctgcctcgggaagtcctatgctcaaatgtggcagctgatgtactttcatcgccgggaccttagactggccgctaacgccatttgtagcgcggtgcccgttgattgggtgccgacctcccgcacaacctggtctatccacgcccatcaccagtggatgacaaccgaagacatgctcagcgtctggaatcgggtgtggattgaggaaaacccttggatggaggataaaacacatgtttccagctggggagacgtgccctatctgggcaagagagaggaccaatggtgcgggtctcttatcggactgaccgctcgcgccacgtgggcctccaatatccaggtcgctattaaccaggtgcggagactcatcggcaatgaaaactacctggattacatgacaagcatgaagcggttcaaaaatgagggggaccccgaaggcgccctgtggtga

SEQ ID NO: 19198 - RNA, 9879 nt, synthetic construct
  misc_feature 1..9879: note = derived and/or modified CDS sequence (opt5) from DENV-1__GU131754__SS-prME
  source 1..9879: mol_type = other RNA
agcgtgaccatgctgctgatgctgatgcccacggcccttgctttccacctgacgaccagaggcggggagcctcatatgatcgtctccaagcaggaacggggaaagtctctcctgtttaagacaagcgccggcgttaatatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagataagcctgtgaacatcgaggccgaaccgcccttcggcgagtcttatattgtgatcggggccggagagaaagctctgaaacttagctggtttaagaaaggctcctctattgggaagatgttcgaagccaccgctagaggcgcccgccggatggcgatcctcggagacacagcctgggattttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgacagcggatgcgttgtgaactggaaaggccgcgagctcaagtgtgggtccggaatttttgtcacaaatgaagtgcacacctggacagagcaatataagttccaggccgactctcctaaacggctgagcgcggccatcggcaaggcttgggaagagggggtttgcggcattagatccgccacccgcctggagaacatcatgtggaaacagatctctaacgaactcaatcatattctgcttgagaacgatatgaagtttacggtggtcgtgggagacgtggctggcatcctggcccaggggaaaaagatgattcggccgcaacccatggaatacaaatatagctggaagtcctggggaaaggccaaaatcattggcgctgatgtccagaatacaaccttcatcatcgacgggcctaacacccccgagtgtcctgatgaccagagagcgtggaatatttgggaagttgaggattacggatttggcatcttcacaaccaacatttggctcaagctgcgcgacagctatacacaggtgtgcgatcaccggctgatgtctgccgctatcaaagactccaaggccgtgcacgccgatatgggctactggattgagagcgagaagaatgagacatggaaacttgctagagcctctttcatcgaagtcaagacctgtatctggcccaaatcccatacactctggagcaacggggtgctggagtctgaaatgattatcccgaagatttatggaggccctatcagccaacacaattaccgccccgggtactttacccagacagcgggaccttggcatctgggcaaactcgagctggacttcgatctttgcgaggggaccacggttgtggtcgacgaacactgcggaaaccggggcccctccctgagaaccacaaccgtgacaggcaagattatccacgagtggtgttgccggagctgtaccctccctcccctgcgctttaaaggggaagacggatgctggtatggcatggagatcagaccggttaaggagaaggaagagaatctggtgaaatctatggtctccgctgggagcggagaagtggattccttctctcttggcctcctgtgtattagcatcatgattgaggaagttatgcggtccagatggtctcgcaagatgctgatgacggggacactcgccgtgtttttcctgcttatcatgggacagctgacctggaacgacctcattcggctgtgcatcatggtcggcgccaatgctagcgatagaatgggcatggggacaacctacctggcccttatggcgacctttaaaatgcgccctatgttcgctgtgggactgctctttagacggctgacatcccgcgaggtgctcctgcttacgattggcctgtctctcgtcgccagcgttgagctgcccaactccctggaagaacttggggacggactggccatgggcatcatgatcctcaagctgctcaccgatttccaaagccatcagctgtgggctacacttctgtctctcacctttattaaaacaaccttctccctgcactatgcctggaagacgatggctatggtgctgagcatcgtgtctctttttcccctgtgtatgtccacaaccagccagaagaccacatggctccctgtcctgctcgggtctctgggatgcaaaccgcttaccatgttcctgattgccgaaaataagatctggggcagaaaatcctggcccctgaacgagggcattatggcggtggggatcgttagcatcctcctgtccagccttctgaagaacgacgtgcctctcgccggacccctgattgctggcgggatgctcatcgcctgttacgtcatttctggaagctccgctgatctgtctcttgaaaaagccgccgaggtgagctgggaggaagaggctgaacattccggcgcgtctcacaatatcctggttgaggtgcaggacgatgggacaatgaagattaaagacgaagaacgggatgacacgctgaccatcctcctgaaggccacacttctggctgtcagcggagtgtatcctctctccatccccgccaccctgttcgtctggtacttttggcaaaagaaaaagcagcgctctggcgtgctctgggatacaccttcccctcccgaggttgaaagagccgtgctggacgacggcatttatcggatcatgcagcgcgggcttctgggaagatcccaggtcggcgtgggggttttccaagagaacgtgtttcataccatgtggcacgtcacgcggggagctgtgctgatgtaccagggcaaacgcctcgaacccagctgggcctctgtgaagaaagatctgatttcctacgggggaggctggagacttcagggcagctggaataccggggaggaggttcaggtcatcgcggtggaacccggaaagaaccctaagaatgtgcaaacagctcccggcaccttcaaaacatctgagggggaagtcggagccattgccctggactttaagccgggcacctccgggagccctatcgtgaaccgggagggaaaaattgttggcctctatggcaatggggtggtcacaacgtccggaacctacgtgtctgctatcgcccaggcgaaggctagccaggaaggccccctgcctgagatcgaggatgaagttttcagaaaacgcaacctcacaattatggacctgcaccccgggtccggaaagacccggagatatcttcccgccatcgtgcgcgaggccattaagcggaaactgagaaccctgatcctcgctcctacacgcgtcgtggccagcgaaatggctgaggccctgaagggcatgccgattcggtaccaaacgaccgcggttaaatctgaacatacagggaaggagatcgtggatcttatgtgccacgccacctttacaatgagactgctctcccccgtccgcgtgcctaattataacatgatcattatggacgaggctcatttcaccgatcccagctctatcgccgctcggggctacattagcacgagagtgggaatgggcgaagccgccgctatctttatgacagcgacccctcccgggtccgtcgaggccttccctcagtctaatgctgttattcaggacgaggaacgggatatcccggaacgcagctggaactccggatatgagtggatcaccgactttcccggcaaaacagtgtggttcgtgccttctattaagagcgggaatgatatcgccaactgtctgagaaagaatggaaaacgggtcattcagctgtcccgcaagaccttcgacacagagtaccagaagaccaagaacaacgactgggattacgtggttacgacagacatcagcgaaatgggcgccaattttagagctgatcgggtgattgaccccagacgctgcctcaaacctgtcatccttaaggatgggcccgagcgggtgattctggccggcccgatgcctgttaccgtggcgtctgctgcccagagacgcggacggatcggcagaaaccacaataaggaaggggaccagtatgtctacatgggacagcccctgaacaatgatgaggaccatgcccactggacagaggctaaaatgctcctggataacatcaatacccccgaaggcattatccctgcccttttcgagcccgaacgcgagaagtccgcggccattgacggggaatatcggctgagaggagaggctcgcaaaacgtttgtggagctcatgagacggggcgatctgcctgtctggctgagctacaaggtggcctccgaagggttccaatattctgaccgcagatggtgctttgatggcgagcggaacaatcaggttctcgaagagaacatggacgtggaaatctggaccaaagagggagagcgcaagaaacttagaccgcggtggctggacgctagaacatacagcgatcccctggccctccgcgagttcaaggagtttgctgccggccggagatccgtgtctggggacctgattcttgaaatcggaaagctgcctcagcacctcacccagcgcgcgcaaaatgccctggataacctggtcatgctccataatagcgagcagggcgggcgggcttatagacacgccatggaggaacttcccgacacaatcgagaccctgatgctgctcgctctgattgccgttcttacaggaggcgtgaccctgttctttctctccggccgggggctgggaaaaacgagcatcggcctgctctgtgtgatggcctcttccgcccttctgtggatggcgagcgtcgaacctcattggattgccgcttctatcattctggagttctttctcatggtgctgcttatccccgaaccggatcgccagagaacacctcaggacaaccaactggcctacgttgtgatcgggctcctgttcatgattctgaccgtcgccgctaatgagatgggactccttgagaccacaaagaaagatctgggcatcgggcacgtggccgtcgaaaaccaccatcacgcggccatgctggacgtggatctccatcccgcttccgcctggaccctgtacgctgttgccacaacgattatcacccctatgatgcggcacacaattgagaacaccacagcgaatatcagccttaccgccattgctaaccaggccgctatcctgatgggactcgacaagggctggcccatctctaaaatggatattggcgtgcctctgctggccctcgggtgctatagccaggtcaatccccttacgctgaccgctgccgtgctgatgctcgttgcgcattacgccatcattggaccgggcctgcaagctaaggccacacgcgaagctcagaagagaaccgccgccgggatcatgaaaaaccctacagtggacggaattgtcgcgatcgatcttgaccccgtggtgtatgacgctaagtttgagaaacagctgggccagatcatgctcctgattctgtgtacctcccaaatcctccttatgcggacgacatgggccctgtgcgaatctattaccctggctacagggcccctcaccaccctgtgggagggaagccctggcaagttctggaatacaacgatcgccgtttccatggccaacattttccgcggcagctaccttgctggggccggactggcgttttccctcatgaaatctctgggcgggggaagacggggcaccggggcccagggagagacactgggcgaaaagtggaagcgccagctcaatcagcttagcaaatccgagttcaacacctataagagatctggcatcatggaagtcgatcggagcgaggctaaagaagggctgaagagaggagagacaaccaaacacgccgtgtcccgcggcacggctaagctgcggtggtttgtggagagaaatctcgtcaagccggaagggaaagttatcgacctgggatgtggccgcgggggatggtcttactattgcgccggccttaagaaagtgacagaggtgaagggctacaccaaagggggacccggccacgaggaacctattcccatggcgacctacgggtggaacctggtcaagctccatagcggaaaagatgtgttctttatccctcccgaaaagtgtgacacactgctgtgcgatattggcgagtccagccctaatccgaccatcgaggaagggcggacactcagagttcttaagatggtggagccctggctgcgcggaaaccaattctgtattaaaatcctgaatccttatatgccctctgtcgtggaaacgctcgagcagatgcagcggaagcacggcggcatgctggttagaaaccctctttcccgcaatagcacccatgagatgtactgggtgtcttgcgggacaggaaacattgtctccgccgtgaatatgaccagccggatgctgctcaacagatttacaatggctcaccgcaaacccacctatgaacgggacgtggatctgggcgccgggacgagacacgtcgctgttgagccggaagtggccaacctggacatcatcggacagcgcattgagaatatcaagcatgaacacaaatctacctggcattacgatgaggacaacccttataagacatgggcttaccacggctcctatgaggtgaagcccagcgggtccgccagctctatggtcaatggagtggttaaactcctgaccaagccctgggatgtgattcctatggtcacacaaatcgcgatgaccgacacaacccccttcggccagcagagagtgtttaaagaaaaggttgacacgcggacacctaaagccaagcgcggcaccgctcaaattatggaggtgaccgccaagtggctttgggggttcctgagcagaaacaaaaagccgcggatctgtacaagagaagagtttacgcggaaagtccgctccaatgctgccatcggagccgtgttcgttgatgaaaaccagtggaactctgcgaaggaggctgtggaggacgaaagattttgggatctcgtccatcgggagcgcgaactgcacaaacagggcaagtgcgctacctgcgtgtacaacatgatggggaagagagagaagaaacttggagagttcggcaaagccaaagggagccgggctatttggtacatgtggctgggcgcccgcttcctcgagtttgaggctctgggattcatgaatgaagaccactggttttccagagagaactctctgagcggcgtcgaaggggagggactccataaactgggctatatccttcgggatatttccaagatccccgggggaaatatgtacgccgacgatacagcgggctgggacacccgcattacagaggatgacctgcagaacgaagccaaaatcaccgatatcatggagcctgaacacgctctcctggccaagtctattttcaaacttacatatcaaaataaagtggttagagtgcagcggcccgctaagaacgggaccgtcatggacgtgatcagccgcagagatcagcggggctccggacaggtgggcacgtacgggctgaatacctttacaaacatggaggcccaactcattcgccagatggaaagcgagggaatcttctctccttccgagctggaaacccccaacctggcgggcagagttctcgactggctggagaaacatggggtggaacggcttaagagaatggccattagcggagacgattgtgtcgtgaaaccgatcgacgatcgctttgctacagccctgaccgctctcaatgacatgggcaaggttcggaaggatatccctcagtgggagccctctaaagggtggaacgactggcagcaagtgcctttctgctcccaccactttcatcagctgattatgaaggatggcagagaaatcgtcgtgccctgtcgcaatcaggacgagcttgtcggacgggccagagtgagccagggcgctgggtggtccctgcgcgagacggcctgcctcggaaaatcttatgcgcaaatgtggcagctgatgtacttccaccggagagatctgcgcctcgccgctaacgccatttgtagcgccgttcctgtggactgggtccccacatcccggaccacatggagcatccatgctcaccatcagtggatgaccacggaagatatgctgtctgtgtggaatagagtttggattgaggaaaacccgtggatggaggacaagacccacatctccagctggggcgacgtgccttatcttgggaaacgcgaagatcaatggtgcggatctctgattggcctcacagcccgggcgacctgggctacaaatatccaggtcgccatcaaccaggtgagacggctgattgggaatgagaactaccttgactacatgaccagcatgaagagatttaagaatgagtccgatcccgaaggcgccctgtggtga

SEQ ID NO: 19199 - RNA, 9879 nt, synthetic construct
  misc_feature 1..9879: note = derived and/or modified CDS sequence (opt5) from DENV-1__GU131755__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagagcaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattaccccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagcccccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattccggggggaggacggatgctggtatggcatggagattagaccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatccggcctatgtttgcggtcggactcctgttccgcagactcaccagccgggaggtgctgcttctgacaatcggcctctccctggtggcttctgtcgaactgcccaacagccttgaggaactgggggatggactcgccatgggcattatgatcctgaagctcctgaccgactttcaatcccatcagctttgggccacactgctcagcctgaccttcattaaaacgacattttctctgcactgtgcttggaagaccatggccatggttctttccatcgtgagcctgttccccctctgcctgtctaccacatcccagaaaaccacatggctccctgtgctgcttgggagcctgggatgtaagccgctgacgatgtttctcattgctgagaataagatctggggccgcagatcttggcccctgaacgaaggcatcatggccgtcgggattgtgtccatccttctgagctccctcctgaaaaacgatgttcctctcgcgggacccctgattgccggcgggatgcttatcgcttgctatgtgattagcggatctagcgccgacctgtccctggagaaggctgccgaggtctcttgggaagaggaagccgagcatagcggcgcttcccacaatatcctcgtggaagttcaggatgacgggaccatgaaaatcaaggatgaggagcgggacgatacactgaccattcttctgaaagcgacactcctggccgtgtctggagtctaccctctcagcatccccgctaccctgttcgtgtggtatttctggcaaaagaaaaagcagcgctccggcgtcctttgggacacgccttctcccccggaagtggagagagccgttctggatgacggcatttaccggatcatgcagcgcgggctgctcggaagaagccaggtgggcgtcggggtgtttcaagaaaacgttttccataccatgtggcacgtgacacggggagccgtcctgatgtatcagggcaagagacttgagccttcctgggctagcgtgaaaaaggacctgatttcttacgggggaggctggcgcctccagggctcctggaataccggggaggaagtgcaggttatcgccgtcgagcccggaaaaaaccctaagaatgtgcaaacagcgcccggcacctttaaaacaccggaaggggaggtgggagctattgccctggatttcaagcctggcacgagcgggtctcccatcgtcaaccgggaaggaaagatcgtgggcctctacggcaatggggttgtgaccacatccggaacctatgtcagcgccattgctcaggccaaagcgtcccaggagggccctctgcccgagatcgaagacgaggtgtttagaaagcgcaaccttaccattatggatctgcaccccgggtctggaaaaacacggagatacctgcctgctatcgttcgcgaagccattaagcggaaactcagaacgctgatccttgccccgacccgcgtggtcgctagcgagatggccgaagctctgaagggcatgcccatccggtatcaaacaaccgccgtgaagtccgagcatacagggaaagagattgttgacctcatgtgtcacgcgaccttcacgatgagactgctgagccctgtgcgggtccccaattacaacatgatcattatggatgaagcccattttacagacccttcttccatcgctgcccgcggctatattagcaccagagtgggaatgggcgaggctgccgccatcttcatgaccgctacaccccctgggtctgtggaagcgtttccgcagagcaatgccgtcatccaggatgaggaacgggacattcccgagcgctcctggaactctggatacgagtggatcaccgatttccctggcaagacagtttggtttgtgcccagcattaaatccgggaatgacatcgctaactgcctcagaaagaatggaaaacgggtgattcagctttctagaaagaccttcgatacggaatatcaaaagacaaaaaacaacgactgggactacgtcgtgaccacagatatcagcgagatgggcgccaatttccgcgccgaccgggttattgatcctagacgctgcctgaagcccgtgatcctgaaagacgggccggaacgggtcatcctcgctggccctatgcccgtgaccgttgcctccgcggctcagagacgcggacggattggcagaaaccacaataaggagggggatcagtacatctatatgggacagcccctgaacaatgacgaggatcatgcccactggacggaagccaaaatgcttctggacaacattaatacccctgagggcatcattcccgctctctttgaacctgagcgcgaaaagagcgccgcgatcgatggggagtacagactgcggggagaggcccgcaagacattcgtggaactgatgagacggggcgacctcccggtctggctttcttataaagtggcttccgaggggtttcaatacagcgatcgcagatggtgtttcgacggcgaacggaacaatcaggtcctggaggaaaacatggatgtggagatctggaccaaggagggagaaagaaaaaagctgcgcccccggtggctcgacgccagaacatattccgaccctctggctcttcgcgagtttaaagaattcgccgctggccggagatctgttagcggggatctgattctcgagatcggaaagctgccccagcacctgacccagcgggcccaaaatgcgctcgacaaccttgtgatgctgcataattccgaacagggcgggcgcgcctacagacacgctatggaggagctgcctgatacaattgaaaccctcatgctgcttgccctgatcgctgtgctcacgggaggcgtcacactgtttttcctgtctggccgggggctcggaaaaaccagcattggccttctgtgcgttatggcctccagcgtgctgctctggatggcctctgtggagccccattggatcgctgcgtccatcattctggaatttttccttatggtcctgctcatcccggagcctgacaagcagcgcaccccccaggataaccaactggcctatgtggttattgggctgctctttatgatccttacagtggctgccaatgagatgggactgctggaaaccacaaagaaagacctcggcattgggcacgtcgccgtggagaaccaccatcacgctgccatgctggatgtcgaccttcatcctgcgagcgcctggacgctgtacgctgtggccaccacaatcattacccccatgatgagacacacaatcgaaaacaccacggctaatatctctctcaccgccattgcgaaccaggccgctatcctgatgggactggataagggctggcctatttccaaaatggacatcggcgttcccctccttgccctggggtgttacagccaggtgaatccgctgacactcaccgctgccgtcctgatgcttgtggctcattatgccattatcggacctggcctgcaagcgaaggccacacgggaggctcagaaacgcaccgccgctgggatcatgaagaaccccacggttgatggaattgtggccatcgacctcgatcccgtcgtgtacgacgccaagttcgaaaaacagctgggccagattatgctgctcatcctttgcacatctcaaattctgctgatgagaaccacatgggcgctctgtgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggttgaccgctccgaagcgaaagaggggctcaagcggggagagacgacaaaacacgccgtctctagaggcaccgctaagctgcgctggttcgtggaacggaatcttgtgaaacccgaggggaaggtcattgatctgggatgcggcagagggggatggagctattactgtgccggcctcaagaaagttaccgaagtgaagggctatacaaaagggggacctggccacgaggaacccatccctatggctacctacgggtggaacctggtgaagctgcattccggaaaagacgtctttttcattccccctgagaagtgcgatacactcctttgtgacatcggcgagtctagcccgaatcccacgattgaagaggggcgcaccctgcgggtgctgaaaatggttgaaccttggctcagaggaaaccaattttgcatcaagatcctgaatccctacatgccttccgtggtcgagacacttgagcagatgcagcgcaagcacggcggcatgctggtgcggaaccccctcagcagaaattctacccatgaaatgtattgggtttcctgtgggacaggaaacattgtgagcgccgtcaatatgacctctcgcatgctgctgaaccggttcacgatggcgcacagaaaaccgacctacgagcgcgatgtggacctcggcgccgggacaagacacgtggctgtcgaacctgaggttgccaacctggatatcattggacagcggatcgaaaatattaagcatgagcacaaatccacctggcattatgacgaggataacccctacaagacatgggcttatcacggcagctacgaagtgaaaccctctgggtccgccagctccatggtgaatggagtcgtgaagcttctgaccaagccttgggacgttatccccatggtgacacaaatcgctatgaccgatacgacaccttttggccagcagcgcgtcttcaaagagaaggtggacaccagaaccccgaaagccaagcggggcacagcgcaaattatggaagttacggccaaatggctctgggggtttctgagcagaaacaagaagccccggatctgcacccgcgaggaattcacaagaaaagtgcggtctaatgctgccattggagctgtctttatcgacgagaaccagtggaatagcgccaaggaggccgtggaagatgagcgcttctgggaccttgttcatagagaacgggagctgcacaaacagggcaagtgcgcgacctgtgtgtataacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtcgagggggagggacttcataaactgggctacatcctcagagacatctctaagattcctgggggaaatatgtatgccgatgacacagctggctgggatacccggatcacagaagacgatctgcagaacgaggcccgcattaccgacatcatggaacccgagcacgcgcttctggccaaaagcatttttaagctcacgtaccaaaataaagtggtcagagtgcagcggcctgctaagaacgggaccgttatggatgtgatctcccgcagagaccagcggggctctggacaggtcggcacatatgggctgaataccttcacaaacatggaagcccaactgatcagacagatggagagcgagggaattttttcccccagcgaactcgagaccccgaacctggctgaacgcgtgcttgattggctggagaagtacggcgtggaacggctcaaaagaatggccatctctggggacgactgcgttgtgaagcctattgatgaccgcttcgcgacggccctgacagctcttaatgatatgggaaaagtccggaaggacatcccccagtgggagccttccaaaggctggaacgattggcagcaagtgcccttttgtagccatcacttccaccagctgattatgaaggacgggagagagatcgttgtgccttgccgcaatcaggatgaactcgtcggccgggccagagtgtctcagggagctggctggtccctgcgcgagaccgcctgtctggggaagagctatgctcaaatgtggcagctcatgtactttcatcggagagacctgcgccttgccgcgaacgccatttgctccgctgtccccgtggattggatcccgacatctcggaccacgtggagcatccacgcccatcaccagtggatgaccacagaagacatgctgtccgtttggaatagagtgtggattgaggaaaacccttggatggaggataaaacccatatcagctcttggggagacgtcccctatctcggcaagcgggaggaccaatggtgtgggtccctgattggacttacagccagagctacctgggccacaaatatccaggtggcgattaaccaggttcgccggctgatcggcaatgaaaactacctcgattacatgaccagcatgaaaagattcaagaatgagtctgaccccgaaggggctctgtggtga

SEQ ID NO: 19200 - RNA, 9879 nt, synthetic construct
  misc_feature 1..9879: note = derived and/or modified CDS sequence (opt5) from DENV-1__GU131756__SS-prME
  source 1..9879: mol_type = other RNA
agcgtgaccatgctgctgatgctgatgcccacagcccttgctttccacctgacgacccggggaggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgccttctttcttctgattatgggacagctcacctggaacgatctgatccggctgtgcattatggttggcgctaatgccagcgacagaatgggcatggggacaacctaccttgcgctgatggctaccttcaaaatgcgccctatgtttgccgtgggactcctgttcagacggctcacatcccgcgaggtcctgcttctgacgatcggcctctctctggtggccagcgtggaactgcccaactcccttgaggaactgggggatggactcgctatgggcatcatgattctgaagctcctgaccgactttcaaagccatcagctttgggccacactgctctctctgaccttcatcagaacaaccttttccctgcactatgcttggaaaacgatggccatggtccttagcattgtttctctgttccccctctgtctgtccacaaccagccagaagaccacatggctccctgtgctgcttgggtctctgggatgcaagccgctgaccatgtttctcatcgcggagaataaaatttggggccggaagtcctggcccctgaacgaaggcatcatggccgtggggatcgtcagcattcttctgtccagcctcctgaaaaacgatgtgcctctcgctggacccctgatcgccggcgggatgcttattgcttgttacgttatctctggaagctccgccgacctgtctctggagaaggccgctgtggtcagctgggaggaagaggcggaacattccggcgcctctcacaatattctcgtggaggttcaggatgacgggacaatgaaaatcaaggatgaagaaagagacgatacgctgaccatccttctgaaagctacactcctggccgtgagcggagtctatcctctctccattcccgccaccctgttcgtgtggtacttctggcaaaagaagaaacagagatctggcgtcctttgggacacaccttcccctcccgaggtggaacgggctgttctggatgacggcatctatcgcattatgcagagagggctgctcggacggtcccaggtgggcgtcggggtgtttcaagagaacgttttccataccatgtggcacgtgacgcgcggagccgtcctgatgtaccagggcaagagacttgaacccagctgggcgtctgtgaaaaaggacctgatctcctacgggggaggctggcggctccagggcagctggaataccggggaggaggtgcaggttattgctgtcgaacccggcaagaatcctaagaatgtgcaaacagcccccggcacctttaagacatctgagggggaagtgggagccatcgctctggatttcaaaccgggcacctccgggagccctattgtcaacagagagggaaagatcgtgggcctctatggcaatggggttgtgacaacgtccggaacctacgtctctgccatcgcgcaggctaaagccagccaggaaggccccctgcctgagattgaggacgaagtgtttcgcaagcggaaccttacaatcatggatctgcaccccgggtccggaaaaaccagacgctatctgcccgccattgttcgggaggctatcaagagaaagctccgcaccctgattcttgcccctacacgggtggtcgctagcgaaatggccgaggcgctgaaaggcatgccgatcagataccaaacgaccgccgtgaagtctgaacatacagggaaagagatcgttgacctcatgtgccacgctaccttcacaatgcgcctgctgtcccccgtgcgggtccctaattataacatgattatcatggatgaggcccattttaccgaccccagctctattgctgccagaggctacatcagcacgcgggtgggaatgggcgaagccgctgcgattttcatgacagccacccctcccgggtccgtggaggcttttcctcagtctaatgccgtcatccaggatgaggaacgcgacatcccggaaagaagctggaactccggatatgagtggattaccgatttccccggcaagacagtttggtttgtgccttctatcaaaagcgggaatgacattgccaactgtctccggaagaatggaaagcgcgtgatccagctttccagaaaaaccttcgatacagagtaccaaaagaccaaaaacaacgactgggactacgtcgtgacgacagatattagcgaaatgggcgctaatttccgggccgacagagttatcgatccccgccggtgcctgaagcctgtgattctgaaagacgggcccgagagagtcatcctcgcgggcccgatgcctgtgaccgttgcttctgccgcccagcgccggggaagaatcggccgcaaccacaataaggaaggggatcagtatatttacatgggacagcccctgaacaatgacgaggatcatgctcactggacagaggccaagatgcttctggacaacatcaatacccccgaaggcattatccctgcgctctttgagcccgaacgggagaaatccgccgctattgatggggaatatagactgcgcggagaggccagaaagacgttcgtggagctgatgcggcgcggcgacctccctgtctggcttagctacaaagtggcttccgaagggtttcaatattctgatagacggtggtgcttcgacggcgagcgcaacaatcaggtcctggaagagaacatggatgtggaaatctggaccaaggagggagagcgcaagaagctgcggccgagatggctcgacgcccgcacatacagcgaccccctggcccttcgggaatttaaagagttcgccgcgggcagacgctccgtttctggggatctgatcctcgaaattggaaagctgcctcagcacctgacccagcgggcccaaaatgctctcgacaaccttgtgatgctgcataatagcgagcagggcgggagagcctatcggcacgctatggaggaactgcccgatacaatcgagaccctcatgctgcttgccctgattgccgtgctcacaggaggcgtcaccctgtttttcctgtccggccgcgggctcggaaagacgagcatcggccttctgtgtgttatggcttcttccgtgctgctctggatggcgagcgtggaacctcattggattgccgcttctatcatcctggagtttttccttatggtcctgctcattcccgaaccggacagacagcggacacctcaggataaccaactggcctacgtggttatcgggctgctctttatgattcttaccgtggccgctaatgagatgggactgctggagaccaccaagaaggacctcggcatcgggcacgtcgccgtggaaaaccaccatcacgcggccatgctggatgtcgaccttcatcccgcttccgcctggaccctgtacgctgtggccacaacgattatcacccctatgatgcgccacacaattgagaacaccacagcgaatatcagcctcaccgccatcgctaaccaggccgctattctgatgggactggataaaggctggcccatctctaagatggacattggcgttcctctccttgccctggggtgctatagccaggtgaatcccctgacgctcaccgctgccgtcctgatgcttgtggcgcattacgccatcattggaccgggcctgcaagctaaagccacaagagaagctcagaagcggaccgccgccgggatcatgaagaaccctacagttgatggaatcgtggcgattgacctcgatcccgtcgtgtatgacgctaaattcgagaagcagctgggccagatcatgctgctcattctttgtacctcccaaatcctgctgatgcgcacgacatgggccctctgcgaatctattaccctggctacagggccccttaccaccctgtgggagggaagccctggcaaattttggaatacaacgatcgccgtgtccatggccaacatcttcagaggcagctacctcgctggggccggactggcgttctccctgatgaagtctctcggcgggggacggcgcggcaccggggcccagggagagacacttggcgaaaaatggaagagacagctgaatcagctgagcaagtccgagtttaacacctataaacggtctggcattatggaagttgacagaagcgaggctaaggaagggctcaaacgcggagagacaaccaagcacgccgtctcccggggcacggctaaactgagatggttcgtggagcgcaatcttgtgaagccggaagggaaggtcatcgatctgggatgtggcagagggggatggtcttactattgcgccggcctcaaaaaggttacagaggtgaaaggctacaccaaagggggacccggccacgaggagcctattcccatggcgacctacgggtggaacctggtgaaactgcatagcggaaaggacgtctttttcatccctcccgaaaaatgtgatacactcctttgcgacattggcgagtccagccctaatccgaccatcgaggaagggagaacactgcgcgtgctgaagatggttgagccctggctccggggaaaccaattttgtattaagatcctgaatccttatatgccctctgtggtcgaaacgcttgagcagatgcagagaaaacacggcggcatgctggtgcgcaaccctctctcccggaatagcacccatgagatgtactgggtttcttgcgggacaggaaacatcgtgtccgccgtcaatatgaccagcagaatgctgctgaaccgcttcacaatggctcaccggaagcccacctatgaaagagatgtggacctcggcgccgggacgcgccacgtggctgtcgagccggaagttgccaacctggatattatcggacagagaattgagaatatcaaacatgaacacaagtctacctggcattacgacgaggataacccttataaaacatgggcttaccacggctcctatgaggtgaagcccagcgggtccgccagctctatggtgaatggagtcgtgaaacttctgaccaaaccctgggacgttattcctatggtgacacaaatcgcgatgaccgatacaaccccctttggccagcagcgggtcttcaaggaaaaagtggacacgcgcacacctaaggccaaaagaggcaccgctcaaatcatggaggttaccgccaagtggctctgggggtttctgagccggaacaagaaaccgagaatttgtacacgggaagagttcacgcgcaaggtgagatccaatgctgccatcggagccgtctttgtggacgaaaaccagtggaactctgcgaaagaggctgttgaggatgaacggttctgggaccttgtgcatcgcgagagagaactgcacaagcagggcaaatgcgctacatgcgtctacaacatgatggggaagcgggagaagaaactcggagaatttggcaaggccaaagggagccgcgctatttggtacatgtggctgggcgccagattcctggagttcgaggctctcggatttatgaatgaagatcactggttctcccgggagaactctctgagcggcgtggaaggggagggacttcataagctgggctatatcctccgcgacatttccaaaatccccgggggaaatatgtacgccgatgacacagcgggctgggataccagaatcacagaggacgatctgcagaacgaagccaagattaccgacatcatggagcctgaacacgcccttctggccaaatctatttttaagctcacatatcaaaataaggtcgtgcgggttcagcgccccgctaaaaacgggaccgtgatggatgtcatcagcagacgggaccagcgcggctccggacaggtgggcacgtacgggctgaataccttcacaaacatggaggcccaactgattagacagatggaaagcgagggaatcttttctccttccgagctcgaaacccccaacctggcgggccgggtgcttgattggctggagaagcatggggttgaaagactcaaacgcatggccatcagcggagacgactgtgtggtcaagccgattgatgaccggttcgctacagccctgaccgctcttaatgatatgggcaaagtgagaaaggacatccctcagtgggagccctctaaggggtggaacgattggcagcaagttcctttttgctcccaccacttccatcagctgattatgaaagacggccgcgaaatcgtggtcccctgtcggaatcaggatgagctcgtgggcagagctcgcgtcagccagggagctgggtggtccctgcgggagacggcctgcctgggaaagtcttatgcgcaaatgtggcagctcatgtactttcacagacgcgacctgcggcttgccgctaacgccatttgtagcgccgtgcctgttgattgggtgcccacatccagaaccacatggagcatccatgctcaccatcagtggatgaccacggaagacatgctgtctgtctggaatcgcgtgtggattgaggaaaacccgtggatggaggataaaacccacatctccagctggggcgacgttccttatctcgggaagcgggaagaccaatggtgcggatctctgatcggccttacagccagagcgacctgggctacaaatattcaggtggccatcaaccaggtccggagactgctcgggaatgagaactacctggattacatgaccagcatgaaacgcttcaagaatgagtccgaccccgaaggcgccctgtggtga

SEQ ID NO: 19201 - RNA, 9879 nt, synthetic construct
  misc_feature 1..9879: note = derived and/or modified CDS sequence (opt5) from DENV-1__GU131758__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaagtgcccgagaatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgtgccgtgcaagattccttttagcacccaggatgaaaaaggggtcacacaaaacggacggctgatcacggcgaatcccatcgtgaccgacaaggagaaacctgtgaacattgaagctgagccgcccttcggcgagtcttatatcgttattggggccggagaaaaggccctgaaacttagctggtttaaaaagggctcctctatcgggaaaatgttcgaggctacagccagaggcgctcgccggatggccattctcggagataccgcgtgggactttggcagcatcgggggagtcttcacatccgtgggcaagctggtgcatcagatctttgggaccgcctacggagtcctgttcagcggcgtgtcttggacgatgaaaattgggatcggcgttctcctgacctggcttggactcaattccagaagcacatctctctccatgacctgtattgctgtgggcctggtcacactgtaccttggggtgatggttcaggccgatagcggatgcgtgatcaactggaagggccgcgaactcaagtgtgggtccggaatttttgtcaccaatgaggtgcacacatggaccgaacagtataaattccaagctgactctcctaagcggctgagcgccgcgatcggcaaagcctgggaggagggggtttgcggcattagatccgctacgcgcctggaaaacatcatgtggaagcagatctctaacgagctcaatcatattctgcttgaaaacgacatgaaatttacagtggtcgtgggagatgtggccggcatcctggctcaggggaagaaaatgattcggccgcagcccatggagtacaagtatagctggaagtcctggggaaaagccaagatcattggcgccgacgtccaaaataccaccttcatcatcgatgggcctaacacacccgaatgtcctgacgatcagagagcttggaatatttgggaggttgaggactacggatttggcatcttcaccacgaacatttggctcaaactgcgcgatagctatacacaggtgtgcgaccaccggctgatgtctgcggccatcaaggattccaaagctgtgcacgccgacatgggctactggattgaaagcgagaagaatgaaacctggaaacttgccagagcttctttcatcgaggtcaaaacatgtatctggcccaagtcccataccctctggagcaacggggtgctggaatctgagatgattatcccgaaaatttatggaggccctatcagccagcacaattaccgccccgggtactttacacaaaccgccggaccttggcatctgggcaagctcgagctggatttcgacctttgcgaagggacgaccgttgtggtcgatgagcactgcggaaaccggggcccctccctgagaacaaccacagtgaccggcaaaattatccacgaatggtgttgccggagctgtacgctccctcccctgcgctttaagggggaggacggatgctggtatggcatggagatcagaccggttaaggaaaaagaggaaaatctggtgaagtctatggtctccgcggggagcggagaggtggactccttctctcttggcctcctgtgtattagcatcatgattgaagaggttatgcggtccagatggtctcgcaaaatgctgatgacagggaccctcgctgtgtttttcctgcttatcatgggacagctgacatggaacgatctcattcggctgtgcatcatggtcggcgccaatgccagcgacagaatgggcatggggaccacctacctggctcttatggccacatttaagatgcgccctatgttcgcggtgggactgctctttagacggctgacgtcccgcgaggtgctcctgcttaccattggcctgtctctcgtcgctagcgttgaactgcccaactccctggaggaacttggggatggactggccatgggcatcatgatcctcaaactgctcacagacttccagagccatcaactgtgggccacccttctgtcttttacattcattaagaccacgttttccctccactatgcttggaagacaatggccatggtgctgagcatcgtgtctctgttccccctttgtctgtccaccaccagccagaaaacaacctggctccctgtcctgctcgggtctctgggatgcaagccgcttacaatgttcctgattgctgagaataaagtgtggggcagaaagtcctggcccctgaacgaaggcatcatggccgttgggattgtgagcatcctcctgtccagccttctgaaaaacgatgtccctctcgcgggacccctgatcgccggcgggatgctcattgcttgttacgtgatctctggaagctccgccgacctgtctcttgagaaggctgccgaggttagctgggaagaggaagccgagcattccggcgcttctcacaatattctggtggaagtccaggatgacgggacgatgaaaatcaaggatgaggagcgggacgataccctgacaattctcctgaaggcgacccttctggccgtgagcggagtctatcctctctccatccccgctacactgtttgtgtggtacttctggcagaaaaagaaacaacgctctggcgttctctgggacaccccttcccctcccgaagtggagagagccgtcctggatgacggcatctatcggattatgcagcgcgggcttctgggaagatcccaggtgggcgttggggtgtttcaggaaaacgtcttccatacgatgtggcacgtgacccggggagccgtgctgatgtaccaaggcaagcgcctcgagcccagctgggcttctgttaaaaaggacctgatctcctacgggggaggctggagacttcagggcagctggaatacaggggaggaagtccaggtgattgccgtggagcccggaaagaaccctaaaaatgtccagaccgcgcccggcacatttaagacctctgaaggggaggtgggagctatcgccctggatttcaaaccgggcacatccgggagccctattgttaaccgggaaggaaagatcgtgggcctctatggcaatggggtcgtgacgacctccggaacatacgtttctgccattgctcaagccaaagcgagccaggagggccccctgcctgagatcgaagacgaggtgtttagaaagcgcaacctcaccatcatggatctgcaccccgggtccggaaagacccggagatatcttcccgctattgtccgcgaagccatcaaacggaagctgagaacactgattctcgcccctacgcgcgtggttgctagcgagatggccgaagctctgaaaggcatgccgatccggtaccagaccacagccgtgaagtctgagcataccgggaaagagattgtcgaccttatgtgccacgcgacattcaccatgagactgctctcccccgtgcgcgtgcctaattataacatgatcatcatggatgaagcccattttacggaccccagctctattgctgcccggggctacatcagcacaagagtcggaatgggcgaggctgccgccattttcatgaccgctacccctcccgggtccgttgaagcgtttcctcaatctaatgccgtgatccaggatgaggaacgggacattccggagcgcagctggaactccggatatgagtggatcacagatttccccggcaagaccgtgtggttcgtcccttctatcaagagcgggaatgacattgctaactgtctgcgcaagaatggaaagcgggtgatccagctgtcccgcaaaacatttgataccgaataccagaagacgaaaaacaacgactgggactacgttgtgacaaccgatattagcgagatgggcgccaatttcagagccgaccgggtcatcgatcccagacgctgcctcaagcctgtgattcttaaggacgggcccgaacgggttatcctggctggcccgatgcctgtgacagtcgcctctgcggctcaaagacgcggacggattggcagaaaccacaataaagagggggatcagtatatctacatgggacagcccctgaacaatgacgaggatcatgcccactggaccgaagccaagatgctcctggacaacatcaatacgcccgagggcattatccctgctctttttgaacccgagcgcgaaaaatccgccgcgattgatggggagtatcggctgagaggagaggcccgcaagaccttcgtggaactcatgagacggggcgacctgcctgtctggctgagctacaaagtggcttccgaggggtttcagtattctgatcgcagatggtgcttcgacggcgaacggaacaatcaagttctcgaggaaaacatggatgtggagatctggacaaaggagggagaacgcaagaaacttagaccgcggtggctggacgccagaacctacagcgaccccctggctctccgcgagtttaaagagttcgccgctggccggagatccgtgtctggggatctgattcttgagatcggaaaactgcctcagcacctcacacagcgcgcccagaatgcgctggacaacctggtcatgctccataatagcgaacaaggcgggcgggcctatagacacgctatggaggagcttcccgataccatcgaaacactgatgctgctcgccctgattgctgttcttaccggaggcgtgacgctgtttttcctctccggccgggggctgggaaagacaagcatcggcctgctctgtgtgatggcctcttccgtccttctgtggatggccagcgtggagcctcattggattgctgcgtctatcattctggaatttttcctcatggttctgcttatccccgagccggaccgccagagaacccctcaggataaccagctggcctacgtggtcatcgggctcctgtttatgattctgaccgtggctgccaatgagatgggactccttgaaacaaccaaaaaggacctgggcatcgggcacgccgctgtcgagaaccaccatcacgccgcgatgctggatgtggacctccatcccgcctccgcttggacactgtacgccgttgctacgaccattatcacacctatgatgcggcacaccattgaaaacacaaccgccaatatcagccttacggcgattgccaaccaagctgccatcctgatgggactcgataaaggctggcccatctctaagatggacattggcgtgcctctgctggctctcgggtgctatagccaggtcaatccccttaccctgacagccgctgtgctgatgctcgttgcccattacgcgatcattggaccgggcctgcaggccaaggctacccgcgaggcccagaagagaacagctgccgggatcatgaagaaccctaccgtggatggaattgtcgccatcgaccttgatcccgtggtgtatgacgcgaaattcgaaaagcagctgggccagatcatgctcctgattctgtgtacgtcccagatcctccttatgcggacaacctgggctctgtgcgagtctattacactggccaccgggcccctcaccacactgtgggagggaagccctggcaaattctggaatacgaccatcgctgtttccatggccaacatttttcgcggcagctaccttgccggggctggactggccttctccctcatgaagtctctgggcgggggaagacggggcacaggggcgcaaggagaaaccctgggcgagaagtggaaacgccagctcaatcagcttagcaagtccgaatttaacacatataaaagatctggcatcatggaggtcgaccggagcgaagccaaggaggggctgaaaagaggagagaccacgaagcacgctgtgtcccgcggcacagccaagctgcggtggttcgtggaaagaaatctcgtcaaaccggaggggaaggttatcgatctgggatgtggccgcgggggatggtcttactattgcgctggccttaaaaaggtgaccgaagtgaaaggctacaccaaagggggacccggccacgaggaacctattcccatggccacatacgggtggaacctggtcaaactccatagcggaaaggacgtgtttttcatccctcccgagaagtgtgataccctgctgtgcgacattggcgagtccagccctaatccgacaatcgaagaggggcggacgctcagagttcttaaaatggtggaaccctggctgcgcggaaaccagttttgtattaagatcctgaatccttatatgccctctgtcgtggagaccctcgagcaaatgcagcggaaacacggcggcatgctggttagaaaccctctttcccgcaatagcacacatgaaatgtactgggtgtcttgcgggaccggaaacattgtctccgcggtgaatatgacaagccggatgctgctcaacagattcaccatggcccaccgcaagcccacgtatgagcgggatgtggacctgggcgctgggaccagacacgtcgccgttgaaccggaggtggctaacctggatatcatcggacagcgcattgaaaatatcaaacatgagcacaagtctacatggcattacgacgaggataacccttataagacctgggcctaccacggctcctatgaagtgaaacccagcgggtccgctagctctatggtcaatggagtggttaagctcctgacaaaaccctgggacgtgattcctatggtcacccagatcgccatgacagataccacgccctttggccaacagagagtgttcaaggagaaagttgacacacggacccctaaggcgaagcgcggcaccgcccagattatggaagtgacagctaaatggctttgggggtttctgagcagaaacaagaaaccgcggatctgtacgagagaggagttcacccggaaggtccgctccaatgccgctatcggagccgtgtttgttgacgagaaccaatggaactctgccaaagaggcggtggaagatgagagattctgggacctcgtccatcgggaacgcgagctgcacaagcagggcaagtgcgctacatgcgtgtacaacatgatggggaaaagagaaaagaaacttggagagttcggcaaggccaaagggagccgggccatttggtacatgtggctgggcgctcgctttctcgagttcgaagccctgggatttatgaatgaggatcactggttctccagagaaaactctctgagcggcgtcgagggggagggactccataagctgggctatatccttcgggacatttccaaaatccccgggggaaatatgtacgctgatgacaccgccggctgggatacacgcattaccgaagacgatctgcagaacgaggcgaagatcacagacatcatggaacctgagcacgccctcctggctaagtctatttttaaacttacctatcagaataaggtggttagagtgcaacggcccgccaaaaacgggacggtcatggatgtgatcagccgcagagaccagcggggctccggacaggtgggcacctacgggctgaatacattcaccaacatggaagctcagctcattcgccaaatggagagcgagggaatcttttctccttccgaactggagacacccaacctggccggcagagttctcgattggctggaaaagcatggggtggagcggcttaaaagaatggcgattagcggagacgactgtgtcgtgaagccgatcgatgaccgcttcgccaccgctctgacggccctcaatgatatgggcaaggttcggaaagacatccctcagtgggaaccctctaaggggtggaacgattggcaacaggtgcctttttgctcccaccacttccatcaactgattatgaaagacggcagagagatcgtcgtgccctgtcgcaatcaggatgagcttgtcggacgggctagagtgagccagggcgccgggtggtccctgcgcgaaacagcttgcctcggaaagtcttatgcccagatgtggcaactgatgtactttcaccggagagacctgcgcctcgcggccaacgctatttgtagcgccgttcctgtggattgggtccccacctcccggacaacctggagcatccatgcccaccatcagtggatgacgaccgaggacatgctgtctgtgtggaatagagtttggattgaagagaacccgtggatggaagataaaacacacatctccagctggggcgacgtgccttatcttgggaagcgcgaggaccagtggtgcggatctctgattggcctcaccgctcgggccacatgggcgaccaatatccaagtcgctatcaaccaggtgagacggctgattgggaatgagaactaccttgattacatgacaagcatgaagagattcaaaaatgaatccgaccccgagggcgccctgtggtga

SEQ ID NO: 19202 - RNA, 9879 nt, synthetic construct
  misc_feature 1..9879: note = derived and/or modified CDS sequence (opt5) from DENV-1__GU131759__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtcttttacattcattaagaccacgttttccctccactatgcctggaagacaatggctatggttctgagcatcgtgtctctgttccccctttgtctgtccaccaccagccagaaaacaacctggctccctgtgctgctcgggtctctgggatgcaagccgcttacaatgttcctgattgccgagaataaagtctggggcagaaagtcctggcccctgaacgaaggcatcatggcggtggggattgttagcatcctcctgtccagccttctgaaaaacgatgtgcctctcgccggacccctgatcgctggcgggatgctcattgcctgttacgtcatctctggaagctccgctgacctgtctcttgagaaggccgccgaggtgagctgggaagaggaagctgagcattccggcgcgtctcacaatattctggttgaagtgcaggatgacgggacgatgaaaatcaaggatgaggagcgggacgataccctgacaattctcctgaaggccacccttctggctgtcagcggagtgtatcctctctccatccccgccacactgtttgtctggtacttctggcagaaaaagaaacaacgctctggcgtgctctgggacaccccttcccctcccgaagttgagagagccgtgctggatgacggcatctatcggattatgcagcgcgggcttctgggaagatcccaggtcggcgtgggggtttttcaggaaaacgtgttccatacgatgtggcacgtcacccggggagctgtgctgatgtaccaaggcaagcgcctcgagcccagctgggcctctgtgaaaaaggacctgatctcctacgggggaggctggagacttcagggcagctggaatacaggggaggaagttcaggtcattgcggtggagcccggaaagaaccctaaaaatgtgcagaccgctcccggcacatttaagacctctgaaggggaggtcggagccatcgccctggatttcaaaccgggcacatccgggagccctattgtgaaccgggaaggaaagatcgttggcctctatggcaatggggtggtcacgacctccggaacatacgtgtctgctattgcccaagcgaaagctagccaggagggccccctgcctgagatcgaagacgaggtttttagaaagcgcaacctcaccatcatggatctgcaccccgggtccggaaagacccggagatatcttcccgccattgtgcgcgaagccatcaaacggaagctgagaacactgattctcgctcctacgcgcgtcgtggccagcgagatggctgaagccctgaaaggcatgccgatccggtaccagaccacagcggttaagtctgagcataccgggaaagagattgtggaccttatgtgccacgccacattcaccatgagactgctctcccccgtccgcgtgcctaattataacatgatcatcatggatgaagctcattttacggaccccagctctattgccgctcggggctacatcagcacaagagtgggaatgggcgaggccgccgctattttcatgaccgcgacccctcccgggtccgtcgaagcctttcctcaatctaatgctgttatccaggatgaggaacgggacattccggagcgcagctggaactccggatatgagtggatcacagatttccccggcaagaccgtgtggttcgtgccttctatcaagagcgggaatgacattgccaactgtctgcgcaagaatggaaagcgggtcatccagctgtcccgcaaaacatttgataccgaataccagaagacgaaaaacaacgactgggactacgtggttacaaccgatattagcgagatgggcgccaatttcagagctgaccgggtgatcgatcccagacgctgcctcaagcctgtcattcttaaggacgggcccgaacgggtgatcctggccggcccgatgcctgttacagtggcgtctgctgcccaaagacgcggacggattggcagaaaccacaataaagagggggatcagtatatctacatgggacagcccctgaacaatgacgaggatcatgcccactggaccgaagctaagatgctcctggacaacatcaatacgcccgagggcattatccctgccctttttgaacccgagcgcgaaaaatccgcggccattgatggggagtatcggctgagaggagaggctcgcaagaccttcgtcgaactcatgagacggggcgacctgcctgtgtggctgagccacaaagtcgcctccgaggggtttcagtactctgatcgcagatggtgcttcgacggcgaacggaacaatcaagtgctcgaggaaaacatggatgttgagatctggacaaaggagggagaacgcaagaaacttagaccgcggtggctggacgctagaacctatagcgaccccctggccctccgcgagtttaaagagttcgctgccggccggagatccgtgtctggggatctgattcttgagatcggaaaactgcctcagcatctcacacagcgcgcgcagaatgccctggacaacctggtgatgctccacaatagcgaacaaggcgggcgggcttacagacatgccatggaggagcttcccgataccatcgaaacactgatgctgctcgctctgattgccgtccttaccggaggcgttacgctgtttttcctctccggccgggggctgggaaagacaagcatcggcctgctctgtgtgatggcctcttccgtgcttctgtggatggctagcgtcgagcctcactggattgcggcctctatcattctggaatttttcctcatggtgctgcttatccccgagccggaccgccagagaacccctcaggataaccagctggcttatgttgtgatcgggctcctgtttatgattctgaccgtcgccgccaatgagatgggactccttgaaacaaccaaaaaggacctgggcatcgggcacgctgccgtggagaaccatcaccatgcggccatgctggatgtcgacctccaccccgcttccgcctggacactgtacgctgtggccacgaccattatcacacctatgatgcggcataccattgaaaacacaaccgcgaatatcagccttacggccattgctaaccaagccgctatcctgatgggactcgataaaggctggcccatctctaagatggacattggcgttcctctgctggccctcgggtgctacagccaggtgaatccccttaccctgacagctgccgtcctgatgctcgtggcgcactatgccatcattggaccgggcctgcaggctaaggccacccgcgaggctcagaagagaacagccgccgggatcatgaagaaccctaccgttgatggaattgtggcgatcgaccttgatcccgtcgtgtacgacgctaaattcgaaaagcagctgggccagatcatgctcctgattctgtgtacgtcccagatcctccttatgcggacaacctgggccctgtgcgagtctattacactggctaccgggcccctcaccacactgtgggagggaagccctggcaaattctggaatacgaccatcgccgtgtccatggccaacatttttcgcggcagctatcttgctggggccggactggcgttctccctcatgaagtctctgggcgggggaagacggggcacaggggcccaaggagaaaccctgggcgagaagtggaaacgccagctcaatcagcttagcaagtccgaatttaacacatacaaaagatctggcatcatggaggttgaccggagcgaagctaaggaggggctgaaaagaggagagaccacgaagcacgccgtctcccgcggcacagctaagctgcggtggttcgtggaaagaaatctcgtgaaaccggaggggaaggtcatcgatctgggatgtggccgcgggggatggtcttattactgcgccggccttaaaaaggttaccgaagtgaaaggctataccaaagggggacccggccatgaggaacctattcccatggcgacatacgggtggaacctggtgaaactccacagcggaaaggacgtctttttcatccctcccgagaagtgtgataccctgctgtgcgacattggcgagtccagccctaatccgacaatcgaagaggggcggacgctcagagtgcttaaaatggttgaaccctggctgcgcggaaaccagttttgtattaagatcctgaatccttacatgccctctgtggtcgagaccctcgagcaaatgcagcggaaacatggcggcatgctggtgagaaaccctctttcccgcaatagcacacacgaaatgtattgggtttcttgcgggaccggaaacattgtgtccgccgtcaatatgacaagccggatgctgctcaacagattcaccatggctcaccgcaagcccacgtacgagcgggatgtggacctgggcgccgggaccagacatgtggctgtcgaaccggaggttgccaacctggatatcatcggacagcgcattgaaaatatcaaacacgagcataagtctacatggcactatgacgaggataacccttacaagacctgggcttatcatggctcctacgaagtgaaacccagcgggtccgccagctctatggtgaatggagtcgtgaagctcctgacaaaaccctgggacgttattcctatggtgacccagatcgcgatgacagataccacgccctttggccaacagagagtcttcaaggagaaagtggacacacggacccctaaggccaagcgcggcaccgctcagattatggaagttacagccaaatggctttgggggtttctgagcagaaacaagaaaccgcggatctgtacgagagaggagttcacccggaaggtgcgctccaatgctgccatcggagccgtctttgtggacgagaaccaatggaactctgcgaaagaggctgttgaagatgagagattctgggacctcgtgcaccgggaacgcgagctgcacaagcagggcaagtgcgccacatgcgtctataacatgatggggaaaagagaaaagaaacttggagagttcggcaaggccaaagggagccgggctatttggtacatgtggctgggcgcccgctttctcgagttcgaagctctgggatttatgaatgaggatcattggttctccagagaaaactctctgagcggcgtggagggggagggactccacaagctgggctacatccttcgggacatttccaaaatccccgggggaaatatgtatgccgatgacaccgcgggctgggatacacgcattaccgaagacgatctgcagaacgaggccaagatcacagacatcatggaacctgagcatgctctcctggccaagtctatttttaaacttacctaccagaataaggtcgtgagagttcaacggcccgctaaaaacgggacggtgatggatgtcatcagccgcagagaccagcggggctccggacaggtgggcacctatgggctgaatacattcaccaacatggaagcccagctcattcgccaaatggagagcgagggaatcttttctccttccgaactggagacacccaacctggcgggcagagtgctcgattggctggaaaagcacggggttgagcggcttaaaagaatggccattagcggagacgactgtgtggtcaagccgatcgatgaccgcttcgctaccgccctgacggctctcaatgatatgggcaaggtgcggaaagacatccctcagtgggaaccctctaaggggtggaacgattggcagcaggttcctttttgctcccaccatttccaccaactgattatgaaagacggcagagagatcgtggtcccctgtcgcaatcaggatgagcttgtgggacgggccagagtcagccagggcgctgggtggtccctgcgcgaaacagcctgcctcggaaagtcttacgcgcagatgtggcaactgatgtattttcatcggagagacctgcgcctcgccgctaacgccatttgtagcgccgtgcctgttgattgggtgcccacctcccggacaacctggagcatccacgctcatcaccagtggatgacgaccgaggacatgctgtctgtctggaatagagtgtggattgaagagaacccgtggatggaagataaaacacacatctccagctggggcgacgttccttaccttgggaagcgcgaggaccagtggtgcggatctctgattggcctcaccgcccgggcgacatgggctaccaatatccaagtggccatcaaccaggtcagacggctgattgggaatgagaactatcttgattacatgacaagcatgaagagattcaaaaatgaatccgaccccgagggcgccctgtggtga

SEQ ID NO: 19203 - RNA, 9879 nt, synthetic construct
  misc_feature 1..9879: note = derived and/or modified CDS sequence (opt5) from DENV-1__GU131761__SS-prME
  source 1..9879: mol_type = other RNA
agcgtgaccatgctgctcatgctgatgcccaccgcccttgctttccacctgacgaccagaggaggggaacctcatatgatcgtgtccaagcaggaacggggaaaatctctcctgtttaagacaagcgccggcgttaacatgtgcacccttattgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaactggctgagacccagcacggaacagtcctggtgcagattaagtacgagggcaccgacgccccgtgcaaaatccctttctccacacaagatgaaaagggggttacgcagaacggacggcttatcaccgcgaatcccattgtgacagacaaagagaagcctgtcaacatcgaagctgagccgccctttggcgagagctatattgtgatcggggccggagaaaaagccctcaagctgtcttggttcaagaaaggcagctccattgggaagatgtttgaggctaccgccagaggcgctcgccggatggccatcctgggagatacagcgtgggacttcggctctatcgggggagtgtttaccagcgttggcaaactcgtccatcagattttcgggacggcctacggagtgctgttttccggcgtgagctggaccatgaagatcgggattggcgtccttctgacatggctcggactcaattctagatccaccagcctgtctatgacatgtatcgctgtgggccttgttaccctctacctgggggtgatggtccaggccgattccggatgcgtgattaactggaaaggccgcgaactgaagtgtgggagcggaatcttcgttacaaatgaggtgcacacctggacggaacaatataagtttcaggctgactcccctaaacggctctctgccgcgattggcaaggcctgggaggagggggtctgcggcatcagaagcgctacacgcctggaaaacatcatgtggaaacagatttccaacgagcttaatcatatcctgctcgaaaacgacatgaagttcaccgtggttgtgggagatgtcgccggcattctggctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtggaggactacggattcggcatttttacgacaaacatctggctgaaacttcgcgattcctatacccaggtctgcgaccaccggctcatgagcgcggccattaaagattctaaggctgttcacgccgacatgggctactggatcgaatccgagaaaaatgaaacatggaagctggccagagctagcttcatcgaggtgaagacctgtatttggcccaaatctcatacactgtggtccaacggggtgctcgaaagcgagatgatcattccgaagatctatggaggccctatttctcaacacaattaccgccccgggtacttcacccagacggccggaccttggcatctgggcaaacttgagctggattttgacctctgcgaagggaccacagtcgtggttgatgagcactgcggaaaccggggccccagcctgagaaccacaaccgtgacgggcaagatcatccacgaatggtgttgccggtcctgtacactgcctccccttcgcttcagaggggaggacggatgctggtatggcatggagattcggccggtcaaagaaaaggaggaaaatctcgtcaagagcatggtttctgcggggtccggagaggtggacagcttttccctgggcctgctctgtatctctattatgatcgaagaggtcatgagaagccgctggtcccggaaaatgctgatgaccgggacacttgctgtgttctttctgctcattatgggacagctgacctggaacgatctgatcagactttgcattatggttggcgccaatgcctctgaccgcatgggcatggggaccacatacctggctctcatggccacgttcaagatgagacctatgtttgcggtgggactgctgttccggcgcctgaccagcagagaggtccttctgctcacaatcggcctgtccctggtggcttctgtggaacttcccaacagcctggaggaactcggggatggactggccatgggcatcatgattctcaaactgcttaccgactttcaatcccatcagctgtgggccacactcctgagcctgaccttcatcaagacgacattttctcttcactatgcttggaaaaccatggccatgattctgtccatcgtcagcctcttccccctgtgtctctctaccacatcccagaagaccacatggctgcctgttcttctggggagcctgggatgcaagccgctcacgatgtttctgattgctgagaataaaatctggggccggcgctcttggccccttaacgaaggcatcatggccgtggggattgtgtccatcctgctcagctccctgctcaagaacgatgtccctctggcgggaccccttattgccggcgggatgctgatcgcttgttacgtgattagcggatctagcgccgacctgtccctcgagaaagctgccgaggtttcttgggaagaggaagccgagcatagcggcgcttcccacaatatcctggtggaagtccaggatgacgggaccatgaagatccaagatgaggagagagacgatacacttaccattctgctcaaagcgacactgctcgccgtgtctggagtttatcctctgagcatccccgctacccttttcgtgtggtacttctggcagaagaaaaagcagcggtccggcgtcctgtgggacacgccttctcccccggaagtggagcgcgccgtcctggatgacggcatttatagaatcatgcagcgggggctcctgggacgcagccaagtgggcgttggggtgtttcaggaaaacgtcttccataccatgtggcacgtgacaagaggagccgttcttatgtaccagggcaagcggctggagccttcctgggctagcgtgaaaaaggacctcatttcttacgggggaggctggagactgcagggctcctggaataccggggaggaagtccaagtgatcgccgtggagcccggcaagaaccctaagaatgttcagacagcgcccggcacctttaaaacaccggaaggggaggtcggagctattgccctcgatttcaagcctggcacgagcgggtctcccatcgtgaaccgcgaaggaaagatcgtgggcctgtatggcaatggggtcgtgaccacatccggaacctacgttagcgccattgctcaggccaaagcgtcccaagagggccctcttcccgagatcgaagacgaggtgtttcggaagagaaacctgaccattatggatctgcaccccgggtctggaaaaacacgccggtatctccctgctatcgtcagagaagccattaagcgcaaactgcggacgcttatcctggccccgaccagagtggttgctagcgagatggccgaagctctcaagggcatgcccatccgctaccagacaaccgccgtgaagtccgagcatacagggaaagagattgtcgacctgatgtgccacgcgaccttcacgatgcggctgctcagccctgtgagagttcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgtgatccaggatgaggaaagagacattcccgagcggtcctggaactctggatatgagtggatcaccgatttccctggcaagacagtgtggtttgtccccagcattaaatccgggaatgacatcgctaactgtcttcgcaagaatggaaaaagagttattcaactgtctcggaagaccttcgatacggaataccagaagaccaagaacaacgactgggactacgtggtgaccacagatatcagcgagatgggcgccaatttcagagccgaccgcgtcattgatcctcggagatgcctgaagcccgtgatcctcaaagacgggccggaacgcgttatcctggctggccctatgcccgtgaccgtcgcctccgcggctcagcggagaggacgcattggccggaaccacaataaggagggggatcagtatatctacatgggacaaccccttaacaatgacgaggatcatgcccactggacggaagccaaaatgctgctcgacaacattaatacccctgagggcatcattcccgctctgtttgaacctgagagagaaaagagcgccgcgatcgatggggagtatcgcctgagaggagaggcccggaagacattcgtggaactcatgcgcagaggcgaccttccggtttggctgtcttacaaagtggcttccgaggggtttcagtatagcgatcggcgctggtgcttcgacggcgaaagaaacaatcaggtcctggaggaaaacatggatgtggagatctggaccaaggagggagaacggaaaaagctcagaccccgctggctggacgcccggacatactccgaccctcttgctctgagagagtttaaagagttcgccgctggccgccggtctgtcagcggggatctcattctggagatcggaaagctgccccagcacctcacccaaagagcccagaatgcgcttgacaacctggtgatgctgcataattccgaacagggcgggcgggcctatcgccacgctatggaggagctccctgatacaattgaaaccctgatgcttctggccctcatcgctgttctgacgggaggcgtgacactgtttttcctctctggcagagggcttggaaaaaccagcattggcctgctgtgtgtgatggcctccagcgtcctcctgtggatggcctctgttgagccccattggatcgctgcgtccatcattcttgaatttttcctgatggtgctcctgatcccggagcctgaccggcagcgcacaccccaagataaccagctggcctacgtggtcattgggctcctttttatgatcctgacagtggctgccaatgagatgggactgctcgaaaccacaaagaaggacctgggcattgggcacgttgccgtggagaaccaccatcacgctgccatgcttgatgtcgacctgcatcctgcgagcgcctggacgctctacgctgtggccaccacaatcattacccccatgatgagacacacaatcgaaaacaccacggctaatatctctctgaccgccattgcgaaccaggccgctatcctgatgggactcgataaaggctggcctatttccaagatggacatcggcgtcccccttctggccctggggtgctatagccaagtgaatccgctcacactgaccgctgccgttcttatgctggtggctcattacgccattatcggacctggcctccaggcgaaagccacacgggaggctcagaagcgcaccgccgctgggatcatgaaaaaccccacggtcgatggaattgtggccatcgacctggatcccgttgtgtatgacgccaagttcgaaaagcagctgggccaaattatgctccttatcctgtgtacatctcagattctgctcatgagaaccacatgggcgctgtgcgagagcatcacccttgctaccgggcctctgacaacgctctgggagggatccccgggcaaattttggaataccacaatcgccgtctctatggctaacattttccggggcagctacctggccggggccggactggctttctccctcatgaaaagccttggcgggggacgcagaggcaccggggcccagggagaaacactgggcgagaaatggaagcggcagctgaatcaactctccaaatctgaatttaacacctataagagaagcggcatcatggaggtggaccgctccgaagcgaaggaggggctgaaacggggagagacgacaaagcacgccgtgtctagaggcaccgctaaacttcgctggttcgttgaacggaatctggtcaagcccgaggggaaagtgattgatctcggatgtggcagagggggatggagctactattgcgccggcctgaagaaggtgaccgaagtcaaaggctacacaaaaggcgggcctgggcacgaggaacccatccctatggctacctacgggtggaacctggttaaactccattccggaaaggacgtgtttttcattccccctgagaaatgtgatacacttctgtgcgacatcggcgagtctagcccgaatcccacgattgaagaggggcgcaccctgcgggtgctcaagatggtcgaaccttggctgagaggaaaccagttttgtatcaaaatccttaatccctatatgccttccgtggttgagacactggagcagatgcagcgcaagcacggcggcatgctcgtgcggaaccccctgagcagaaattctacccatgaaatgtactgggtctcctgcgggacaggaaacattgtgagcgccgttaatatgacctctcgcatgctgctcaaccggttcacgatggcgcacagaaagccgacctatgagcgcgatgtggacctgggcgccgggacaagacacgtcgctgtggaacctgaggtggccaaccttgatatcattggacaacggatcgaaaatattaaacatgagcacaagtccacctggcattacgacgaggataacccctataaaacatgggcttaccacggcagctatgaagtcaagccctctgggtccgccagctccatggttaatggagtggtgaaactgctcaccaagccttgggacgtcatccccatggtgacacagatcgctatgaccgatacgacaccttttggccagcaacgcgttttcaaggagaaagtggacaccagaaccccgaaggccaaacggggcacagcgcagattatggaagtcacggccaagtggctgtgggggtttcttagcagaaacaaaaagccccggatctgtacccgcgaggagttcacaagaaaggtgcggtctaatgctgccattggagctgtttttgtggacgagaaccagtggaatagcgccaaagaggccgtcgaagatgagcgcttctgggacctggtgcatagagaacgggagctccacaagcagggcaaatgcgcgacctgcgtttacaacatgatggggaagcgcgagaagaagctgggagagtttggcaaggctaaagggtccagagccatctggtacatgtggctgggcgcccggttcctcgagttcgaagctctgggatttatgaatgaggatcactggttctctcgcgaaaacagcctttccggcgtggagggggagggactgcataagctcggctatattctgagagacatctctaaaatccctgggggaaatatgtacgccgatgacacagctggctgggatacccggattacagaagacgatcttcaaaacgaggcccgcatcaccgacattatggaacccgagcacgcgctgctcgccaagagcatctttaaactgacgtatcagaataaggtcgtgagagtccagcggcctgctaaaaacgggaccgtgatggatgttatttcccgcagagaccagcggggctctggacaagtgggcacatacgggctgaataccttcacaaacatggaagcccagctcatcagacagatggagagcgagggaatcttttcccccagcgaactggagaccccgaaccttgctgaacgcgtcctggattggctcgagaagtatggcgtggaacggctgaagagaatggccatttctggggacgactgtgtggttaaacctatcgatgaccgcttcgcgacggcccttacagctctgaatgatatgggaaaggtgcggaaagacattccccagtgggagccttccaagggctggaacgattggcaacaggtccccttttgcagccatcacttccaccagctcatcatgaaagacgggagagagattgtggttccttgtcgcaatcaggatgaactggtgggccgggccagagtctctcaaggagctggctggtccctgcgcgagaccgcctgcctcggaaagagctacgctcagatgtggcagctgatgtattttcatcggagagaccttcgcctggccgcgaacgccatctgttccgctgtgcccgtcgattggattccgacatctcggaccacgtggagcatccacgcccatcaccaatggatgaccacagaagacatgctctccgtgtggaatagagtttggatcgaggaaaacccttggatggaggataagacccatattagctcttggggagacgtgccctacctgggcaaacgggaggaccagtggtgcgggtcccttatcggactgacagccagagctacctgggccacaaatattcaggtcgcgatcaaccaggtgcgccggctcattggcaatgaaaactacctggattatatgaccagcatgaagagattcaaaaatgagtctgaccccgaaggggctctgtggtga

SEQ ID NO: 19204 - RNA, 9879 nt, synthetic construct
  misc_feature 1..9879: note = derived and/or modified CDS sequence (opt5) from DENV-1__GU131762__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcatgtctctctccatgacctgtatcgccgttggcctggtgacactgtaccttggggtcatggtgcaggctgatagcggatgcgttattaactggaaaggccgcgaactcaagtgtgggtccggaatctttgtgaccaatgaggtccacacatggaccgaacaatataagttccaggccgactctcctaaacggctgagcgcggccattggcaaggcttgggaggagggggtgtgcggcatcagatccgccacacgcctggaaaacatcatgtggaaacagatttctaacgagctcaatcatatcctgcttgaaaacgacatgaagtttaccgttgtggtcggagatgtggctggcattctggcccaggggaaaaagatgatccggccgcaacccatggagtacaaatatagctggaagtcctggggaaaggccaaaattatcggcgctgacgtgcagaatacgacattcatcattgatgggcctaacacccccgaatgtcctgacgatcagagagcgtggaatatctgggaggtcgaggactacggatttggcattttcaccacaaacatctggctcaagctgcgcgatagctatacccaggtttgcgaccaccggctgatgtctgccgctattaaagattccaaggccgtgcacgccgacatgggctactggatcgaaagcgagaaaaatgaaacgtggaaacttgctagagcctctttcatcgaggtgaagacatgtatttggcccaaatcccataccctctggagcaacggggtcctggaatctgagatgatcattccgaagatctatggaggccctattagccaacacaattaccgccccgggtactttacacagaccgcgggaccttggcatctgggcaaactcgagctggatttcgacctttgcgaagggacaaccgtggttgtggatgagcactgcggaaaccggggcccctccctgagaacgaccacagtcaccggcaagatcatccacgaatggtgttgccggagctgtacactccctcccctgcgctttaaaggggaggacggatgctggtatggcatggagattagaccggtgaaggaaaaggaggaaaatctggttaaatctatggtgtccgctgggagcggagaggtcgactccttctctcttggcctcctgtgtatcagcattatgatcgaagaggtgatgcggtccagatggtctcgcaagatgctgatgaccgggacgctcgccgtctttttcctgcttattatgggacagctgacatggaacgatctcatccggctgtgcattatggtgggcgccaatgctagcgacagaatgggcatggggaccacatacctggcccttatggcgacctttaaaatgcgccctatgttcgctgtcggactgctctttagacggctgacctcccgcgaggtgctcctgcttacaatcggcctgtctctcgtggccagcgtcgaactgcccaactccctggaggaacttggggatggactggccatgggcatcatgattctcaagctgctcacggacttccaaagccatcagctgtgggctacccttctgtctctcacatttatcaaaaccacattctccctgcactatgcctggaagaccatggctatggttctgagcattgtgtctctttttcccctgtgtctctccacgacaagccagaagaccacctggctgcctgtgctcctggggtctcttggatgcaaaccgctgacaatgttcctgatcgccgagaataagatttggggcagaaaatcctggcccctcaacgaaggcatcatggcggtcgggatcgtgagcattctgctttccagcctgctcaagaacgatgttcctctggccggacccctcatcgctggcgggatgctgattgcctgttacgtgatctctggaagctccgctgacctttctctggagaaagccgccgaggtcagctgggaagaggaagctgagcattccggcgcgtctcacaatattctggtggaagttcaggatgacgggaccatgaagatcaaagatgaggagcgggacgatacactcacgatcctgcttaaggccaccctgctcgctgtgagcggagtctatcctctgtccattcccgccacactcttcctgtggtacttttggcaaaagaaaaagcagcgctctggcgtgctttgggacaccccttcccctcccgaagtcgagagagccgtgctggatgacggcatctatcggattatgcagcgcgggctgctcggaagatcccaggttggcgtgggggtcttccaagaaaacgtgtttcatacaatgtggcacgttacccggggagctgtgctgatgtaccagggcaaacgccttgagcccagctgggcctctgtcaagaaagacctgatctcctacgggggaggctggagactccagggcagctggaatacgggggaggaagtccaggtgattgcggttgagcccggaaagaaccctaagaatgtccaaaccgctcccggcacattcaaaacctctgaaggggaggtgggagccatcgccctggattttaagccgggcacatccgggagccctattgtgaaccgggaaggaaaaatcgtcggcctctatggcaatggggtggttaccacatccggaacgtacgtgtctgctatcgcccaggcgaaggctagccaggagggccccctgcctgagattgaagacgaggtcttcagaaaacgcaaccttaccatcatggatctgcaccccgggtccggaaagacacggagatatctgcccgccattgtgcgcgaagccatcaagcggaaactcagaaccctgattcttgctcctacccgcgttgtggccagcgagatggctgaagccctgaagggcatgccgatccggtaccaaacaacggcggtcaaatctgagcataccgggaaggagatcgtggacctcatgtgccacgccacatttaccatgagactgctgtcccccgttcgcgtgcctaattataacatgattatcatggatgaagctcatttcacagaccccagctctattgccgctcggggctacatcagcaccagagtcggaatgggcgaggccgccgctatttttatgacggcgacacctcccgggtccgtggaagccttccctcagtctaatgctgtgatccaggatgaggaacgggacatcccggagcgcagctggaactccggatatgagtggattaccgattttcccggcaaaaccgtctggttcgttccttctatcaagagcgggaatgacattgccaactgtctcagaaagaatggaaaacgggtgatccagctttcccgcaagacattcgataccgaataccagaagacaaagaacaacgactgggactacgtggtcaccacggatattagcgagatgggcgccaattttagagctgaccgggtgatcgatcccagacgctgcctgaaacctgttattctgaaggacgggcccgaacgggtgatcctcgccggcccgatgcctgtcacagtggcgtctgctgcccagagacgcggacggatcggcagaaaccacaataaggagggggatcagtatatttacatgggacagcccctgaacaatgacgaggatcatgcccactggaccgaagctaaaatgcttctggacaacatcaatacacccgagggcattatccctgccctcttcgaacccgagcgcgaaaagtccgcggccattgatggggagtatcggctgagaggagaggctcgcaaaacctttgttgaactgatgagacggggcgacctccctgtgtggcttagctacaaggtcgcctccgaggggttccaatattctgatcgcagatggtgctttgacggcgaacggaacaatcaggtgctggaggaaaacatggatgtcgagatctggacgaaagagggagaacgcaagaaactgagaccgcggtggctcgacgctagagtgtacagcgaccccctggcccttcgcgagttcaaggaatttgctgccggccggagatccgtttctggggatctgatcctcgagattggaaagctgcctcagcacctgacccagcgcgcgcaaaatgccctcgacaaccttgtgatgctgcataatagcgaacagggcgggcgggcttatagacacgccatggaggagctgcccgatacaatcgaaaccctcatgctgcttgctctgattgccgtgctcacaggaggcgtcaccctgttctttctgtccggccgggggctcggaaaaacaagcatcggccttctgtgtgttatggcctcttccgtgctgctctggatggctagcgtggagcctcattggattgcggcctctatcatcctggagttctttcttatggtcctgctcattcccgagccggaccgccagagaacccctcaggataaccaactggcttacgtggttatcgggctgctgttcatgattcttacggtggccgccaatgagatgggactgctggaaacaaccaagaaagacctcggcatcgggcacgtcgctgtggagaaccaccatcacgccgcgatgctggatgtcgaccttcatcccgcctccgcttggaccctgtacgccgtggctacaaccattatcacacctatgatgcggcacacgattgaaaacaccacagccaatatcagcctcaccgcgatcgccaaccaggctgccattctgatgggactggataagggctggcccatctctaaaatggacattggcgttcctctccttgctctggggtgctatagccaggtgaatcccctgacactcaccgccgctgtcctgatgcttgtggcccattacgcgatcattggaccgggcctgcaagccaaggctacgcgcgaggcccagaagagaaccgctgccgggatcatgaaaaaccctacagttgatggaatcgtggccattgacctcgatcccgtcgtgtatgacgcgaagtttgaaaaacagctgggccagatcatgctgctcattctttgtacctcccaaatcctgctgatgcggacaacctgggctctctgcgagtctattacgctggccacagggccccttaccacactgtgggagggaagccctggcaagttctggaataccaccatcgctgtgtccatggccaacatcttccgcggcagctacctcgccggggctggactggccttttccctgatgaaatctctcggcgggggaagacggggcacaggggcgcagggagaaacgcttggcgagaagtggaagcgccagctgaatcagctgagcaaatccgagttcaacacctataagagatctggcattatggaggttgaccggagcgaagccaaagaggggctcaagagaggagagacaaccaaacacgctgtctcccgcggcacagccaagctgcggtggtttgtggaaagaaatcttgtgaagccggaggggaaagtcatcgatctgggatgtggccgcgggggatggtcttactattgcgctggcctcaagaaagttaccgaagtgaagggctacacgaaagggggacccggccacgaggaacctattcccatggccacatacgggtggaacctggtgaagctgcatagcggaaaagacgtcttctttatccctcccgagaagtgtgataccctcctttgcgacattggcgagtccagccctaatccgaccatcgaagaggggcggacactgagagtgctgaagatggttgaaccctggctccgcggaaaccaattctgtattaaaatcctgaatccttatatgccctctgtggtcgagacccttgagcagatgcagcggaagcacggcggcatgctggtgagaaaccctctctcccgcaatagcacacatgaaatgtactgggtttcttgcgggacgggaaacatcgtgtccgcggtcaatatgaccagccggatgctgctgaacagatttacaatggcccaccgcaaacccacctatgagcgggatgtggacctcggcgctgggacaagacacgtggccgtcgaaccggaggttgctaacctggatattatcggacagcgcattgaaaatatcaagcatgagcacaaatctacctggcattacgacgaggataacccttataagacgtgggcctaccacggctcctatgaagtgaagcccagcgggtccgctagctctatggtgaatggagtcgtgaaacttctgaccaagccctgggacgttattcctatggtgacacaaatcgccatgaccgatacaacccccttcggccagcagagagtctttaaagagaaggtggacacacggacccctaaagcgaagcgcggcacggcccaaatcatggaagttacagctaagtggctctgggggttcctgagcagaaacaaaaagccgcggatttgtaccagagaggaatttacccggaaagtgcgctccaatgccgctatcggagccgtcttcgtggacgagaaccagtggaactctgccaaggaggcggttgaagatgagagattttgggaccttgtgcatcgggaacgcgagctgcacaaacagggcaagtgcgctacatgcgtctacaacatgatggggaagagagagaagaagctcggagagttcggcaaagccaaggggagccgggccatttggtacatgtggctgggcgctcgcttcctggagtttgaagccctcggattcatgaatgaggatcactggttttccagagaaaactctctgagcggcgtggagggggagggacttcataaactgggctatatcctccgggacatttccaagatccccgggggaaatatgtacgctgatgacacggccggctgggatacccgcatcacagaagacgatctgcagaacgaggcgaaaattaccgacatcatggaacctgagcacgcccttctggctaagtctattttcaagctcacatatcaaaataaagtcgtgagagttcagcggcccgccaagaacgggaccgtgatggatgtcatcagccgcagagaccagcggggctccggacaggtgggcacatacgggctgaatacctttacgaacatggaagctcaactgattcgccagatggagagcgagggaatcttctctccttccgaactcgagacccccaacctggccggcagagtgcttgattggctggaaaaacatggggttgagcggctcaagagaatggcgatcagcggagacgactgtgtggtcaaaccgattgatgaccgctttgccacagctctgaccgcccttaatgatatgggcaaggtgcggaaggacatccctcagtgggaaccctctaaagggtggaacgattggcagcaagttcctttctgctcccaccactttcatcagctgattatgaaggacggcagagagatcgtggtcccctgtcgcaatcaggatgagctcgtgggacgggctagagtcagccagggcgccgggtggtccctgcgcgaaacagcttgcctgggaaaatcttatgcccaaatgtggcagctcatgtacttccaccggagagacctgcgccttgcggccaacgctatttgtagcgccgtgcctgttgattgggtgcccacctcccggacgacatggagcatccatgcccaccatcagtggatgaccacagaggacatgctgtctgtctggaatagagtgtggattgaagagaacccgtggatggaagataagacccacatctccagctggggcgacgttccttatctcgggaaacgcgaggaccaatggtgcggatctctgatcggccttacggctcgggccacctgggcgacaaatattcaggtggctatcaaccaggtcagacggctgattgggaatgagaactacctcgattacatgaccagcatgaagagatttaagaatgaatccgaccccgagggcgccctgtggtga

SEQ ID NO: 19205 - RNA, 9879 nt, synthetic construct
  misc_feature 1..9879: note = derived and/or modified CDS sequence (opt5) from DENV-1__GU131763__SS-prME
  source 1..9879: mol_type = other RNA
tccgtgaccatgctgctcatgctgatgcccaccgcccttgctttccacctgacgaccagaggcggggaacctcatatgatcgtcacaaagcaggaacggggaaagtcccttctgtttaagacctctgccggcgttaatatgtgcacccttattgcgatggacctgggggaactctgtgaagataccatgacatacaagtgcccgcgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggctcggagaggtcgactcctttagcctgggcctgctctgtatctccattatgatcgaagaggtgatgcggtctagatggagccgcaagatgctgatggctgggacacttgccgttttcctgctcctgattatgggacagctgacctggaacgatcttatccggctgtgcattatggtgggcgccaatgcttccgacagaatgggcatggggacaacctatctcgccctgatggcgacctttaaaatgcgccctatgttcgctgtcggactcctgtttagacggcttacatctcgcgaggtgctgctcctgacgatcggcctgagccttgtggcctccgtcgaactgcccaactctctcgaggaactgggggatggactcgccatgggcatcatgattctgaaacttctgaccgacttccaaagccaccagctctgggctacactgctgtcccttacctttatcaaaacaaccctgagcctccattacgcctggaagacgatggctatggttctgtctattgtgtccctcttccccctgtgtcttagcacaacctctcagaagaccacatggctgcctgtgctgctcgggtccctgggatgcaaaccgcttaccatgtttctgatcgccgagaataagatttggggcagaaaaagctggcccctcaacgaaggcatcatggcggtcggggtggtttctatcctgctctccagcctgcttaagaacgatgtgcctctggccggacccctgattgctggcgggatgctcatcgcctgttatgtcatttccggaagctctgctgacctgagccttgagaaagccgccgaggtgtcctgggaagaggaagctgagcactctggcgcgagccataatatcctggttgaagtgcaggatgacgggacaatgaagattaaagatgaggagcgggacgatacgctcaccatcctgctcaaggccacactgcttgctatctccggagtctaccctctgtctattcccgccaccctgttcgtgtggtatttttggcaaaagaaaaagcagcgcagcggcgtcctctgggacacacctagccctcccgaagtggagagagccgttctggatgacggcatctaccggattatgcagcgcgggcttctgggaagatctcaggtgggcgtcggggtgttccaagaaaacgttttccacaccatgtggcacgtgacgcggggagctgtcctcatgtatcagggcaaacgcctggagcccagctgggcctccgtgaagaaagacctcatcagctacgggggaggctggagactgcagggctcttggaataccggggaggaagtgcaggttattgcggtcgagcccggaaagaaccctaagaatgtgcaaacagctcccggcacctttaaaacaccggaaggggaggtgggagccatcgcccttgatttcaagcctggcacctccgggagccccattgtcaaccgggaaggaaaaatcgtgggcctgtacggcaatggggttgtgacaacgtctggaacctatgtctccgctatcgcccaggcgaaggctagccaggagggccctctgcccgagattgaagacgaggtgtttagaaaacgcaacctcacaatcatggatctgcatcccgggtccggaaagacccggagataccttcctgccattgttcgcgaagccatcaagcggaaactgagaaccctcattctggctccgacacgcgtggtcgcctctgagatggctgaagccctgaagggcatgcccatccggtatcaaacgaccgcggtgaaaagcgagcacacagggaaggagatcgttgacctcatgtgccatgccaccttcacaatgagacttctgtcccctgtgcgcgtccccaattacaacatgattatcatggatgaagctcactttaccgaccctagctctattgccgctcggggctatatctccacgagagtgggaatgggcgaggccgccgctattttcatgacagcgacaccccctgggagcgtggaagcctttccgcagtctaatgctgtcatccaggatgaggaacgggacatccccgagcgcagctggaactccggatacgagtggattaccgatttccctggcaaaacagtttggtttgtgccctctatcaagagcgggaatgacattgccaactgtctgagaaagaatggaaaacgggtgatccagctctcccgcaagaccttcgatacagaatatcagaagaccaagaacaacgactgggactacgtcgtgacgacagatatttctgagatgggcgccaattttagagctgaccgggttatcgatcctagacgctgcctgaaacccgtgattcttaaggacgggccggaacgggtcatcctggccggccctatgcccgtgaccgttgcgagcgctgcccagagacgcggacggatcggcagaaaccataataaggagggggatcagtacatttatatgggacagcccctcaacaatgacgaggatcacgcccactggacagaagctaaaatgctgctggacaacatcaatacccctgagggcattatccccgccctcttcgaacctgagcgcgaaaagtccgcggccattgatggggagtaccggcttagaggagaggctcgcaaaacgttcgtggaactgatgagacggggcgacctgccggtctggctcagctataaggtggcctctgaggggtttcaatactccgatcgcagatggtgcttcgacggcgaacggaacaatcaggtcctggaggaaaacatggatgtggagatctggaccaaagagggagaacgcaagaaacttagaccccggtggctggacgctagaacatatagcgaccctctcgccctgcgcgagtttaaggagttcgctgccggccggagatccgtttctggggatctgatcctcgagattggaaaacttccccagcatctgacccagcgcgcgcaaaatgccctggacaacctcgtgatgctgcacaatagcgaacagggcgggcgggcttacagacatgccatggaggagcttcctgatacaatcgaaaccctgatgctcctggctctgattgccgtgctcacaggaggcgtcaccctctttttcctgtccggccgggggctgggaaaaacgtctatcggcctcctgtgtgttatggccagctccgtgcttctgtggatggctagcgtggagccccactggattgcggcctctatcatcctcgaatttttcctgatggtcctgctcattccggagcctgaccgccagagaacaccccaggataaccaacttgcttatgtggttatcgggctgctgtttatgattctcaccgtggccgccaatgagatgggactgcttgaaaccacaaagaaagacctgggcatcgggcacgtcgctgtggagaaccatcaccatgccaccatgctcgatgtcgacctgcaccctgcgtccgcctggacactgtacgctgtggccacgaccattatcacacccatgatgcggcataccattgaaaacacaaccgctaatatcagcctcacggccatcgcgaaccaggccgctattcttatgggactggataagggctggcctatctctaaaatggacattggcgttcccctgctcgccctggggtgctactcccaggtgaatccgcttaccctgacagctgccgtcctcatgctggtggctcactatgccatcattggacctggcctgcaagcgaaggccacccgcgaggctcagaagagaacagccgctgggatcatgaaaaaccccaccgttgatggaatcgtggccattgacctcgatcccgtcgtgtacgacgccaagttcgaaaaacagcttggccagatcatgctgctgattctctgtacgagccaaatcctgcttatgcggacaacctgggcgctgtgcgagtctattacactcgctaccgggcctctgaccacactgtgggagggaagcccgggcaagttttggaatacgaccatcgccgtgtccatggctaacatcttccgcggctcttatctcgccggggccggacttgcttttagcctgatgaaatccctgggcgggggaagacggggcacaggggcccagggagaaaccctcggcgagaagtggaagcgccagctgaatcagcttagcaaatccgagttcaacatttacaagagatctggcatcatggaggttgaccggagcgaagcgaaagaggggctgaagagaggagagacaacccgccacgccgtctcccggggcacggctaaactcagatggttcgtggaacgcaatctggtgaagcccgaggggaaggtcattgatctgggatgtggcagagggggatggtcttattactgcgccggcctcaaaaaggttacagaagtgaaaggctataccaaagggggacctggccatgaggaacccatccctatggctacctacgggtggaaccttgtgaaactgcacagcggaaaggacgtctttttcacaccccctgagagatgtgataccctgctctgcgacattggcgagtcctctccgaatcccacaatcgaagaggggcgcacgctgcgggtgcttaaaatggttgaaccttggctgagaggaaaccaattttgtattaagatcctcaatccctacatgcctagcgtggtcgagaccctggagcagatgcagcgcaagcatggcggcatgctggtgcggaaccccctctccagaaatagcacacacgaaatgtattgggtttcttgcgggaccggaaacatcgtgtccgccgtcaatatgacaagccgcatgctgcttaaccggttcaccatggcgcacagaaaaccgacgtacgagcgcgatgtggacctgggcgccgggaccagacatgtggctgtcgaacctgaggttgccaacctcgatattatcggacagcggattgaaaatatcaagcacgagcataaatctacatggcactatgacgaggataacccctacaagacctgggcttatcatggctcctacgaagtgaaacccagcgggtctgcctccagcatggtgaatggagtcgtgaagctgcttacaaagccttgggacgttattcccatggtgacccaaatcgctatgacagataccacgccttttggccagcagcgcgtcttcaaagagaaggtggacacaagaaccccgaaagccaagcggggcaccgcgcaaatcatggaagttacagccagatggctgtgggggtttctctcccggaacaaaaagccccgcatttgtacgagagaggagttcacccggaaggtgcgcagcaatgctgccatcggagctgtctttgtggacgagaaccagtggaactctgccaaagaggccgttgaagatgagagattctgggacctggtgcagaaggaacgggagctgcacaaacagggcaagtgcgcgacatgcgtctataacatgatggggaaacgcgaaaagaagctcggagagtttggcaaagctaaggggagcagagccatttggtacatgtggctgggcgcccggttccttgagtttgaagctctgggattcatgaatgaggatcactggttctcccgcgaaaactctctcagcggcgtggagggggagggactgcataaacttggctacatcctgagagacatttccaagatccctgggggaaatatgtatgccgatgacaccgctggctgggatacacggatcaccgaagacgatctccaaaacgaggccaaaattacagacatcatggaacccgagcacgcgctgctggccacctctatttttaagctcacgtaccagaataaagtcgtgcgcgttcagagacctgctaagaacgggaccgtgatggatgtcatcagccggcgcgaccagagaggctccggacaagtgggcacatatgggctgaataccttcacaaacatggaagcccagcttattcggcagatggagtctgagggaatctttctgcccagcgaactcgagaccccgaacctggctgaaagagtgcttgattggctggagaagcatggcgttgaacgcctcaaacggatggccatctccggggacgactgtgtggtcaagcctattgatgacagattcgcgacggccctgacagctctgaatgatatgggaaaagtgcgcaaggacatcccccagtgggagcctagcaaaggctggaacgattggcaacaggttcccttttgctctcaccacttccatcagctcattatgaaggacgggcgggagatcgtggtcccttgtagaaatcaggatgaactggtgggccgcgcccgggtctcccaaggagctggctggagccttagagagaccgcctgcctggggaagtcttacgctcagatgtggcagctcatgtattttcaccgccgggacctgagacttgccgcgaacgccatttgttccgctgtgcccgttgattgggtgccgacaagccgcaccacgtggtccatccatgcccaccatcaatggatgaccacagaagacatgctgtctgtctggaataaagtgtggattgaggaaaacccttggatggaggataagacccacgttagctcctggggagacgtgccctacctcggcaaacgggaggaccagtggtgcgggagcctgatcggactgacagccagagctacctgggcctctaatatccaggtcgcgattaaccaggtgcggagactcatcggcaatgaaaactatctggattacatgacatccatgaagcgcttcaaaaatgagggggaccccgaaggcgctctttggtga

SEQ ID NO: 19206 - RNA, 9879 nt, synthetic construct
  misc_feature 1..9879: note = derived and/or modified CDS sequence (opt5) from DENV-1__GU131766__SS-prME
  source 1..9879: mol_type = other RNA
agcgtgaccatgctgctcatgctgatgcccaccgcccttgctttccacctgacgacccggggcggggagcctcatatgatcgtcacaaagcaggaacggggaaagtccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccattgaacacggaaccacagctaccatcacgccccaggcccctaccagcgagattcagctcacagactacggcgccctgaccctggattgttctccccggacaggcctcgacttcaacgaaatggttctgcttaccatgaaggagaaatcctggctggtgcataagcagtggtttctcgatctgcctcttccctggacgagcggggcttccacatctcaagagacctggaatcgccaggacctgctcgtcacattcaaaaccgcgcacgccaagaagcaggaagtggtcgtgctgggaagccaagagggcgctatgcacaccgccctgacaggggccacggaaatccagacctccggaacaaccacaatttttgctggccatctcaaatgcagactgaagatggataaacttaccctgaaggggatgagctatgttatgtgtacgggctctttcaaactcgagaaggaagtggccgagacacagcacggaaccgtcctggtgcagatcaagtacgagggcaccgacgcgccgtgcaaaatccctttctccacacaagatgaaaagggggttacccagaacggacggctgattacagctaatcccatcgtgattgacaaagagaagcctgtcaacatcgaagccgagccgccctttggcgagagctatattgtgatcggggccggagaaaaagctcttaagctctcttggttcaagaaaggcagctccatcgggaagatgtttgaggccacggctagaggcgcccgccggatggcgattctgggagataccgcctgggacttcggctctatcgggggagtgtttacaagcattggcaaactggttcatcagatcttcgggaccgcttacggagtcctcttttccggcgtgagctggacaatgaagattgggatcggcgtgctgcttacctggctgggactcaattctagatccacgagcctgtctatgacctgtattgccgtcggcctggtgacactttacctcggggttatggtgcaggctgattccggatgcgtcatcaactggaaaggccgcgaactgaagtgtgggagcggaatcttcgtgaccaatgaggttcacacatggaccgaacaatataagtttcaggccgactcccctaaacggctgtctgcggccattggcaaggcttgggaggagggggtgtgcggcatcagaagcgccacacgcctcgaaaacattatgtggaaacagatctccaacgagctgaatcatattcttctggaaaacgacatgaagttcaccgtcgtggttggagatgtggtcggcatcctcgctcaggggaaaaagatgatccggccgcaacccatggagcacaaatactcttggaaaagctggggaaaggccaagattatcggcgccgacgtgcagaatacgacatttattatcgatgggcctaacacccccgaatgtcctgacgatcagagagcttggaatatttgggaggtggaggactatggattcggcatctttaccacaaacatctggctgaagatgcgcgattcctacacccaggtctgcgaccaccggctgatgagcgcggccattaaagattctaaggctgttcatgccgacatgggctattggatcgaatccgagaaaaatgaaacgtggaaacttgccagagctagcttcattgaggtgaagacatgtatctggcccaaatctcacaccctctggtccaacggggtgctggaaagcgagatgattatcccgaagatctacggaggccctatttctcaacataattatcgccccgggtacttcacacagaccgccggaccttggcacctgggcaaactcgagctggattttgacctttgcgaagggacaaccgtcgtggttgatgagcactgcggaaaccggggccccagcctgagaacgaccacagtgaccggcaagatcattcatgaatggtgttgccggtcctgtacactccctcccctgcgcttcaaaggggaggacggatgctggtacggcatggagatcagaccggtcaaggaaaaggaggaaaatctggtgaaaagcatggtttctgcggggtccggagaggtggacagcttttcccttggcctcctgtgtatttctatcatgattgaagaggtcatgcggagcagatggtcccgcaagatgctgatgaccgggacgctcgctgtgttcctgcttctgatcatgggacagctcacatggaacgatctgatccggctgtgcattatggttggcgccaatgcctctgacagaatgggcatggggaccacatatcttgctctgatggccacctttaaaatgcgccctatgttcgcggtgggactcctgtttagacggctcaccagccgcgaggtcctgcttctgacaatcggcctctccctggtggcttctgtggaactgcccaacagccttgaggaactgggggatggactcgccatgggcattatgatcctgaagctcctgacggacttccaatcccaccagctttgtgccaccctgctcagcctgacatttattaaaaccacactgtctcttcattacgcttggaagaccatggccatggtcctgtccatcgttagcctcatccccctgtgcctctctacgacatcccagaagaccacctggctgcctgtgcttctggggagcctgggatgtaaaccgctcacaatgttcctgattgctgagaataagatctggggcagaaaatcttggccccttaacgaaggcattatggccgtgggggtcgtgtccatcctgctcagctccctgctcaagaacgatgttcctctggcgggaccccttattgccggcgggatgctgatcgcttgctatgtgatcagcggatctagcgccgacctgtccctcgagaaagctgccgaggtctcttgggaagaggaagccgagcacagcggcgcttcccataatattctggtggaagttcaggatgacgggaccatgaagatcaaagatgaggagcgggacgatacacttacgattctgctcaaggcgaccctgctcgccgtgtctggagtctaccctctgagcatccccgctacactttttgtgtggtatttctggcaaaagaaaaagcagcgctccggcgtcctgtgggacaccccttctcccccggaagtggagagagccgttctggatgacggcatttaccggatcatgcagcgcgggctcctgggaagaagccaggtgggcgtcggggtgtttcaagaaaacgttttccacacaatgtggcacgtgacccggggagccgtccttatgtatcagggcaaacgcctggagccttcctgggctagcgtgaagaaagacctcatttcttacgggggaggctggagactgcagggctcctggaatacgggggaggaagtgcaggttatcgccgtcgagcccggaaagaaccctaagaatgtgcaaaccgcgcccggcacattcaaaaccccggaaggggaggtgggagctatcgccctcgattttaagcctggcacaagcgggtctcccattgtcaaccgggaaggaaaaatcgtgggcctgtacggcaatggggttgtgaccacatccggaacgtatgtcagcgccattgctcaggccaaggcgtcccaggagggccctcttcccgagatcgaagacgaggtgttcagaaaacgcaacctgaccattatggatctgcatcccgggtctggaaagacacggagatacctccctgctatcgttcgcgaagccatcaagcggaaactgagaacccttattctggccccgacccgcgtggtcgctagcgagatggccgaagctctcaagggcatgcccatccggtatcaaacaacggccgtgaaatccgagcacaccgggaaggagattgttgacctgatgtgtcatgcgacatttaccatgagactgctcagccctgtgcgcgtccccaattacaacatgatcattatggatgaagcccacttcacagacccttcttccatcgctgcccggggctatatcagcaccagagtgggaatgggcgaggctgccgccatttttatgacggctacaccccctgggtctgtggaagcgttcccgcagagcaatgccgtcatccaggatgaggaacgggacattcccgagcgctcctggaactctggatacgagtggatcaccgattttcctggcaaaaccgtttggttcgtgcccagcattaagtccgggaatgacatcgctaactgccttagaaagaatggaaaacgggtgattcagctgtctcgcaagacatttgataccgaatatcagaagacaaagaacaacgactgggactacgtcgtgaccacggatatcagcgagatgggcgccaatttcagagccgaccgggttatcgatcctagacgctgcctgaaacccgtgattctcaaggacgggccggaacgggtcatcctggctggccctatgcccgtgacagttgcctccgcggctcagagacgcggacggattggcagaaaccataataaggagggggatcagtacatctatatgggacagccccttaacaatgacgaggatcacgcccactggaccgaagccaaaatgctgctcgacaacattaatacacctgagggcatcatccccgctctgtttgaacctgagcgcgaaaagagcgccgcgattgatggggagtaccggctgagaggagaggcccgcaaaaccttcgtggaactcatgagacggggcgaccttccggtctggctgtcttataaggtggcttccgaggggttccaatacagcgatcgcagatggtgttttgacggcgaacggaacaatcaggtcctggaggaaaacatggatgtggagatctggacgaaagagggagaacgcaagaaactcagaccccggtggctggacgccagaacctattccgaccctcttgctctgcgcgagttcaaggaatttgccgctggccggagatctgttagcggggatctcattctggagatcggaaagctgccccagcatctcacacagcgcgcccaaaatgcgcttgacaacctggtgatgctgcacaattccgaacagggcgggcgggcctacagacatgctatggaggagctccctgataccattgaaacactgatgcttctggccctcatcgctgtgctgaccggaggcgtcacactgttctttctctctggccgggggcttggaaaaaccagcatcggcctgctgtgcgttatggcctccagcgtgctcctgtggatggcctctgtggagccccactggattgctgcgtccatcattcttgagttctttctgatggtcctcctgatcccggagcctgaccgccagagaacgccccaggataaccaactggcctatgtggttattgggctccttttcatgatcctgacagtggctgccaatgagatgggactgctcgaaaccaccaagaaagacctgggcattgggcacgtcgccgtggagaaccatcaccatgctacaatgcttgatgtcgacctgcaccctgccagcgcgtggaccctctacgccgtggctacaacgatcatcacccccatgatgcggcatacaattgaaaacaccacagccaatatctctctgaccgctattgccaaccaggcggccatcctgatgggactcgataagggctggcctatttccaaaatggacatcggcgttccccttctggctctggggtgttacagccaggtgaatccgctcacgctgaccgccgctgtccttatgctggtggcccactatgctatcattggacctggcctccaagccaaggcgacacgcgaggcccagaagagaaccgctgccgggatcatgaaaaaccccacagttgatggaattgtggctatcgacctggatcccgtcgtgtacgacgccaagtttgaaaaacagctgggccagattatgctccttatcctgtgcacctctcaaatcctgctcatgcggacgacatgggccctgtgtgagagcattacccttgcgacagggcctctgaccaccctctgggagggatccccgggcaagttctggaatacaacgatcgctgtgtctatggccaacatttttcgcggcagctatctggctggggccggactggccttctccctcatgaaaagccttggcgggggaagacggggcaccggggctcagggagaaacactgggcgagaagtggaagcgccagctgaatcagctctccaaatctgaatttaacatctacaagagaagcggcattatggaggttgaccggtccgaagccaaagaggggctgaagagaggagagaccacacgccacgcggtctctcggggcaccgccaaacttagatggttcgtggaacgcaatctggtgaagcccgaggggaaggtcatcgatctcggatgcggcagagggggatggagctattactgtgctggcctgaaaaaggttacggaagtgaaaggctatacaaaagggggacctggccatgaggaacccattcctatggccacctacgggtggaacctggtgaaactccactccggaaaggacgtcttctttacaccccctgagaaatgcgatacacttctgtgtgacatcggcgagtctagcccgaatcccaccatcgaagaggggagaacactgcgcgtgctcaagatggttgaaccttggctgcggggaaaccaattctgcattaagatccttaatccctacatgccttccgtggtcgagacgctggagcagatgcagagaaaacatggcggcatgctcgtgcgcaaccccctgagcagaaattctacccacgaaatgtattgggtttcctgtgggacaggaaacattgtgagcgctgtcaatatgacctctagaatgctgctcaaccgctttacaatggcccaccggaagccgacctacgagaaagatgtggacctgggcgcggggacgagacatgtggccgtcgaacctgaggttgctaaccttgatatcattggacagcgcatcgaaaatatcaagcacgagcataaatccacctggcactatgacgaggataacccctacaagacatgggcctatcatggcagctacgaagtgaagccctctgggtccgctagctccatggtgaatggagtcgtgaaactgctcaccaagccttgggacgttattcccatggtgacacaaatcgccatgaccgatacaacccctttcggccagcagagagtctttaaagagaaggtggacacgcggacaccgaaagctaagcgcggcaccgttcaaattatggaagtgaccgccagatggctgtgggggttccttagccggaacaagaaacccagaatctgcacacgggaggaatttacgcgcaaggtcagatctaatgcggccattggagctgtgttcgttgacgagaaccagtggaatagcgccaaagaggctgtggaagatgagcggttttgggacctggtcaagaaagaacgcgagctccacaagcagggcaagtgcgccacctgtgtgtataacatgatggggaaaagagaaaagaaactgggagagttcggcaaggccaaagggtcccgggcgatctggtacatgtggctgggcgctcgctttctcgagttcgaagccctgggatttatgaatgaggatcactggttctctagagaaaacagcctttccggcgtcgagggggagggactgcataagctcggctacatcctgcgggacatttctaaaatccctgggggaaatatgtatgccgatgacacagctggctgggatacccgcattacagaagacgatcttcagaacgaggccaagatcaccgacattatggaacccgagcacgctctgctcgccacaagcatcttcaagctgacctaccaaaataaagtggttagagtgcagcggcctgcgaagaacgggacggtcatggatgtgatctcccgcagagaccagcggggctctggacaggtgggcacctatgggctgaatacatttaccaacatggaagcccaactcattcgccagatggagagcgagggaatcttcctgccctccgaacttgagacaccgaacctggctgaaagagttctcgattggctggagaaatacggcgtggaacggcttaagagaatggccattagcggggacgactgcgtcgtgaaacctatcgatgaccgctttgctaccgccctgacggcgctcaatgatatgggaaaggttcggaaggacattccccagtgggagccttctaaaggctggaacgattggcagcaagtgcccttctgttcccatcactttcaccagctgatcatgaaggacgggagagagattgtcgtgccttgccgcaatcaggatgaactggtcggccgggccagagtgagccagggagctggctggtctctccgcgagacagcctgtctggggaaatcctatgctcaaatgtggcagcttatgtacttccatcggagagacctgcgcctcgccgctaacgccatctgcagcgcggttcccgtggattgggtcccgacctcccggacaacctggtctatccacgcccatcaccagtggatgacgaccgaagacatgctgagcgtgtggaatagagtttggattgaggaaaacccttggatggaggataagacacatgtgtccagctggggagacgtcccctatcttggcaaacgcgaggaccaatggtgtgggtctctgatcggactcaccgctcgggccacatgggcctccaatattcaggtggctatcaaccaggtgagacggctgattggcaatgaaaactacctggattacatgaccagcatgaagagatttaagaatgagggggaccccgaaggcgccctctggtga

SEQ ID NO: 19207 - RNA, 9879 nt, synthetic construct
  misc_feature 1..9879: note = derived and/or modified CDS sequence (opt5) from DENV-1__GU131767__SS-prME
  source 1..9879: mol_type = other RNA
agcgtgacaatgctgctgatgctgatgcccacggcccttgctttccacctgacgaccagaggaggggagcctcatatgatcgtctccaagcaggaacggggaaagtctctcctgtttaagacaagcgttggcgtgaacatgtgcacccttattgccatggacctgggggagttctgtgaagatacaatgacctacaaatgcccgcgcatcacagaggcggaacccgacgatgtggactgttggtgcaatgctaccgatacgtgggttacctatggaacatgttcccaaaccggcgagcacagacgggacaagcgctctgtggccctcgcccctcatgttgggctgggactggagacaagaaccgaaacgtggatgagctccgagggcgcttggaaacagattcagcgggtggaaacatgggccctccgccaccccggctttaccgtcatcgctctgttccttgcccatgcgattgggacatctatcacccagaagggaatcatttttatcctgctcatgctggtgacccctagcatggccatgagatgcgttggcattgggtcccgggatttcgtggagggacttagcggcgctacatgggtcgacgtggtgctggagcacgggtcttgtgtcacgaccatggccaaggataaacccacactcgacatcgaactgctgaagaccgaggttacaaaccctgctgtgctccgcaaactgtgcattgaagccaagatctccaataccacgacagatagcagatgtccgacccaaggagaggcgacccttgtggaggaacaggacgccaactttgtctgccggcgcacattcgtggatagaggctggggcaatgggtgtggactgtttggcaaagggtctctcattacctgcgctaagttcaagtgcgttacaaaactggagggaaagatcgtgcagtacgaaaaccttaaatattccgtcatcgtgacggttcacaccggcgaccagcatcaagtggggaatgagagcacagaacacggaaccacagccaccattacgccccaggctccttctaccgagatccagctgacagactacggcgccctcaccctggattgtagcccccggacaggcctggactttaacgaaatggtcctcctgaccatgaaggagaaaagctggcttgtgcataagcagtggttcctggatctccctctgccctggacgtccggggcctctacaagccaagagacctggaatcgccaggaccttctggtcacatttaaaaccgctcacgcgaagaagcaggaagtggttgtgctcggatcccaagagggcgccatgcacaccgctctgacaggggccacggaaattcagaccagcggaacaaccacaatcttcgccggccatctgaaatgcagactcaagatggataaactgacccttaaggggatgtcttatgtcatgtgtacgggctccttcaaactggagaaggaagtggctgagacacagcacggaaccgttctcgtgcagattaagtacgagggcaccgacgccccgtgcaaaatcccttttagcacacaagatgaaaagggggtcacccagaacggacggctgatcacagcgaatcccattgtgacggacaaagagaagcctgtgaacatcgaagctgagccgcccttcggcgagtcttatattgttatcggggccggagaaaaagccctgaaacttagctggtttaagaaaggctcctctattgggaagatgttcgaggctaccgccagaggcgctcgccggatggccatcctcggagatacagcgtgggactttggcagcatcgggggagtcttcacctccgtgggcaaactggtgcatcagatttttgggacagcctacggagtcctgttcagcggcgtgtcttggaccatgaagatcgggattggcgttctcctgacgtggcttggactcaattccagaagcacctctctctccatgacatgtatcgctgtgggcctggtcaccctgtaccttggggtgatggttcgcgccgatagcggatgcgtgattaactggaaaggccgggaactcaagtgtgggtccggaatctttgtcacaaatgaggtgcacacctggacagaacagtataagttccaagctgactctcctaaaagactgagcgccgcgattggcaaggcctgggaggagggggtttgcggcatccgctccgctacccggctggaaaacatcatgtggaaacagatttctaacgagctcaatcatatcctgcttgaaaacgacatgaagctgacggtggtcgtgggagatgtggccggcattctcgctcaggggaaaaagatgatcagaccgcagcccatggagtacaaatatagctggaagtcctggggaaaggccaaaattatcggcgccgacgtccaaaatacaacctttatcattgatgggcctaacacccccgaatgtcctgacgatcagcgcgcttggaatatctgggaggttgaggactacggattcggcatttttacaaccaacatctggctgaagctgcgggatagctatacacaggtgtgcgaccacagacttatgtctgcggccattaaagattccaaggctgtgcacgccgacatgggctactggatcgaaagcgagaaaaatgaaacatggaagctcgcccgcgcttctttcatcgaggtcaagacctgtatttggcccaaatcccatacactgtggagcaacggggtgctggaatctgagatgatcattccgaagatctatggaggccctattagccagcacaattaccggcccgggtacttcacccaaacagccggaccttggcatctcggcaaactggagcttgattttgacctgtgcgaagggaccacggttgtggtcgatgagcactgcggaaacagaggcccctccctccggaccacaaccgtgacaggcaagatcatccacgaatggtgttgccgcagctgtaccctgcctcccctgagattcaaaggggaggacggatgctggtatggcatggagattcggccggttaaggaaaaggaggaaaatcttgtgaaatctatggtctccgcggggagcggagaggtggactccttttctctcggcctgctgtgtatcagcattatgatcgaagaggttatgagatcccgctggtctcggaagatgctcatgacggggacactggctgtgttctttcttctgattatgggacagctcacctggaacgatctgatcagactgtgcattatggtcggcgccaatgccagcgaccgcatgggcatggggacaacctaccttgctctgatggccaccttcaaaatgagacctatgtttgcggtgggactcctgttccggcgcctcacatccagagaggtgctgcttctgacgatcggcctctctctggtcgctagcgttgaactgcccaactcccttgaggaactgggggatggactcgccatgggcatcatgattctgaagctcctgaccgactttcagagccatcaactttgggccacactgctctctctgaccttcatccggacaaccttttccctgcactatgcttggaaaacgatggccatggtgcttagcattgtgtctctgttccccctctgtctgtccacaaccagccagaagaccacatggctccctgtcctgcttgggtctctgggatgcaagccgctgaccatgtttctcatcgctgagaataaaatttggggccgcaagtcctggcccctgaacgaaggcatcatggccgtggggatcgttagcattcttctgtccagcctcctgaaaaacgatgtgcctctcgcgggacccctgatcgccggcgggatgcttattgcttgttacgtcatctctggaagctccgccgacctgtctctggagaaggctgccgtggttagctgggaggaagaggccgaacattccggcgcttctcacaatattctcgtggaggtccaggatgacgggacaatgaaaatcaaggatgaagagagagacgatacgctgaccatccttctgaaagcgacactcctggccgtgagcggagtctatcctctctccattcccgctaccctgttcgtgtggtacttctggcagaagaagaaacaacggtctggcgttctttgggacacaccttcccctcccgaggtggaacgcgccgtcctggatgacggcatctatagaattatgcagcgggggctgctcggacgctcccaggtgggcgttggggtgtttcaggagaacgtcttccataccatgtggcacgtgacgagaggagccgtgctgatgtaccaaggcaagcggcttgaacccagctgggcttctgttaaaaaggacctgatctcctacgggggaggctggagactccagggcagctggaataccggggaggaggtccaggtgattgccgtggaacccggcaagaatcctaagaatgtccagacagcgcccggcacctttaagacatctgagggggaagtgggagctatcgccctggatttcaaaccgggcacctccgggagccctattgttaaccgcgagggaaagatcgtgggcctctatggcaatggggtcgtgacaacgtccggaacctacgtttctgccatcgctcaagccaaagcgagccaggaaggccccctgcctgagattgaggacgaagtgtttcggaagagaaaccttacaatcatggatctgcaccccgggtccggaaaaacccgccggtatctgcccgctattgtcagagaggccatcaagcgcaagctccggaccctgattcttgcccctacaagagtggttgctagcgaaatggccgaggctctgaaaggcatgccgatccgctaccagacgaccgccgtgaagtctgaacatacagggaaagagatcgtcgacctcatgtgccacgcgaccttcacaatgcggctgctgtcccccgtgagagtgcctaattataacatgattatcatggatgaggcccattttaccgaccccagctctattgctgcccggggctacatcagcacgcgcgtcggaatgggcgaagctgccgccattttcatgacagctacccctcccgggtccgttgaggcgtttcctcaatctaatgccgtgatccaggatgaagagagagacatcccggaacggagctggaactccggatatgagtggattaccgatttccccggcaagacagtgtggtttgtcccttctatcaaaagcgggaatgacattgctaactgtctccgcaagaatggaaagagagtgatccagctttcccggaaaaccttcgatacagagtaccagaagaccaaaaacaacgactgggactacgttgtgacgacagatattagcgaaatgggcgccaatttcagagccgaccgcgtcatcgatccccggagatgcctgaagcctgtgattctgaaagacgggcccgagcgcgttatcctcgctggcccgatgcctgtgaccgtcgcctctgcggctcaacggagaggacgcatcggccggaaccacaataaggaaggggatcagtatatttacatgggacagcccctgaacaatgacgaggatcatgcccactggacagaggccaagatgcttctggacaacatcaatacccccgaaggcattatccctgctctctttgagcccgaaagagagaaatccgccgcgattgatggggaatatcgcctgagaggagaggcccggaagacgttcgtggagctgatgcgcagaggcgacctccctgtctggcttagctacaaagtggcttccgaagggtttcagtattctgatcggcgctggtgcttcgacggcgagagaaacaatcaagttctggaagagaacatggatgtggaaatctggaccaaggagggagagcggaaaaagctgagaccgcgctggctcgacgcccggacatacagcgaccccctggctcttagagaatttaaagagttcgccgctggccgccggtccgtgtctggggatctgatcctcgaaattggaaagctgcctcagcacctgacccagagagcccagaatgcgctcgacaaccttgtcatgctgcataatagcgagcaaggcgggcgggcctatcgccacgctatggaggaactgcccgatacaatcgagaccctcatgctgcttgccctgattgctgttctcacaggaggcgtgaccctgtttttcctgtccggcagagggctcggaaagacgagcatcggccttctgtgtgtgatggcctcttccgtcctgctctggatggccagcgtggaacctcattggattgctgcgtctatcatcctggagtttttccttatggttctgctcattcccgaaccggaccggcagcgcacacctcaggataaccagctggcctacgtggtcatcgggctgctctttatgattcttaccgtggctgccaatgagatgggactgctggagaccaccaagaaggacctcggcatcgggcacgtcgccgtggaaaaccaccatcacgctgccatgctggatgttgaccttcatcccgcgtccgcctggaccctgtacgctgtggccacaacgattatcacccctatgatgagacacacaattgagaacaccacagctaatatcagcctcaccgccatcgcgaaccaagccgctattctgatgggactggataaaggctggcccatctctaagatggacattggcgtccctctccttgccctggggtgctatagccaggtgaatcccctgacgctcaccgctgccgttctgatgcttgtggctcattacgccatcattggaccgggcctgcaggcgaaagccacacgggaagctcaaaagcgcaccgccgctgggatcatgaagaaccctacagtcgatggaatcgtggccattgacctcgatcccgtggtttatgacgccaaattcgagaagcagctgggccagatcatgctgctcattctttgtacctcccagatcctgctgatgagaacgacatgggcgctctgcgaatctattaccctggctacagggccccttaccaccctgtgggagggaagccctggcaaattttggaatacaacgatcgccgtctccatggctaacatcttccggggcagctacctcgccggggccggactggctttctccctgatgaagtctctcggcgggggacgcagaggcaccggggcccaaggagagacacttggcgaaaaatggaagcggcagctgaatcagctgagcaagtccgagtttaacacctataaaagatctggcattatggaagtggaccgcagcgaggcgaaggaagggctcaaacggggagagacaaccaagcacgccgtgtccagaggcacggctaaactgcgctggttcgtcgagcggaatcttgttaagccggaagggaaggtgatcgatctgggatgtggcagagggggatggtcttactattgcgccggcctcaaaaaggtgacagaggtcaaaggctacaccaaagggggacccggccacgaggaacctattcccatggctacctacgggtggaacctggtgaaactgcatagcggaaaggacgtctttttcatccctcccgaaaaatgtgatacactcctttgcgacattggcgagtccagccctaatccgaccatcgaggaagggcgcacactgcgggtgctgaagatggtcgagccctggctcagaggaaaccagttttgtattaagatcctgaatccttatatgccctctgtggttgaaacgcttgagcaaatgcagcgcaaacacggcggcatgctggtgcggaaccctctctccagaaatagcacccatgagatgtactgggtctcttgcgggacaggaaacatcgtgtccgccgtgaatatgaccagccgcatgctgctgaaccggttcacaatggcgcacagaaagcccacctatgaacgcgatgtcgacctcggcgccgggacgagacacgttgctgtggagccggaagtggccaacctggatattatcggacagcggattgagaatatcaaacatgaacacaagtctacctggcattacgacgaggataacccttataaaacatgggcttaccacggctcctatgaggtcaagcccagcgggtccgccagctctatggtgaatggagttgtgaaacttctgaccaaaccctgggacgtcattcctatggtgacacagatcgctatgaccgatacaaccccctttggccaacagcgcgttttcaaggaaaaagtggacacgagaacacctaaggccaaacggggcaccgcgcagatcatggaggtcaccgccaagtggctctgggggtttctgagcagaaacaagaaaccgcggatttgtacacgcgaagagttcacgagaaaggtgcggtccaatgctgccatcggagctgtttttgtggacgaaaaccaatggaactctgccaaagaggccgtcgaggatgaacgcttctgggaccttgtgcatagagagcgggaactgcacaagcagggcaaatgcgcgacctgcgtctacaacatgatggggaagcgcgagaagaaactcggagaatttggcaaggctaaagggagcagagccatttggtacatgtggctgggcgcccggttcctggagttcgaggctctcggatttatgaatgaagatcactggttctcccgcgagaactctctgagcggcgtggaaggggagggacttcataagctgggctatatcctcagagacatttccaaaatccccgggggaaatatgtacgccgatgacacagctggctgggatacccggatcacagaggacgatctgcagaacgaagccaagattaccgacatcatggagcctgaacacgcgcttctggccaaatctatttttaagctcacatatcagaataaggttgtgcgcgtccaaagacccgctaaaaacgggaccgtgatggatgtgatcagccggcgcgaccagagaggctccggacaggttggcacgtacgggctgaataccttcacaaacatggaggcccagctgattcggcaaatggaaagcgagggaatcttttctccttccgagctcgaaacccccaacctggctggcagagtgcttgattggctggagaagcatggggtcgaacgcctcaaacggatggccatcagcggagacgactgtgtggttaagccgattgatgacagattcgcgacagccctgaccgctcttaatgatatgggcaaagtgcgcaaggacatccctcagtgggagccctctaaggggtggaacgattggcagcaggtccctttttgctcccaccacttccatcaactgattatgaaagacggccgggaaatcgtggtcccctgtagaaatcaggatgagctcgtgggacgcgcccgggttagccagggcgctgggtggtccctgagagagacggcctgcctgggaaagtcttatgctcagatgtggcaactcatgtactttcaccgccgggacctgagacttgccgcgaacgccatttgtagcgctgtgcctgtcgattgggtgcccacatcccgcaccacatggagcatccatgcccaccatcagtggatgaccacggaagacatgctgtctgtttggaatcgggtgtggattgaggaaaacccgtggatggaggataaaacccacatctccagctggggcgacgtcccttatctcgggaagagagaagaccagtggtgcggatctctgatcggccttacagcccgggctacctgggccacaaatattcaagtggcgatcaaccaggtgagacgcctgctcgggaatgagaactacctggattacatgaccagcatgaaacggttcaagaatgagtccgaccccgaaggcgctctgtggtga

SEQ ID NO: 19208 - RNA, 9879 nt, synthetic construct
  misc_feature 1..9879: note = derived and/or modified CDS sequence (opt5) from DENV-1__HM181967__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagaccagcgccggcgttaacatgtgcacccttatcgcgatggacctgggggaactctgtgaagataccatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggacgatgaaaatcaaggatgaggagcgggacgataccctgacaatccttctgaaagccaccctcctggctgtgtctggagtctatcctctcagcattcccgccacactgttcgtgtggtacttctggcaaaagaaaaagcagcgctccggcgtcctttgggacaccccttctcccccggaagtggagagagccgttctggatgacggcatctatcggattatgcagcgcgggctgctcggaagaagccaggtgggcgtcggggtgtttcaagaaaacgttttccatacgatgtggcacgtgacccggggagctgtcctgatgtaccagggcaagagacttgagccttcctgggccagcgtgaaaaaggacctgatctcttacgggggaggctggcgcctccagggctcctggaatacaggggaggaagtgcaggttattgcggtcgagcccggcaagaaccctaagaatgtgcaaaccgctcccggcacatttaaaaccccggaaggggaggtgggagccatcgccctggatttcaagcctggcacaagcgggtctcccattgtcaaccgggaaggaaagatcgtgggcctctatggcaatggggttgtgacgacctccggaacatacgtcagcgctatcgcccaggcgaaggcttcccaggagggccctctgcccgagattgaagacgaggtgtttagaaagcgcaaccttaccatcatggatctgcaccccgggtctggaaaaacccggagatatctgcctgccattgttcgcgaagccatcaagcggaaactcagaacactgattcttgctccgacgcgcgtggtcgccagcgagatggctgaagccctgaagggcatgcccatccggtaccaaaccacagcggtgaagtccgagcataccgggaaagagatcgttgacctcatgtgccacgccacattcaccatgagactgctgagccctgtgcgggtccccaattataacatgattatcatggatgaagctcattttacggacccttcttccattgccgctcgcggctacatcagcacaagagtgggaatgggcgaggccgccgctattttcatgaccgcgacaccccctgggtctgtggaagcctttccgcagagcaatgctgtcatccaggatgaggaacgggacatccccgagcgctcctggaactctggatatgagtggattacagatttccctggcaagaccgtttggtttgtgcccagcatcaaatccgggaatgacattgccaactgtctcagaaagaatggaaaacgggtgatccagctttctagaaagacattcgataccgaataccaaaagacgaaaaacaacgactgggactacgtcgtgacaaccgatattagcgagatgggcgccaatttccgcgctgaccgggttatcgatcctagacgctgcctgaagcccgtgattctgaaagacgggccggaacgggtcatcctcgccggccctatgcccgtgacagttgcgtccgctgcccagagacgcggacggatcggcagaaaccacaataaggagggggatcagtatatttacatgggacagcccctgaacaatgacgaggatcatgcccactggaccgaagctaaaatgcttctggacaacatcaatacgcctgagggcattatccccgccctctttgaacctgagcgcgaaaagagcgcggccattgatggggagtatagactgcggggagaggctcgcaagaccttcgtggaactgatgagacggggcgacctcccggtctggctttcttacaaagtggcctccgaggggtttcaatatagcgatcgcagatggtgcttcgacggcgaacggaacaatcaggtcctggaggaaaacatggatgtggagatctggacaaaggagggagaacgcaagaaactgcgcccccggtggctcgacgctagaacctactccgaccctctggcccttcgcgagtttaaagagttcgctgccggccggagatctgttagcggggatctgatcctcgagattggaaagctgccccagcacctgacacagcgggcgcaaaatgccctcgacaaccttgtgatgctgcataattccgaacagggcgggcgcgcttatagacacgccatggaggagctgcctgataccatcgaaacactcatgctgcttgctctgattgccgtgctcaccggaggcgtcacgctgtttttcctgtctggccgggggctcggaaaaacaagcatcggccttctgtgtgttatggcctccagcgtgctgctctggatggcttctgtggagccccattggattgcggcctccatcatcctggaatttttccttatggtcctgctcattccggagcctgaccgccagagaacaccccaggataaccaactggcttacgtggttatcgggctgctctttatgattcttaccgtggccgccaatgagatgggactgctggaaacaaccaagaaggacctcggcatcgggcacatggctgtcgagaaccaccatcacgccgcgatgctggatgtggaccttcatcctgccagcgcttggacactgtacgccgtcgctacgaccattatcacacccatgatgcggcacaccattgaaaacacaaccgccaatatctctctcacggcgatcgccaaccaggctgccattctgatgggactggataaaggctggcctatctccaagatggacattggcgtgcccctccttgctctggggtgctatagccaggttaatccgctgaccctcacagccgctgtgctgatgcttgtcgcccattacgcgatcattggacctggcctgcaagccaaagctacccgcgaggcccagaagagaacagctgccgggatcatgaaaaaccccaccgtggatggaatcgttgccattgacctcgatcccgtggtctatgacgcgaagttcgaaaagcagctgggccagatcatgctgctcattctttgtacgtctcaaatcctgctgatgcggacaacctgggctctctgcgagagcattacactggccaccgggcctcttaccacactgtgggagggatccccgggcaaattttggaatacgaccatcgctgtgtctatggccaacatcttccgcggcagctacctcgccggggctggactggccttctccctgatgaaaagcctcggcgggggaagacggggcacaggggcgcagggagaaacccttggcgagaaatggaagagacagctgaatcagctgtccaaatctgaatttaacacatataagcgcagcggcattatggaggtggaccggtccgaagccaaggaggggctcaaaagaggagagaccacgaagcacgctgtttctcgcggcacagccaaactgcggtggttcgtcgaaagaaatcttgtgaagcccgaggggaaagtgatcgatctgggatgtggccgcgggggatggagctactattgcgctggcctcaagaaggtcaccgaagttaaaggctacaccaaaggcgggcctgggcacgaggaacccattcctatggccacatacgggtggaacctggtgaaactgcattccggaaaggacgtgtttttcattccccctgagaaatgtgataccctcctttgcgacattggcgagtctagcccgaatcccacaatcgaagaggggcggacgctgagagtcctgaagatggtggaaccttggctccgcggaaaccaattttgtattaaaatcctgaatccctatatgccttccgttgtggagacccttgagcagatgcagcggaagcacggcggcatgctggtcagaaaccccctcagccgcaattctacacatgaaatgtactgggtgtcctgcgggaccggaaacatcgttagcgcggtgaatatgacatctcggatgctgctgaacagattcaccatggcccaccgcaagccgacgtatgagagagatgtcgacctcggcgctgggacccggcacgtggccgtggaacctgaggtcgctaacctggatattatcggacagcgcattgaaaatatcaaacatgagcacaagtccacatggcattacgacgaggataacccctataaaacctgggcctaccacggcagctatgaagttaagccctctgggtccgctagctccatggtgaatggagtggtcaaacttctgacaaagccttgggacgtgattcccatggttacccaaatcgccatgacagataccacgccttttggccagcagagagtgttcaaggagaaagtcgacacacggaccccgaaggcgaaaagaggcaccgcccaaatcatggaagtgacagctaagtggctctgggggtttctgagccggaacaaaaagccccgcatttgtacgagagaggagttcacccggaaggttcgctctaatgccgctatcggagccgtgtttgtcgacgagaaccagtggaatagcgccaaagaggcggtggaagatgagagattctgggaccttgttcatcgggaacgcgagctgcacaagcagggcaaatgcgctacatgcgtgtacaacatgatggggaagagagagaaaaagctcggagagtttggcaaggccaaagggtcccgggccatttggtacatgtggctgggcgctcgcttcctggagttcgaagccctcggatttatgaatgaggatcactggttctctagagaaaacagcctgtccggcgtcgagggggagggacttcataagctgggctatatcctccgggacatttctaaaatccctgggggaaatatgtacgctgatgacaccgccggctgggatacacgcatcaccgaagacgatctgcagaacgaggcgagaattacagacatcatggaacccgagcacgcccttctggctaagagcatttttaaactcacctatcaaaataaggtggtccgggtgcagcgccctgccaaaaacgggacggttatggatgtgatctccagacgggaccagagaggctctggacaggtcggcacctacgggctgaatacattcaccaacatggaagctcaactgattcgccagatggagagcgagggaatcttttcccccagcgaactcgagacaccgaacctggccgaacgggtgcttgattggctggagaagtatggcgtggaaagactcaagcgcatggcgatctctggggacgactgtgttgtgaaacctattgatgaccggttcgccaccgctctgacggcccttaatgatatgggaaaggtcagaaaagacatcccccagtgggagccttccaagggctggaacgattggcagcaagtgcccttttgcagccatcacttccaccagctgattatgaaagacgggcgcgagatcgttgtgccttgtcggaatcaggatgaactcgtcggcagagctcgcgtgtctcagggagccggctggtccctgcgggagacagcttgcctgggaaagagctacgcccaaatgtggcagctcatgtattttcatagacgcgacctgcggcttgcggccaacgctatttgttccgccgtccccgtggattggatcccgacctctagaacaacctggagcattcacgcccatcaccagtggatgacgaccgaagacatgctgtccgtttggaatcgggtgtggatcgaggaaaacccttggatggaggataagacacatatcagctcttggggagacgtcccctacctcggcaaaagagaggaccaatggtgcgggtccctgattggacttaccgctcgcgccacatgggcgaccaatatccaggtggctattaaccaggttcggagactgatcggcaatgaaaactacctcgattatatgacaagcatgaagcgcttcaaaaatgagtctgaccccgaaggggccctgtggtga

SEQ ID NO: 19209 - RNA, 9879 nt, synthetic construct
  misc_feature 1..9879: note = derived and/or modified CDS sequence (opt5) from DENV-1__GU131768__SS-prME
  source 1..9879: mol_type = other RNA
agcgtgaccatgctgctcatgctgatgcccaccgcccttgctttccacctgacgaccagaggcggggaacctcatatgatcgtgacaaagcaggaacggggaaaatccctcctgtttaagacctctgccggcgttaatatgtgcacacttattgcgatggacctgggggaactctgtgaagataccatgacatacaaatgcccccgcatcaccgaagctgaacccgacgatgtggactgttggtgcaatgccacggatacctgggtgacatatggaacctgtagccaaacaggcgaacaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgttacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctgtcgggggagtttttacaagcgtcggcaaactggtgcatcagatcttcgggaccgcttacggagtgctcttttccggcgtcagctggacgatgaagattgggatcggcgtgctgcttacctggctgggactcaattctagatccacaagcctgtctatgacctgtattgccgttggcctggtgacactttacctcggggtcatggtgcaggctgattccggatgcgttatcaactggaaaggccgcgaactgaagtgtgggagcggaattttcgtgaccaatgaggtccacacatggaccgaacaatataagtttcaggccgactcccctaaacggctgtctgcggccatcggcaaggcttgggaggagggggtgtgcggcattagaagcgccacgcgcctcgaaaacatcatgtggaaacagatctccaacgagctgaatcatattcttctggaaaacgacatgaagttcacagttgtggtcggagatgtggtgggcatcctcgctcaggggaaaaagatgattcggccgcaacccatggagcacaaatactcttggaaaagctggggaaaggccaagatcattggcgccgacgtccagaataccacctttatcatcgatgggcctaacacacccgaatgtcctgacgatcagagagcttggaatatttgggaggttgaggactatggattcggcatctttaccacgaacatttggctgaagctgcgcgattcctacacacaggtgtgcgaccaccggcttatgagcgcggccatcaaagattctaaggctgtgcatgccgacatgggctattggattgaatccgagaaaaatgaaacctggaagctcgccagagctagcttcatcgaggtcaagacatgtaactggcccaaatctcacaccctgtggtccaatggggtgctggaaagcgagatgatcattccgaagatctacggaggccctatttctcaacataactatcgccccgggtacttcacacagaccgccggaccttggcacctcggcaaactggagcttgattttgacctgtgcgaagggacgaccgttgtggtcgatgagcactgcggaaatcggggccccagcctcagaacaaccacagtgaccggcaagatcattcatgaatggtgttgccggtcctgtacgctgcctcccctgcgcttcaaaggggaggacggatgctggtacggcatggagatcagaccggttaaggaaaaggaggaaaaccttgtgaaaagcatggtctctgcggggtccggagaggtggacagcttttccctcggcctgctgtgtatctctattatgatcgaagaggttatgcggagcagatggtcccgcaagatgctcatgacagggaccctggctgtgttccttctgctcattatgggacagctgacatggaatgatctgatccggctttgcattatggtcggcgccaacgcctctgacagaatgggcatggggaccacctatctggctctcatggccacatttaaaatgcgccctatgttcgcggtgggactgctctttagacggctgacgagccgcgaggtgcttctgctcaccatcggcctgtccctggtcgcttctgttgaacttcccaatagcctggaggaactcggggatggactggccatgggcattatgatcctcaagctgcttacagacttccaatcccaccagctgtgggccaccctcctgagcctgacatttatcaaaaccacgctttctctgcattacgcttggaagacaatggccatggtgctctccattgtgagcctgttccccctctgtctgtctaccacctcccagaagacaacctggcttcctgtcctgctggggagcctcggatgcaaaccgctgacaatgtttcttatcacggagaacaagatttggggcagaaaatcttggcccctgaacgaaggcatcatggctgtgggggttgtgtccattctcctgagctccctcctgaagaatgatgtccctcttgccggacccctgatcgcgggcgggatgctgatcgcctgttatgtgattagcggatctagcgctgacctctccctggagaaagccgctgaggtttcttgggaagaggaagccgagcacagcggcgcctcccataacatccttgtggaagtccaggatgacgggaccatgaagattaaagatgaggagcgggacgatacactgaccatcctcctgaaggctacactcctggcggtgtctggagtctaccctcttagcattcccgccaccctgttcgtgtggtatttttggcaaaagaaaaagcagcgctccggcgttctgtgggacacgccttctcccccggaagtggagagagctgtcctcgatgacggcatctaccggatcatgcagcgcgggctgcttggaagaagccaggtgggcgttggggtgttccaagaaaatgtcttccacaccatgtggcacgtgacacggggagccgtgctgatgtatcagggcaaacgcctcgagccttcctgggccagcgttaagaaagacctgatttcttacgggggaggctggagactccagggctcctggaacaccggggaggaagtccaggtgatcgctgtggagcccggaaagaatcctaagaacgtccaaacagcccccggcacctttaaaacaccggaaggggaggtgggagcgattgctctggatttcaagcctggcacgagcgggtctcccatcgttaatcgggaaggaaaaattgtgggcctttacggcaacggggtcgtgaccacatccggaacctatgttagcgccatcgcccaggctaaggcctcccaggagggccctctgcccgagattgaagacgaggtgtttagaaaacgcaatctgaccatcatggatctccatcccgggtctggaaagacacggagatacctgcctgcgatcgtccgcgaagctattaagcggaaacttagaacgctgatcctcgccccgacccgcgtggttgccagcgagatggctgaagccctgaagggcatgcccattcggtatcaaacaaccgctgtgaaatccgagcacacagggaaggagatcgtcgacctgatgtgccatgccaccttcacgatgagactccttagccctgtgcgcgtgcccaactacaatatgattatcatggatgaagcgcactttacagacccttcttccatcgccgctcggggctatattagcaccagagtcggaatgggcgaggccgctgccatcttcatgaccgccacaccccctgggtctgttgaggcttttccgcagagcaacgcggtgattcaggatgaggaacgggacatccccgagcgctcctggaactctggatacgagtggattaccgatttccctggcaaaacagtgtggtttgtccccagcatcaagtccgggaacgacatcgccaattgtctgagaaagaacggaaaacgggtgattcagctgtctcgcaagaccttcgatacggaatatcagaagaccaagaacaatgactgggactacgttgtgaccacagatatcagcgagatgggcgctaactttagagccgaccgggtcattgatcctagacgctgcctcaaacccgtgatcctgaaggacgggccggaacgggttattcttgccggccctatgcccgtgaccgtcgcttccgccgcgcagagacgcggacggatcggcagaaatcataacaaggagggggatcagtacatttatatgggacagcccctgaataacgacgaggatcacgctcactggacggaagccaaaatgctcctggacaatatcaacacccctgagggcatcattcccgccctgttcgaacctgagcgcgaaaagagcgctgccatcgatggggagtaccggctcagaggagaggcgcgcaaaacattcgtggaacttatgagacggggcgacctgccggtctggctgtcttataaggtggcctccgaggggtttcaatacagcgatcgcagatggtgcttcgacggcgaacggaataaccaggttctcgaggaaaatatggatgtggagatttggaccaaagagggagaacgcaagaaactgagaccccggtggcttgacgctagaacatattccgaccctctggccctccgcgagtttaaggagttcgctgccggccggagatctgtgagcggggatctgatcctggagattggaaagctcccccagcatcttacccagcgcgctcaaaacgccctggacaatctggtcatgctccacaactccgaacagggcgggcgggcgtacagacatgccatggaggagctgcctgatacaatcgaaacccttatgctgctcgctctgatcgccgttctgacgggaggcgtgacactctttttcctttctggccgggggctgggaaaaaccagcattggcctgctctgtgtgatggcttccagcgtcctgctttggatggcctctgtggagccccactggatcgccgcttccattatcctggaatttttcctcatggttctgctgattccggagcctgaccgccagagaacaccccaggataatcaactcgcgtatgtggtcatcgggcttctgtttatgatcctgacagtggccgctaacgagatgggactcctggaaaccacaaagaaagaccttggcattgggcacgtcgccgtggagaaccatcaccatgccacgatgctggatgttgacctccaccctgctagcgcctggaccctgtacgcggtggccacaaccatcattacacccatgatgcggcataccatcgaaaatacgaccgctaacatttctctgacagccatcgctaatcaggccgcgattctcatgggacttgataagggctggcctatctccaaaatggacatcggcgtccccctgctggccctcgggtgctacagccaggtgaacccgctgacccttacagctgccgttctgatgctcgtggctcactatgccattatcggacctggcctgcaagctaaggccacccgcgaggcgcagaagagaacggccgctgggattatgaaaaatcccacagtcgatggaatcgtggccattgacctggatcccgtggtttacgacgctaagttcgaaaaacagctcggccagatcatgcttctgatcctgtgtacctctcaaattctcctgatgcggacaacctgggccctttgcgagagcatcaccctggccacagggcctctcacgaccctgtgggagggatccccgggcaagttttggaacacaaccattgcggtctctatggctaatatcttccgcggcagctatctggccggggctggactcgccttttcccttatgaaaagcctgggcgggggaagacggggcacaggggcccagggagaaaccctgggcgagaagtggaagcgccagctcaaccagctgtccaaatctgagttcaatatttacaagagaagcggcatcatggaggtggaccggtccgaagctaaagaggggcttaagagaggagagacgacacgccacgccgtgtctcggggcaccgcgaaactgagatggttcgtcgaacgcaacctcgttaagcccgaggggaaggtgatcgatctgggatgtggcagagggggatggagctattactgcgccggcctgaaaaaggtgaccgaagtcaaaggctatacaaaagggggacctggccatgaggaacccattcctatggctacctacgggtggaatctcgtgaaacttcactccggaaaggacgtctttttcacaccccctgagaaatgtgatacgctgctgtgcgacatcggcgagtctagcccgaaccccaccattgaagaggggagaacactccgcgtgctgaagatggtcgaaccttggcttcggggaaatcaattttgtatcaagattctgaacccctacatgccttccgtggttgagaccctcgagcagatgcagagaaaacatggcggcatgctggtgcgcaatcccctgagccggaactctacacacgaaatgtattgggtctcctgcgggaccggaaatatcgtgagcgccgtgaacatgacgtctagaatgctcctgaaccgcttcaccatggctcaccggaagccgacatacgagagagatgtcgaccttggcgccgggacccgccatgttgcggtggaacctgaggtggccaatctggatattatcggacagagaatcgaaaacattaaacacgagcataagtccacatggcactatgacgaggataatccctacaaaacctgggcttatcatggcagctacgaagtcaagccctctgggtccgccagctccatggtgaacggagttgtgaagctcctgacaaaaccttgggacgtcatccccatggtgacccaaattgctatgacggatacaaccccttttggccagcagcgggttttcaaggagaaagtggacacccgcacaccgaaggccaaaagaggcacggctcaaatcatggaagtcaccgcccggtggctttgggggtttctgagcagaaataagaagccccggatttgtacacgcgaggagttcaccagaaaagtgcggtctaacgcggccatcggagctgtttttgtggacgagaatcagtggaacagcgccaaggaggctgtcgaagatgagcgcttctgggacctcgtgaaaaaggaaagagagctgcacaaacagggcaagtgcgccacatgcgtctataatatgatggggaagcgggagaaaaagctgggagagtttggcaaagccaaggggtcccgcgcgatctggtacatgtggctcggcgctagattcctggagtttgaagcccttggattcatgaacgaggatcactggttctctcgggaaaatagcctgtccggcgtggagggggagggactccataaactgggctacattcttcgcgacatctctaagattcctgggggaaacatgtatgccgatgacaccgctggctgggatacaagaatcaccgccgacgatctgcagaatgaagctaaaattacggacatcatggagcccgaacacgccctcctggcgaccagcatctttaagctgacataccaaaacaaggttgtgcgggtccagcgccctgccaaaaatgggaccgtgatggatgtgatttccagacgggaccagcgcggctctggacaggttggcacatatgggctcaacaccttcacgaacatggaggctcaactgatcagacagatggaaagcgagggaatttttcttccctccgagctggaaacaccgaatctcgccgagcgggtgctggattggcttgaaaagtacggcgtcgagagactgaaacgcatggctatcagcggggacgactgtgtggttaagcctattgatgaccggttcgccaccgcgctcacagccctgaacgatatgggaaaagtgagaaaggacatcccccagtgggaaccttctaagggctggaatgattggcagcaagtccccttttgctcccatcacttccaccagctgatcatgaaagacgggcgcgagattgtggtcccttgtcggaaccaggatgagctcgtgggcagagctcgcgttagccagggagccggctggtctctgcgggaaaccgcttgccttgggaagtcctatgcccaaatgtggcagctgatgtactttcatagacgcgacctccggctggctgccaatgcgatctgtagcgccgtgcccgtcgattgggtgccgacgtccagaaccacatggtctattcacgctcatcaccagtggatgaccacagaggacatgcttagcgtttggaaccgcgtgtggatcgaagagaatccttggatggaagataaaacccatgtctccagctggggagacgtgccctatctgggcaagcgggaggaccaatggtgcgggtctctcattggactgacagccagagccacctgggcttccaacatccaggtggccattaatcaggttcggagactgatcggcaacgagaattacctcgattacatgacgagcatgaaacgcttcaagaacgaaggggaccccgagggcgcgctgtggtga

SEQ ID NO: 19210 - RNA, 9879 nt, synthetic construct
  misc_feature 1..9879: note = derived and/or modified CDS sequence (opt5) from DENV-1__GU131770__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagagcaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattaccccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagcccccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattccggggggaggacggatgctggtatggcatggagattagaccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatccggcctatgtttgcggtcggactcctgttccgcagactcaccagccgggaggtgctgcttctgacaatcggcctctccctggtggcttctgtcgaactgcccaacagccttgaggaactgggggatggactcgccatgggcattatgatcctgaagctcctgaccgactttcaatcccatcagctttgggccacactgctcagcctgaccttcattaaaacgacattttctctgcactgtgcttggaagaccatggccatggttctttccatcgtgagcctgttccccctctgcctgtctaccacatcccagaaaaccacatggctccctgtgctgcttgggagcctgggatgtaagccgctgacgatgtttctcattgctgagaataagatctggggccgcagatcttggcccctgaacgaaggcatcatggccgtcgggattgtgtccatccttctgagctccctcctgaaaaacgatgttcctctcgcgggacccctgattgccggcgggatgcttatcgcttgctatgtgattagcggatctagcgccgacctgtccctggagaaggctgccgaggtctcttgggaagaggaagccgagcatagcggcgcttcccacaatatcctcgtggaagttcaggatgacgggaccatgaaaatcaaggatgaggagcgggacgatacactgaccattcttctgaaagcgacactcctggccgtgtctggagtctaccctctcagcatccccgctaccctgttcgtgtggtatttctggcaaaagaaaaagcagcgctccggcgtcctttgggacacgccttctcccccggaagtggagagagccgttctggatgacggcatttaccggatcatgcagcgcgggctgctcggaagaagccaggtgggcgtcggggtgtttcaagaaaacgttttccataccatgtggcacgtgacacggggagccgtcctgatgtatcagggcaagagacttgagccttcctgggctagcgtgaaaaaggacctgatttcttacgggggaggctggcgcctccagggctcctggaataccggggaggaagtgcaggttatcgccgtcgagcccggaaaaaaccctaagaatgtgcaaacagcgcccggcacctttaaaacaccggaaggggaggtgggagctattgccctggatttcaagcctggcacgagcgggtctcccatcgtcaaccgggaaggaaagatcgtgggcctctacggcaatggggttgtgaccacatccggaacctatgtcagcgccattgctcaggccaaagcgtcccaggagggccctctgcccgagatcgaagacgaggtgtttagaaagcgcaaccttaccattatggatctgcaccccgggtctggaaaaacacggagatacctgcctgctatcgttcgcgaagccattaagcggaaactcagaacgctgatccttgccccgacccgcgtggtcgctagcgagatggccgaagctctgaagggcatgcccatccggtatcaaacaaccgccgtgaagtccgagcatacagggaaagagattgttgacctcatgtgtcacgcgaccttcacgatgagactgctgagccctgtgcgggtccccaattacaacatgatcattatggatgaagcccattttacagacccttcttccatcgctgcccgcggctatattagcaccagagtgggaatgggcgaggctgccgccatcttcatgaccgctacaccccctgggtctgtggaagcgtttccgcagagcaatgccgtcatccaggatgaggaacgggacattcccgagcgctcctggaactctggatacgagtggatcaccgatttccctggcaagacagtttggtttgtgcccagcattaaatccgggaatgacatcgctaactgcctcagaaagaatggaaaacgggtgattcagctttctagaaagaccttcgatacggaatatcaaaagacaaaaaacaacgactgggactacgtcgtgaccacagatatcagcgagatgggcgccaatttccgcgccgaccgggttattgatcctagacgctgcctgaagcccgtgatcctgaaagacgggccggaacgggtcatcctcgctggccctatgcccgtgaccgttgcctccgcggctcagagacgcggacggattggcagaaaccacaataaggagggggatcagtacatctatatgggacagcccctgaacaatgacgaggatcatgcccactggacggaagccaaaatgcttctggacaacattaatacccctgagggcatcattcccgctctctttgaacctgagcgcgaaaagagcgccgcgatcgatggggagtacagactgcggggagaggcccgcaagacattcgtggaactgatgagacggggcgacctcccggtctggctttcttataaagtggcttccgaggggtttcaatacagcgatcgcagatggtgtttcgacggcgaacggaacaatcaggtcctggaggaaaacatggatgtggagatctggaccaaggagggagaaagaaaaaagctgcgcccccggtggctcgacgccagaacatattccgaccctctggctcttcgcgagtttaaagaattcgccgctggccggagatctgttagcggggatctgattctcgagatcggaaagctgccccagcacctgacccagcgggcccaaaatgcgctcgacaaccttgtgatgctgcataattccgaacagggcgggcgcgcctacagacacgctatggaggagctgcctgatacaattgaaaccctcatgctgcttgccctgatcgctgtgctcacgggaggcgtcacactgtttttcctgtctggccgggggctcggaaaaaccagcattggccttctgtgcgttatggcctccagcgtgctgctctggatggcctctgtggagccccattggatcgctgcgtccatcattctggaatttttccttatggtcctgctcatcccggagcctgacaagcagcgcaccccccaggataaccaactggcctatgtggttattgggctgctctttatgatccttacagtggctgccaatgagatgggactgctggaaaccacaaagaaagacctcggcattgggcacgtcgccgtggagaaccaccatcacgctgccatgctggatgtcgaccttcatcctgcgagcgcctggacgctgtacgctgtggccaccacaatcattacccccatgatgagacacacaatcgaaaacaccacggctaatatctctctcaccgccattgcgaaccaggccgctatcctgatgggactggataagggctggcctatttccaaaatggacatcggcgttcccctccttgccctggggtgttacagccaggtgaatccgctgacactcaccgctgccgtcctgatgcttgtggctcattatgccattatcggacctggcctgcaagcgaaggccacacgggaggctcagaaacgcaccgccgctgggatcatgaagaaccccacggttgatggaattgtggccatcgacctcgatcccgtcgtgtacgacgccaagttcgaaaaacagctgggccagattatgctgctcatcctttgcacatctcaaattctgctgatgagaaccacatgggcgctctgtgagagcatcaccctggctaccgggcctcttacaacgctgtgggagggatccccgggcaagttttggaataccacaatcgccgtgtctatggctaacattttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcatcatggaggttgaccgctccgaagcgaaagaggggctcaagcggggagagacgacaaaacacgccgtctctagaggcaccgctaagctgcgctggttcgtggaacggaatcttgtgaaacccgaggggaaggtcattgatctgggatgcggcagagggggatggagctattactgtgccggcctcaagaaagttaccgaagtgaagggctatacaaaagggggacctggccacgaggaacccatccctatggctacctacgggtggaacctggtgaagctgcattccggaaaagacgtctttttcattccccctgagaagtgcgatacactcctttgtgacatcggcgagtctagcccgaatcccacgattgaagaggggcgcaccctgcgggtgctgaaaatggttgaaccttggctcagaggaaaccaattttgcatcaagatcctgaatccctacatgccttccgtggtcgagacacttgagcagatgcagcgcaagcacggcggcatgctggtgcggaaccccctcagcagaaattctacccatgaaatgtattgggtttcctgtgggacaggaaacattgtgagcgccgtcaatatgacctctcgcatgctgctgaaccggttcacgatggcgcacagaaaaccgacctacgagcgcgatgtggacctcggcgccgggacaagacacgtggctgtcgaacctgaggttgccaacctggatatcattggacagcggatcgaaaatattaagcatgagcacaaatccacctggcattatgacgaggataacccctacaagacatgggcttatcacggcagctacgaagtgaaaccctctgggtccgccagctccatggtgaatggagtcgtgaagcttctgaccaagccttgggacgttatccccatggtgacacaaatcgctatgaccgatacgacaccttttggccagcagcgcgtcttcaaagagaaggtggacaccagaaccccgaaagccaagcggggcacagcgcaaattatggaagttacggccaaatggctctgggggtttctgagcagaaacaagaagccccggatctgcacccgcgaggaattcacaagaaaagtgcggtctaatgctgccattggagctgtctttgtggacgagaaccagtggaatagcgccaaggaggccgttgaagatgagcgcttctgggaccttgtgcatagagaacgggagctgcacaaacagggcaagtgcgcgacctgtgtctataacatgatggggaaacgcgaaaagaagctcggagagtttggcaaagctaaggggtccagagccatctggtacatgtggctgggcgcccggttcctggagttcgaagctctcggatttatgaatgaggatcactggttctctcgcgaaaacagcctgtccggcgtggagggggagggacttcataaactgggctacattctcagagacatctctaagatccctgggggaaatatgtatgccgatgacacagctggctgggatacccggattacagaagacgatctgcagaacgaggcccgcatcaccgacattatggaacccgagcacgcgcttctggccaaaagcatctttaagctcacgtaccaaaataaagtcgtgagagttcagcggcctgctaagaacgggaccgtgatggatgtcatttcccgcagagaccagcggggctctggacaggtgggcacatatgggctgaataccttcacaaacatggaagcccaactgatcagacagatggagagcgagggaatcttttcccccagcgaactcgagaccccgaacctggctgaacgcgtgcttgattggctggagaagtacggcgttgaacggctcaaaagaatggccatttctggggacgactgcgtggtcaagcctatcgatgaccgcttcgcgacggccctgacagctcttaatgatatgggaaaagtgcggaaggacattccccagtgggagccttccaaaggctggaacgattggcagcaagttcccttttgtagccatcacttccaccagctgatcatgaaggacgggagagagattgtggtcccttgccgcaatcaggatgaactcgtgggccgggccagagtctctcagggagctggctggtccctgcgcgagaccgcctgtctggggaagagctatgctcaaatgtggcagctcatgtactttcatcggagagacctgcgccttgccgcgaacgccatctgctccgctgtgcccgttgattggattccgacatctcggaccacgtggagcatccacgcccatcaccagtggatgaccacagaagacatgctgtccgtgtggaatagagtctggatcgaggaaaacccttggatggaggataaaacccatattagctcttggggagacgtgccctatctcggcaagcgggaggaccaatggtgtgggtccctgatcggacttacagccagagctacctgggccacaaatattcaggttgcgatcaaccaggtgcgccggctgattggcaatgaaaactacctcgattacatgaccagcatgaaaagattcaagaatgagtctgaccccgaaggggctctgtggtga

SEQ ID NO: 19211 - RNA, 9879 nt, synthetic construct
  misc_feature 1..9879: note = derived and/or modified CDS sequence (opt5) from DENV-1__GU131773__SS-prME
  source 1..9879: mol_type = other RNA
agcgtgaccatgctgctgatgctgatgcccacagcccttgctttccacctgacgaccagaggaggggagcctcatatgatcgtctccaagcaggaacggggaaaatctctcctgtttaagaccagcgccggagttaacatgtgcacccttattgcgatggacctgggggagctctgtgaagatacaatgacctacaaatgcccccgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccaaggagaagccaccctggtggaggagcaggatgctaacttcgtgtgccggcgcacatttgtcgacagaggctggggcaatgggtgtggactcttcggcaaagggtctctgcttacctgcgccaagtttaagtgcatgacaaaactggaaggaaagattgtgcagtacgagaacctcaaatattccgttatcgtgacggtccacaccggcgatcagcatcaagtggggaatgaaagcacagagcacggaaccacagctaccatcacgccccaggcccctaccacagaaattcagctgaccgactacggcgccctgacactcgactgttctccccggaccggcctggatttcaacgagatggttcttctgacgatgaaggagaaatcctggctcgtgcataagcagtggtttctggaccttcctctgccctggacaagcggggcttccacctctcaagaaacatggaatcgccaggatctcctggtcaccttcaaaaccgcgcacgccaagaagcaggaggtggtcgtgctgggaagccaagaaggcgctatgcacacagccctcacgggggccaccgagatccagacatccggaaccacaaccatttttgctggccatctgaaatgcagacttaagatggacaaactgacgctcaaggggatgagctatgttatgtgtacaggctctttcaaactggaaaaggaggtggccgagacccagcacggaaccgtcctggtgcagatcaagtacgaaggcacagatgcgccgtgcaaaattcctttctccacccaagacgagaagggggttacacagaacggacggcttatcacggctaatcccatcgtgaccgataaagaaaagcctgtcaacattgaggccgagccgccctttggcgaaagctatatcgtgattggggccggagagaaagctctcaagctgtcttggttcaagaaaggcagctccatcgggaagatgtttgaagccacagctagaggcgcccgccggatggcgattctgggagacaccgcctgggatttcggctctatcgggggagtgtttacaagcgttggcaaactcgtccatcagatcttcgggaccgcttacggagtgctgttttccggcgtgagctggacgatgaagattgggatcggcgtccttctgacctggctcggactcaattctagatccacaagcctgtctatgacctgtattgccgtgggccttgttacactctacctgggggtgatggtccaggctgactccggatgcgtgatcaactggaaaggccgcgagctgaagtgtgggagcggaattttcgttaccaatgaagtgcacacatggaccgagcaatataagtttcaggccgattcccctaaacggctctctgcggccatcggcaaggcttgggaggaaggggtctgcggcattagaagcgccacgcgcctggagaacatcatgtggaaacagatctccaacgaacttaatcatattctgctcgagaacgacatgaagttcacagtggttgtgggagacgtcgctggcatcctggtgcaggggaaaaagatgattcggccgcaacccatggaatacaaatattcttggaaaagctggggaaaggccaaaatcattggcgccgatgtgcaaaattccacctttatcatcgacgggcctaacacccccgagtgtcctgatgaccagagagcttggaatatttgggaggtcgaagattacggattcggcatctttacaaccaacatttggctgaaacttcgcgacagctatacgcaggtttgcgatcaccggctcatgtctgcggccatcaaagactccaaggctgtgcacgccgatatgggctactggattgagagcgagaagaatgagacatggaagctggccagagcttctttcatcgaagtgaagacctgtatctggcccaaatcccatacactgtggagcaacggggtcctcgagtctgagatgattatcccgaagattcacggaggccctatcagccaacataattatcgccccgggtacttcacccagacagccggaccttggcacctgggcaaacttgaactggactttgatctctgcgaggggaccacggtggttgtggacgaacactgcggaaaccggggcccctccctgagaaccacaaccgtcacaggcaagattatccatgagtggtgttgccggagctgtaccctgcctccccttcgcttcagaggggaggatggatgctggtacggcatggaaatccggccggtgaaagagaaggaagagaatctcgttaagtctatggtgtccgcggggagcggagaagtcgactcctttctgctgggcctcctgtgtatttctatcatgattgaggaggtgatgagaagccgctggtcccggaaaatgcttatgacggggacactggctgttttctttctcctgatcatgggacagctgacctggaacgaccttattagactgtgcatcatggtgggcgccaatgcctctgatcgcatgggcatggggacaacctatctcgctctgatggccaccttcaagatgagacctatgtttgcggtcggactcctgttccggcgccttacaagcagagaagtgctgctcctgacgattggcctgtcccttgtggcttctgtcgagctgcccaacagcctcgaagaactgggggacggactcgccatgggcatcatgatcctgaaacttctgaccgattttcaatcctaccagctctgggccacactgctgagccttaccttcattaagacaaccttttctctgcactatgcttggaaaacgatggccatggttctctccatcgtgagcctgttccccctctgtctgtctacaacctcccagaagaccacatggcttcctgtgctgctggggagcctcggatgcaagccgctgaccatgtttcttattgctgaaaataaaatctggggccggaagtcttggcccctgaacgagggcattatggccgtcgggatcgtgtccatcctcctgagctccctcctgaaaaacgacgttcctcttgcgggacccctgattgccggcgggatgctgatcgcttgttacgtgattagcggatctagcgccgatctctccctggagaaggctgccgaagtctcttgggaggaagaggccgaacatagcggcgcttcccacaatatccttgtggaggttcaggacgatgggacaatgaaaattaaggacgaggaacgcgatgacacgctgaccatcctcctgaaagcgacactcctggccgtgtctggagtctatcctcttagcatccccgctaccctgttcgtgtggcatttctggcaaaagaagaaacagagatccggcgtcctgtgggatacaccttctcccccggaggtggaacgggccgttctcgacgatggcatttaccgcatcatgcagagagggctgcttggacggagccaggtgggcgtcggggtgtttcaagagaacgttttccacaccatgtggcacgtgacgcgcggagccgtcctgatgtatcagggcaagagactcgagccttcctgggctagcgtgaaaaaggacctgatttcttacgggggaggctggcggtttcagggctcctggaataccggggaagaggtgcaggttatcgccgtcgaacccggcaagaatcctaagaatgtgcaaacagcgcccggcaccttcaagacaccggagggggaagtgggagctattgccctcgactttaaacctggcaccagcgggtctcccatcgtcaacagagagggaaagattgtgggcctgtacggcaatggggttgtgacaacgtccggaacctatgtcagcgccatcgctcaggccaaagcgtcccaggagggccctcttcccgaaatcgaggatgaagtgttccgcaagcggaacctgacaattatggacctgcatcccgggtctggaaaaaccagacgctacctccctgctatcgttcgggaggccattaagagaaagctgcgcacccttatcctggccccgacacgggtggtcgctagcgaaatggccgaggctctcaaaggcatgcccattagatatcaaacgaccgccgtgaagtccgagcacacagggaaagaaatcgttgatctgatgtgccatgcgacctttacaatgcgcctgctcagccctgtgcgggtccccaattacaacatgatcattatggacgaggcccacttcaccgatccttcttccatcgctgccagaggctatattagcacgcgggtgggaatgggcgaagctgccgccatctttatgacagctacaccccctgggtctatggaggcgttcccgcagagcaatgccgtgattcaggacgaagaaagagatatccccgagagatcctggaactctggatacgaatggatcaccgactttcctggcaagacagtctggttcgttcccagcattaaagctgggaatgatatcgccaactgtcttcggaagaatggaaagcgcgtgattcagctgtccagaaaaaccttcgacacagagtatcaaaagaccaaaaacaacgattgggactacgtggtcacgacagacatctctgaaatgggcgccaattttcgggctgatagagtgattgaccctcgccggtgcctgaagcccgttatcctcaaagatgggccggagagagtgattctggccggccctatgcccgtcaccgtggcgagcgctgcccagcgccggggaagaatcggccgcaaccataataaggagggggaccagtacatctatatgggacagccccttaacaatgatgaagaccacgcccactggacagaggctaagatgctgctcgataacattaatacccctgaaggcatcattcccgccctgttcgagcctgaacgggagaaatccgcggccatcgacggggagtacagactgcgcggagaagctagaaagacgtttgttgagctcatgcggcgcggcgatcttccggtgtggctgagctataaagtcgcctctgaagggttccaatactccgacagacggtggtgctttgatggcgagcgcaacaatcaggtgctggaagagaacatggacgtcgagatttggaccaaggaaggagagcgcaagaagctccggcccagatggctggatgctcgcacatatagcgaccctcttgccctgcgggagttcaaagagtttgctgccggcagacgctccgtgtctggggacctcatcctggaaatcggaaagctgccccagcatctcacccagcgggcgcaaaatgcccttgataacctggttatgctgcacaatagcgagcagggcgggagagcttaccggcatgccatggaggaactccctgacacaattgagaccctgatgcttctggctctcatcgccgtgctgacaggaggcgtgaccctgttctttctctccggcaaggggcttggaaaaacgtctattggcctgctgtgtgtcatggccagctccgttctcctgtggatggctagcgtggaaccccactggatcgcggcctctattatccttgagttctttctgatggtgctcctgatcccggagcctgatcgccagagaacaccccaggacaaccaactggcttatgtcgtgattgggctccttttcatgatcctgaccgttgccgccaatgaaatgggactgctcgagaccacaaagaaagatctgggcattgggcacgtggctgtcgaaaaccatcaccatgccgcgatgcttgacgtggatctgcaccctgcctccgcttggaccctctacgccgtcgctacaacgatcattacccccatgatgcggcatacaatcgagaacaccacagccaatattagcctgaccgcgatcgccaaccaggctgccatcctgatgggactcgacaagggctggcctatttctaaaatggatatcggcgtgccccttctggctctggggtgctactcccaggttaatccgctcacgctgaccgccgctgtgcttatgctggtcgcccactatgcgattatcggacctggcctccaagccaaggctacacgcgaagcccagaagagaaccgctgccgggattatgaaaaaccccacaatcgacggaatcgtggccattgatctggaccccgttgtgtacgatgcgaagtttgagaaacagctgggccagatcatgctccttattctgtgtaccagccaaatcctgctcatgcggacgacatgggctctgtgcgagtctattacccttgccacagggcctctgaccaccctctgggaaggaagcccgggcaagttctggaatacaacgatcgctgtctccatggccaacatcttccgcggctcttatctggccggggctggactggcctttagcctcatgaaatcccttggcgggggaagacggggcaccggggcgcagggagagacactgggcgaaaagtggaagcgccagctgaatcagctcagcaaatccgagttcaacacctacaagagatctggcattatggaagtggaccggagcgaggccaaagaggggctgaagagaggagaaacaaccaaacacgctgtgtcccgcggcacggccaaacttcggtggtttgttgagagaaatctggtcaagcccgaagggaaagtgatcgacctcggatgtggccgcgggggatggtcttattactgcgctggcctgaagaaagtgacagaggtcaagggctataccaaagggggacctggccatgaggaacccattcctatggccacctacgggtggaacctggttaagctccacagcggaaaagatgtgttctttattccccctgagaagtgtgacacacttctgtgcgatatcggcgaatcctctccgaatcccaccatcgaggaagggcggacactgagagtgctcaagatggtcgagccttggctgcgcggaaaccaattctgtattaaaatccttaatccctacatgcctagcgtggttgagacgctggaacagatgcagcggaagcatggcggcatgctcgtgagaaaccccctgtcccgcaatagcacccacgagatgtattgggtctcttgcgggacaggaaacatcgtgtccgcggttaatatgaccagccggatgctgctcaacagatttacaatggcccaccgcaaaccgacctacgaacgggacgtggatctgggcgctgggacgagacatgtcgccgtggagcctgaagtggctaaccttgacattatcggacagcgcattgagaatatcaagcacgagcataaatctacctggcactatgatgaagacaacccctacaagacatgggcctatcatggctcctacgaggtcaagcccagcgggtctgcttccagcatggttaatggagtggtgaaactgctcaccaagccttgggatgtcattcccatggtgacacaaatcgccatgaccgacacaacccctttcggccagcagagagtttttaaagaaaaggtggatacgcggacaccgaaagcgaagcgcggcaccgcccaaatcatggaggtcaccgctagatggctgtgggggttcctttcccggaacaagaaacccagaatttgtacacgggaagagtttacgcgcaaggtgagaagcaatgccgctatcggagccgttttcgtggacgagaaccagtggaactctgccaaagaagcggtcgaggacgatcggttttgggacctggtgcaccgcgaaagagagctccacaagcagggcaaatgcgctacctgcgtttataacatgatggggaagcgggaaaagaaactgggagagttcggcaaggccaaagggagccgcgccatttggtacatgtggctgggcgctagattcctcgagtttgaagccctgggattcatgaatgaggatcattggttttcccgggaaaactctcttagcggcgtggagggggagggactgcacaagctcggctacatcctgcgcgacatttccaaaatccctgggggaaatatgtatgctgatgacacagccggctgggataccagaatcacagaagacgatcttcagaacgaggcgaagattaccgacatcatggaacccgagcatgccctgctcgctaaatctattttcaagctgacataccaaaataaggtcgtgcgggtccagcgccctgccaaaaacgggaccgtgatggatgttatcagcagacgggaccagcgcggctccggacaggtgggcacgtatgggctgaatacctttacaaacatggaagctcaactcattagacagatggagtctgagggaatcttcctgcccaacgaacttgagaccccgaatctggccggccgggtcctcgattggctggaaaagtacggggtggagagacttaaacgcatggcgatcagcggagacgactgtgtggttaagcctattgatgaccggtttgccacagctctgaccgccctcaacgatatgggcaaagtgagaaaggacatcccccagtgggaaccttccaaggggtggaatgattggcagcaagtccccttctgcagccaccactttcatcagctgattatgaaagacggccgcgagatcgtggttccttgtcggaaccaggatgagctggtgggcagagctcgcgtctctcagggcgccgggtggtccctccgggaaacggcttgcctgggaaagagctatgcccaaatgtggcagcttatgtacttccacagacgcgacctgcggctcgcggccaatgctatttgttctgccgtgcccgtcgattgggtgccgacatccagaaccacatggagcatccatgcccaccatcagtggatgaccacggaggacatgctgtccgtttggaaccgcgtgtggattgaagagaatccttggatggaagataaaacccggatctctagctgggaggacgtcccctatcttggcaagagagaggaccaatggtgcgggtccctgatcggactcacagctcgggccacctgggcgacaaacattcaggtggctatcaatcaggttagacgcctgattggcaacgaaaattacagcgattacatgacctctatgaaacggtttaagaacgagtccgaacccgagggggccctgtggtga

SEQ ID NO: 19212 - RNA, 9879 nt, synthetic construct
  misc_feature 1..9879: note = derived and/or modified CDS sequence (opt5) from DENV-1__GU131775__SS-prME
  source 1..9879: mol_type = other RNA
agcgtgaccatgctgctcatgctgatgcccaccgcccttgctttccacctgacgacccggggaggggagcctcatatgatcgtgacaaagcaggaacggggaaaatccctcctgtttaagacctctgccggcgttaacatgtgcacacttattgcgatggacctgggggagctctgtgaagataccatgacatacaaatgcccccgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaggaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttgtggtcaccgtgcacacaggcgaccagcatcaagttgggaatgagtccaccgaacacggaacaaccgctacgatcacaccccaggcccctacaagcgagattcagctcaccgactacggcgccctgacactggattgttctccccggaccggcctcgacttcaacgaaatggtgctgcttacgatgaaggagaaatcctggctggtccataagcagtggtttctcgatctgcctcttccctggacaagcggggcttccacctctcaagagacatggaatcgccaggacctgctcgtgaccttcaaaaccgcgcacgccaagaagcaggaagtcgtggttctgggaagccaagagggcgctatgcacacagccctgacgggggccaccgaaatccagacatccggaaccacaaccatttttgctggccatctcaaatgcagactgaagatggataaacttacgctgaaggggatgagctatgtgatgtgtacaggctctttcaaactcgagaaggaagtcgccgagacccagcacggaaccgtgctggttcagatcaagtacgagggcacagacgcgccgtgcaaaattcctttctccacccaagatgaaaagggggtgacacagaacggacggctgatcacggctaatcccatcgtcaccgacaaagagaagcctgtgaacattgaagccgagccgccctttggcgagagctatatcgtgattggggccggaggcaaagctcttaagctctcttggttcaagaaagggagctccatcggcaagatgtttgaagccacagctagaggagcccgccggatggcgattctgggcgataccgcctgggacttcgggtctgttggaggcgtctttacaagcgtggggaaactggtgcatcagatcttcggaaccgcttacggcgtcctcttttccggggtgagctggacgatgaagatcggcattggagttctgcttacctggctgggcctcaattctagatccacaagcctgtctatgacctgtatcgccgtggggctggtcacactttacctcggagtgatggttcaggctgattccggctgcgtgattaactggaaagggcgcgagctgaagtgtggaagcggcatcttcgtcaccaatgaagtgcacacatggaccgagcaatataagtttcaggccgactcccctaaacggctgtctgcggccattgggaaggcttgggaagagggcgtttgcggaatcagaagcgccacgcgcctcgagaacattatgtggaaacagatctccaacgaactgaatcatatccttctggagaacgacatgaagttcacagtggtcgtgggcgatgtggtcgggattctcgctcagggcaaaaagatgatccggccgcaacccatggaacacaaatactcttggaaaagctggggcaaggccaagattatcggggccgacgttcagaataccacctttattatcgatggacctaacacacccgagtgtcctgacgatcagagagcttggaatatctgggaagtggaggactatggcttcggcatttttaccacgaacatctggctgaagctgcgcgattcctacacacaggtgtgcgaccaccggcttatgagcgcggccattaaagattctaaggctgtccatgccgacatggggtattggatcgagtccgagaaaaatgagacctggaagctcgccagagctagcttcattgaagtgaagacatgtatctggcccaaatctcacaccctgtggtccaacggagttctggagagcgaaatgatcattccgaagatctacggcgggcctatttctcaacataattatcgccccggatacttcacacagaccgccggcccttggcacctcgggaaactggagcttgattttgacctgtgcgagggaacgaccgtggtcgtggatgaacactgcggcaaccggggccccagcctcagaacaaccacagttaccgggaagatcattcatgagtggtgttgccggtcctgtacgctgcctcccctgcgcttcaaaggagaagacggctgctggtacgggatggagatcagaccggtgaaggagaaggaagagaatcttgtcaaaagcatggtgtctgcgggatccggcgaagttgacagcttttccctcgggctgctgtgtatctctattatgatcgaggaagtgatgcggagcagatggtcccgcaagatgctcatgacaggaaccctggctgtcttccttctgctcattatgggccagctgacatggaacgatctgatccggctttgcattatggtgggcgccaatgcctctgacagaatggggatgggaaccacctatctggctctcatggccacatttaaaatgcgccctatgttcgcggtgggcctgctctttagacggctgacgagccgcgaggtccttctgctcaccatcgggctgtccctggttgcttctgtggagcttcccaacagcctggaagaactgggagatggcctggccatggggattatgatcctcaagctgcttacagacttccaatcccaccagctgtgggccaccctcctgagcctgacatttatcaaaaccacgctttctctgcattacgcttggaagacaatggccatggtgctctccattgtcagcctgttccccctctgtctgtctaccacctcccagaagacaacctggcttcctgtgctgctgggaagcctcggctgcaaaccgctgacaatgtttcttatcacggaaaataagatttggggcagaaaatcttggcccctgaacgaggggatcatggctgttggagtggtctccattctcctgagctccctcctgaagaacgatgtgcctcttgccggccccctgatcgccgggggaatgctgatcgcctgttatgttattagcggctctagcgctgacctctccctggaaaaagccgctgaggtgtcttgggaggaagaggccgaacacagcggggcctcccataatatccttgtcgaggtgcaggatgacggaaccatgaagattaaagatgaggaacgggacgatacactgaccatcctcctgaaggctacactcctggcggtctctggcgtgtaccctcttagcattcccgccaccctgttcgtttggtatttttggcaaaagaaaaagcagcgctccggcgtgctgtgggacacgccttctcccccggaggtcgaaagagctgtgctcgatgacgggatctaccggatcatgcagcgcggactgcttggcagaagccaggttggggtgggagtcttccaagagaacgtgttccacaccatgtggcacgtgacacggggcgccgttctgatgtatcaggggaaacgcctcgaaccttcctgggccagcgtcaagaaagacctgatttcttacggaggcggctggagactccaggggtcctggaataccggagaggaggtccaggtgatcgctgtcgaacccggcaagaaccctaagaatgtgcaaacagcccccgggacctttaaaacaccggagggagaagttggcgcgattgctctggatttcaagcctgggacgagcggatctcccatcgtgaaccgggagggcaaaattgtcggcctttacgggaatggagtggttaccacatccggcacctatgtgagcgccatcgcccaggctaaggcctcccaggaagggcctctgcccgagattgaggacgaagtctttagaaaacgcaacctgaccatcatggatctccatcccggatctggcaagacacggagatacctgcctgcgatcgtgcgcgaggctattaagcggaaacttagaacgctgatcctcgccccgacccgcgttgtggccagcgaaatggctgaggccctgaaggggatgcccattcggtatcaaacaaccgctgtcaaatccgaacacacaggcaaggagatcgtggacctgatgtgccatgccaccttcacgatgagactccttagccctgtgcgcgtccccaattacaacatgattatcatggatgaggcgcactttacagacccttcttccatcgccgctcggggatatattagcaccagagttggcatgggggaagccgctgccatcttcatgaccgccacaccccctggatctgtggaggcttttccgcagagcaatgcggtgattcaggatgaggaacgggacatccccgaacgctcctggaactctggctacgagtggattaccgatttccctgggaaaacagtctggtttgtgcccagcatcaagtccggaaatgacatcgccaactgtctgagaaagaatggcaaacgggttattcagctgtctcgcaagaccttcgatacggagtatcagaaaaccaagaacaacgactgggactacgtggtcaccacagatatcagcgaaatgggggctaattttagagccgaccgggtgattgatcctagacgctgcctcaaacccgttatcctgaaggacggcccggagcgggtgattcttgccggacctatgcccgtcaccgtggcttccgccgcgcagagacgcggccggatcgggagaaaccataataaggaaggagatcagtacatttatatgggccagcccctgaacaatgacgaggatcacgctcactggacggaggccaaaatgctcctggacaacatcaatacccctgaagggatcattcccgccctgttcgagcctgaacgcgaaaagagcgctgccatcgatggagaataccggctcagaggcgaggcgcgcaaaacattcgtcgagcttatgagaagaggggacctgccggtgtggctgtcttataaggttgcctccgaaggctttcaatacagcgatcgcagatggtgcttcgacggagagcggaacaatcaggtgctcgaagagaacatggatgtggaaatttggaccaaagagggcgagcgcaagaaactgagaccccggtggcttgacgctagaacatattccgaccctctggccctccgcgaatttaaggagttcgctgccgggcggagatctgtcagcggagatctgatcctggaaattggcaagctcccccagcatcttacccagcgcgctcaaaatgccctggacaacctggttatgctccacaattccgagcaagggggacgggcgtacagacatgccatggaggaactgcctgatacaatcgagacccttatgctgctcgctctgatcgccgtgctgacgggcggcgtgacactctttttcctttctgggcggggactgggcaaaaccagcattgggctgctctgtgtcatggcttccagcgtgctgctttggatggcctctgttgaaccccactggatcgccgcttccattatcctggagtttttcctcatggtgctgctgattccggaacctgaccgccagagaacaccccaggataaccaactcgcgtatgtcgtgatcggacttctgtttatgatcctgacagtcgccgctaatgagatgggcctcctggagaccacaaagaaagaccttgggattggacacgtggccgttgaaaaccatcaccatgccacgatgctggatgtggacctccaccctgctagcgcctggaccctgtacgcggtcgccacaaccatcattacacccatgatgcggcataccatcgagaacacgaccgctaatatttctctgacagccatcgctaaccaggccgcgattctcatgggccttgataagggctggcctatctccaaaatggacatcggggtgcccctgctggccctcggatgctacagccaggttaatccgctgacccttacagctgccgtgctgatgctcgtcgctcactatgccattatcggccctgggctgcaagctaaggccacccgcgaagcgcagaagagaacggccgctggaattatgaaaaaccccacagtggatggcatcgtggccattgacctggatcccgttgtctacgacgctaagttcgagaaacagctcgggcagatcatgcttctgatcctgtgtacctctcaaattctcctgatgcggacaacctgggccctttgcgaaagcatcaccctggccacaggacctctcacgaccctgtgggagggctccccgggcaagttttggaatacaaccattgcggtgtctatggctaacatcttccgcgggagctatctggccggagctggcctcgccttttcccttatgaaaagcctcgggggaggcagacgggggacaggagcccagggcgagaccctgggcgaaaagtggaagcgccagctcaatcagctgtccaaatctgagttcaacatttacaagagaagcgggatcatggaagtggaccggtccgaggctaaagaaggacttaagagaggcgagacgacacgccacgccgtctctcgggggaccgcgaaactgagatggttcgttgagcgcaatctcgtgaagcccgaaggaaaggtgatcgatctgggctgtgggcggggaggctggagctattactgcgccggcctgaaaaaggtcaccgaggtgaaagggtatacaaagggaggccctgggcatgaggagcccattcctatggctacctacggatggaacctcgttaaacttcactccggcaaggacgtgtttttcacaccccctgaaaaatgtgatacgctgctgtgcgacatcggggagtctagcccgaatcccaccattgaggaaggaagaacactccgcgtcctgaagatggtggagccttggcttcggggcaaccaattttgtatcaagattctgaatccctacatgccttccgttgtggaaaccctcgagcagatgcagagaaaacatggcgggatgctggtccgcaaccccctgagcagaaattctacacacgagatgtattgggtgtcctgcggaaccggcaacatcgtgagcgccgtcaatatgacgtctagaatgctcctgaaccgcttcaccatggctcaccggaagccgacatacgaaagagatgttgaccttggggccggaacccgccatgtggcggtggagcctgaagtcgccaacctggatattatcggccagagaatcgagaatattaaacacgaacataagtccacatggcactatgacgaggataacccctacaaaacctgggcttatcatgggagctacgaggtgaagccctctggatccgccagctccatggttaatggcgtggtcaagctcctgacaaaaccttgggacgtgatccccatggttacccaaattgctatgacggatacaaccccttttggccagcagcgggtgttcaaggaaaaagtcgacacccgcacaccgaaggccaaaagagggacggctcaaatcatggaggtgaccgcccggtggctttggggatttctgagcagaaacaagaagccccggatttgtacacgcgaagagttcaccagaaaagttcggtctaatgcggccatcggcgctgtgtttgtcgacgaaaaccagtggaatagcgccaaggaggctgtggaggatgaacgcttctgggacctcgtccagaaagagagagaactgcacaagcaggggaaatgcgccacatgcgtgtataacatgatgggaaagcgggagaagaaactgggcgaatttgggaaggccaaaggctcccgcgcgatctggtacatgtggctcggagctagattcctggagtttgaggcccttggcttcatgaatgaagatcactggttctctcgggagaacagcctgtccggggttgaaggagagggcctccataagctggggtacattcttcgcgacatctctaaaattcctggaggcaatatgtatgccgatgacaccgctgggtgggatacaagaatcaccgaggacgatctgcaaaacgaagccaagattacggacatcatggagcccgaacacgctctcctggccaccagcatctttaaactgacataccagaataaggtggtccgggtgcagcgccctgcgaagaacggcaccgtgatggatgttatttccagacgggaccagcgcggatctggccaagtggggacatatggactcaataccttcacgaacatggaggcccagctgatcagacagatggaaagcgagggcatttttcttccctccgagctggaaacaccgaacctcgctgagcgggtcctggattggcttgaaaaatacggggtggagagactgaagcgcatggccatcagcggagacgactgtgttgtgaaacctattgatgaccggttcgctaccgccctcacagcgctgaatgatatgggcaaggtcagaaaagacatcccccagtgggaaccttctaaggggtggaacgattggcaacaggtgcccttttgctcccatcacttccaccagctgatcatgaaggacggccgcgagattgtcgtgccttgtcggaatcaggatgagctcgttggacgggcgcgcgtgagccaaggcgctgggtggtctctgcgggaaaccgcctgccttggaaaatcctatgctcagatgtggcagctgatgtactttcatagacgcgacctccggctggccgctaacgccatctgtagcgcggtccccgtggattgggttccgacgtccagaaccacatggtctattcacgcccatcaccaatggatgaccacagaggacatgcttagcgtgtggaatcgcgtctggatcgaagagaacccttggatggaagataagacccatgtgtccagctggggcgacgtgccctatctggggaaacgggaggaccagtggtgcggatctctcattggcctgacagctagagccacctgggcctccaatatccaggttgctattaaccaggtccggagactgatcgggaatgagaactacctcgattacatgacgagcatgaagcgcttcaaaaatgaaggcgaccccgagggagccctgtggtga

SEQ ID NO: 19213 - RNA, 9879 nt, synthetic construct
  misc_feature 1..9879: note = derived and/or modified CDS sequence (opt5) from DENV-1__GU131777__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccatctctggagtttatcctctgagcattcccgctaccctttttgtgtggtacttctggcagaagaagaagcagcggtccggcgtcctgtgggacacgccttctcccccggaagtggagcgcgccgtcctggatgacggcatctatagaattatgcagcgggggctcctgggacgcagccaggtgggcgttggggtgttccaagaaaacgtctttcataccatgtggcacgtgacaagaggagccgttcttatgtaccagggcaaacggctggagccttcctgggctagcgtgaagaaagacctcatctcttacgggggaggctggagactgcagggctcctggaataccggggaggaagtccaggtgattgccgtggagcccggaaagaaccctaaaaatgttcaaacaacccccggcacattcaagacgccggaaggggaggtcggagcgatcgctctcgattttaagcctggcaccagcgggtctcccatcgtgaaccgcgaaggaaaaattgtgggcctgtatggcaatggggtcgtgacaacctccggaacctacgttagcgccatcgcccaggctaaggcctcccaggagggccctcttcccgagattgaagacgaggtgttccggaaaagaaacctgacaatcatggatctgcaccccgggtctggaaagacgcgccggtatctccctgcgattgtcagagaagctatcaaacgcaagctgcggacccttatcctggccccgacaagagtggttgccagcgagatggctgaagccctcaagggcatgcccattcgctaccaaaccacagctgtgaaatccgagcataccgggaaggagatcgtcgacctgatgtgccacgccacgtttacaatgcggctgctcagccctgtgagagttcccaattataacatgattatcatggatgaagcgcatttcaccgacccttcttccattgccgctcggggctacatcagcacccgcgtgggaatgggcgaggccgctgccatctttatgacagccacaccccctgggtctgtcgaggctttcccgcagagcaatgcggtgattcaggatgaggaaagagacatccccgagcggtcctggaactctggatatgagtggattacagattttcctggcaaaaccgtgtggttcgtccccagcatcaagtccgggaatgacattgccaactgtcttcgcaaaaatggaaagagagttatccagctgtctcggaagacgtttgatacagaataccagaaaaccaagaacaacgactgggactacgtggtgacaaccgatattagcgagatgggcgctaatttcagagccgaccgcgtcatcgatcctcggagatgcctgaaacccgtgatcctcaaggacgggccggaacgcgttattctggccggccctatgcccgtgacggtcgcttccgccgcgcagcggagaggacgcatcggccggaaccacaataaagagggggatcagtatatttacatgggacagccccttaacaatgacgaggatcatgctcactggaccgaagccaagatgctgctcgacaacatcaatacacctgagggcattatccccgccctgttcgaacctgagagagaaaagagcgctgccatcgatggggagtatcgcctgagaggagaggcgcggaaaacctttgtggaactcatgcgcagaggcgaccttccggtttggctgtcttacaaggtggcctccgaggggttccaatatagcgatcggcgctggtgctttgacggcgaaagaaacaatcaggtcctggaggaaaacatggatgtggagatttggacaaaagagggagaacggaagaaactcagaccccgctggctggacgctcggacctactccgaccctcttgccctgagagagttcaaggaatttgctgccggccgccggtctgtcagcggggatctcatcctggagattggaaaactgccccagcacctcacacagagagctcaaaatgcccttgacaacctggtgatgctgcataattccgaacagggcgggcgggcgtatcgccacgccatggaggagctccctgataccatcgaaacgctgatgcttctggctctcattgccgttctgacaggaggcgtgaccctgttctttctctctggcagagggcttggaaagaccagcatcggcctgctgtgtgtgatggcttccagcgtcctcctgtggatggcctctgttgagccccattggatcgccgcttccattatccttgagttctttctgatggtgctcctgattccggagcctgaccggcagcgcacaccccaggataaccaactggcgtacgtggtcatcgggctccttttcatgattctgaccgtggccgctaatgagatgggactgctcgaaacaacgaagaaagacctgggcatcgggcacgttgccgtgggaaaccaccatcacgccgctatgcttgatgtcgacctgcatcctgccagcgcgtggaccctctacgccgtggctacaaccattatcacacccatgatgagacacaccatcgagaacacgaccgccaatatttctctgacagctatcgccaaccaggcggccattctgatgggcctcgataagggctggcctatctccaaaatggacattggggtcccccttctggctctgggatgctatagccaggtgaatccgctcaccctgacagccgctgttcttatgctggtggcccattacgctatcatcggccctgggctccaagccaaggcgacccgggaagcccagaaacgcacggctgccggaattatgaagaaccccacagtcgatggcatcgtggctattgacctggatcccgttgtgtatgacgccaagtttgagaaacagctggggcagatcatgctccttattctgtgtacctctcaaatcctgctcatgagaacaacctgggccctgtgcgaaagcatcacccttgcgacaggacctctgacgaccctctgggagggctccccgggcaagttctggaatacaaccattgctgtctctatggccaacatctttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggattatggaagtggaccgctccgaggccaaagaaggactgaagcggggcgagacaaccaaacacgcggtgtctagagggaccgccaaacttcgctggtttgttgagcggaatctggtcaaacccgaaggaaaggtgatcgatctcggctgtgggagaggaggctggagctactattgcgctggcctgaagaaagtgacagaggtcaaggggtacaccaaaggaggccctgggcacgaagaacccattcctatggccacatacggatggaacctggttaagctccattccggcaaagacgtgttctttattccccctgaaaagtgtgatacgcttctgtgcgacattggggagtctagcccgaatcccaccatcgaggaaggacgcacactgcgggtgctcaaaatggtcgagccttggctgagaggcaaccaattctgtatcaagattcttaatccctatatgccttccgtggttgaaaccctggagcagatgcagcgcaagcacggcgggatgctcgtgcggaaccccctgagcagaaattctacacatgagatgtactgggtctcctgcggaaccggcaacatcgtgagcgctgttaatatgacgtctcgcatgctgctcaaccggtttaccatggcccacagaaaaccgacatatgaacgcgatgtggacctgggggcgggaaccagacacgtcgccgtggagcctgaagtggctaaccttgatattatcggccagcggattgagaatatcaagcatgaacacaaatccacatggcattacgacgaggataacccctataagacctgggcctaccacgggagctatgaggtcaaaccctctggatccgctagctccatggttaatggcgtggtgaagctgctcacaaagccttgggacgtcatccccatggtgacccaaattgccatgacggatacaacccctttcggccagcagcgcgtttttaaagaaaaggtggacaccagaacaccgaaagctaagcgggggacggcccaaatcatggaggtcaccgcgaaatggctgtggggattccttagcagaaacaagaagccccggatttgtacacgcgaagagtttaccagaaaagtgcggtctaatgccgctatcggcgccgttttcgtggacgaaaaccagtggaatagcgctaaggaggccgtcgaggatgaacgcttttgggacctggtgcatagagagcgggaactccacaaacaggggaagtgcgccacatgcgtttacaacatgatgggaaaacgcgagaagaagctgggcgagttcgggaaagcgaagggctccagagctatttggtacatgtggctgggagcccggtttctcgagttcgaggccctgggcttcatgaatgaagatcactggttttctcgcgagaacagcctttccggggtggaaggagagggcctgcataaactcgggtatatcctgagagacatctctaagattcctggaggcaatatgtacgctgatgacaccgccgggtgggatacacggatcaccgaggacgatcttcagaacgaagctcgcattacggacatcatggagcccgaacacgccctgctcgcgaaaagcattttcaagctgacctatcaaaataaagtcgtgagagtccagcggcctgccaagaacggcacagtgatggatgttatctcccgcagagaccagcggggatctggccaggtggggacctacggactgaatacatttaccaacatggaggctcaactcatcagacagatggaaagcgagggcattttctcccccagcgagctggaaacgccgaaccttgccgagcgcgtcctggattggctcgaaaagtatggggtggagcggctgaaaagaatggctatctctggagacgactgtgtggttaagcctattgatgaccgctttgccacagcgcttaccgccctgaatgatatgggcaaagtgcggaaggacatcccccagtgggaaccttccaaagggtggaacgattggcagcaagtccccttctgcagccatcactttcaccagctcattatgaaggacggcagagagatcgtggttccttgtcgcaatcaggatgagctggtgggacgggctagagtctctcagggcgccgggtggtccctgcgcgaaacagcttgcctcggaaagagctacgcccaaatgtggcagctgatgtatttccatcggagagaccttcgcctggctgccaacgcgatttgttccgccgtgcccgtcgattggatcccgacctctcggacgacctggagcatccacgctcatcaccagtggatgacaaccgaggacatgctctccgtgtggaatagagtttggattgaagagaacccttggatggaagataaaacacatatcagctcttggggcgacgtgccctacctggggaagcgggaggaccaatggtgcggatcccttattggcctgaccgccagagccacatgggctaccaatatccaggtcgccattaaccaggtgcgccggctcatcgggaatgagaactacctggattatatgacgagcatgaaaagatttaagaatgaatctgaccccgagggcgcgctgtggtga

SEQ ID NO: 19214 - RNA, 9879 nt, synthetic construct
  misc_feature 1..9879: note = derived and/or modified CDS sequence (opt5) from DENV-1__GU131778__SS-prME
  source 1..9879: mol_type = other RNA
agcgtgaccatgctgctgatgctgatgcccaccgcccttgctttccacctgacgaccagaggcggggaacctcatatgatcgtctccaagcaggaacggggaaaatctctcctgtttaagacaagcgccggcgttaatatgtgcacccttattgcgatggacctgggggagttctgtgaagatacaatgacctacaaatgcccgcgcatcacagaagctgaacccgacgatgtggactgttggtgcaatgccaccgatacgtgggtgacctatggaacatgttcccaaaccggcgagcaccggcgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggccccgctcccataccctctggagcaacggggtcctggaatctgagatgattatcccgaagatttatggaggccctatcagccagcacaattaccggcccgggtactttacacaaaccgcgggaccttggcatctgggcaaactcgagctggatttcgacctttgcgaagggacgaccgtggttgtggatgagcactgcggaaacagaggcccctccctgcggacaaccacagtcaccggcaagattatccacgaatggtgttgccgcagctgtacgctccctcccctgagatttaaaggggaggacggatgctggtatggcatggagatccggccggtgaaggaaaaggaggaaaatctggttaaatctatggtgtccgctgggagcggagaggtcgactccttctctcttggcctcctgtgtattagcatcatgattgaagaggtgatgagatcccgctggtctcggaagatgctgatgacagggaccctcgccgtctttttcctgcttatcatgggacagctgacatggaacgatctcattagactgtgcatcatggtgggcgccaatgctagcgaccgcatgggcatggggaccacctacctggcccttatggcgacatttaaaatgagacctatgttcgctgtcggactgctctttcggcgcctgacgtccagagaggtgctcctgcttaccattggcctgtctctcgtggccagcgtcgaactgcccaactccctggaggaacttggggatggactggccatgggcatcatgatcctcaagctgctcacagacttccagagccatcaactgtgggctacccttctgtctctcacatttattaaaaccacgttctccctgcactatgcctggaagacaatggctatggttctgagcatcgtgtctctttttcccctgtgtctctccaccaccagccagaagacaacctggctgcctgtgctcctggggtctcttggatgcaaaccgctgacaatgttcctgattgccgagaataagatctggggccggaaatcctggcccctcaacgaaggcattatggcggtcgggatcgtgagcatcctgctttccagcctgctcaagaacgatgttcctctggccggacccctcattgctggcgggatgctgatcgcctgttacgtgatttctggaagctccgctgacctttctctggagaaagccgccgaggtcagctgggaagaggaagctgagcattccggcgcgtctcacaatatcctggtggaagttcaggatgacgggacgatgaagattaaagatgaggagcgcgacgataccctcacaatcctgcttaaggccaccctgctcgctgtgagcggagtctatcctctgtccatccccgccacactcttcgtgtggtacttttggcagaagaaaaagcaaagatctggcgtcctgtgggacattccttcccctcccgaagtggagcgggccgttcttgatgacggcatctatcgcattatgcagagagggctgctgggacggtcccaggtgggcgtcggggtgttccaggaaaacgtttttcataccatgtggcacgtgacgcgcggagctgtcctcatgtaccaaggcaaaagactggagcccagctgggcctctgtgaagaaagaccttatctcctacgggggaggctggcggctgcagggcagctggaataccggggaggaagtgcaggttattgcggtcgagcccggaaagaaccctaagaatgtgcagacagctcccggcaccttcaaaacatctgaaggggaggtgggagccatcgccctcgattttaagccgggcacctccgggagccctattgtcaacagagaaggaaaaatcgtgggcctgtatggcaatggggttgtgacaacgtccggaacctacgtctctgctatcgcccaagcgaaggctagccaggagggccccctccctgagattgaagacgaggtgttccgcaaacggaacctgacaatcatggatcttcaccccgggtccggaaagaccagacgctatctgcccgccattgttcgggaagccatcaagagaaaactgcgcaccctcattctggctcctacacgggtggtcgccagcgagatggctgaagcccttaagggcatgccgatcagataccagacgaccgcggtgaaatctgagcatacagggaaggagatcgttgacctgatgtgccacgccacctttacaatgcgcctcctgtcccccgtgcgggtccctaattataacatgattatcatggatgaagctcatttcaccgaccccagctctattgccgctagaggctacatcagcacgcgggtgggaatgggcgaggccgccgctatttttatgacagcgacccctcccgggtccgtggaagccttccctcaatctaatgctgtcatccaggatgaggaacgcgacatcccggagagaagctggaactccggatatgagtggattaccgattttcccggcaaaacagtttggttcgtgccttctatcaagagcgggaatgacattgccaactgtctgcggaagaatggaaaacgcgtgatccagctctccagaaagaccttcgatacagaataccagaaaaccaagaacaacgactgggactacgtcgtgacgacagatattagcgagatgggcgccaattttcgggctgacagagttatcgatccccgccggtgccttaaacctgtgattctgaaggacgggcccgaaagagtcatcctggccggcccgatgcctgtgaccgttgcgtctgctgcccaacgccggggaagaatcggccgcaaccacaataaggagggggatcagtatatttacatgggacagcccctcaacaatgacgaggatcatgcccactggacagaagctaaaatgctgcttgacaacatcaatacccccgagggcattatccctgccctgttcgaacccgagcgggaaaagtccgcggccattgatggggagtatagactccgcggagaggctagaaaaacgtttgtggaactgatgcggcgcggcgacctgcctgtctggctcagctacaaggtggcctccgaggggttccagtattctgatagacggtggtgctttgacggcgaacgcaacaatcaagtccttgaggaaaacatggatgtggagatctggaccaaagagggagaaagaaagaaactgcggccgagatggctggacgctcgcacatacagcgaccccctcgccctgcgggagttcaaggaatttgctgccggcagacgctccgtttctggggatcttatcctggagattggaaagctccctcagcacctgacccagcgggcgcagaatgccctggacaacctcgtgatgcttcataatagcgaacaaggcgggagagcttatcggcacgccatggaggagctgcccgatacaatcgaaaccctgatgctcctggctcttattgccgtgctgacaggaggcgtcaccctcttctttctgtccggccgcgggctgggaaaaacgagcatcggcctcctttgtgttatggcctcttccgtgctgctgtggatggctagcgtggagcctcattggattgcggcctctatcatcctcgagttctttctgatggtccttctgattcccgagccggacagacagcggacacctcaggataaccagctcgcttacgtggttatcgggctgctgttcatgattctcaccgtggccgccaatgagatgggacttctggaaaccacaaagaaagacctgggcatcgggcacgtcgctgtggagaaccaccatcacgccgcgatgctcgatgtcgacctgcatcccgcctccgcttggaccctttacgccgtggctacaacgattatcacccctatgatgcgccacacaattgaaaacaccacagccaatatcagcctgaccgcgatcgccaaccaagctgccattctcatgggactggataagggctggcccatctctaaaatggacattggcgttcctctgctcgctcttgggtgctatagccaggtgaatcccctgacgctgaccgccgctgtcctcatgctggtggcccattacgcgatcattggaccgggccttcaggccaaggctacaagagaggcccaaaagcggaccgctgccgggatcatgaaaaaccctacagttgatggaatcgtggccattgacctggatcccgtcgtgtatgacgcgaagtttgaaaaacagctcggccagatcatgctgctgattctctgtacctcccagatccttctgatgcgcacgacatgggctctgtgcgagtctattaccctcgccacagggcccctgaccaccctttgggagggaagccctggcaagttctggaatacaacgatcgctgtgtccatggccaacatcttcagaggcagctacctggccggggctggactcgccttttccctgatgaaatctctgggcgggggacggcgcggcaccggggcgcaaggagaaacactcggcgagaagtggaagagacagcttaatcagctgagcaaatccgagttcaacacctataagcggtctggcattatggaggttgacagaagcgaagccaaagaggggctgaagcgcggagagacaaccaaacacgctgtctcccggggcacggccaagctcagatggtttgtggaacgcaatctggtgaagccggaggggaaagtcatcgatcttggatgtggcagagggggatggtcttactattgcgctggcctgaagaaagttacagaagtgaagggctacaccaaagggggacccggccacgaggaacctattcccatggccacctacgggtggaacctcgtgaagctgcatagcggaaaagacgtcttctttatccctcccgagaagtgtgatacactgctctgcgacattggcgagtccagccctaatccgaccatcgaagaggggagaacacttcgcgtgctgaagatggttgaaccctggctgcggggaaaccagttctgtattaaaatcctcaatccttatatgccctctgtggtcgagacgctggagcaaatgcagagaaagcacggcggcatgcttgtgcgcaaccctctgtcccggaatagcacccatgaaatgtactgggtttcttgcgggacaggaaacatcgtgtccgcggtcaatatgaccagcagaatgctcctgaaccgctttacaatggcccaccggaaacccacctatgagagagatgtggacctgggcgctgggacgcgccacgtggccgtcgaaccggaggttgctaacctcgatattatcggacagagaattgaaaatatcaagcatgagcacaaatctacctggcattacgacgaggataacccttataagacatgggcctaccacggctcctatgaagtgaagcccagcgggtccgctagctctatggtgaatggagtcgtgaaactgcttaccaagccctgggacgttattcctatggtgacacagatcgccatgaccgatacaacccccttcggccaacagcgggtctttaaagagaaggtggacacgcgcacacctaaagcgaagagaggcaccgcccagatcatggaagttaccgctaagtggctgtgggggttcctcagccggaacaaaaagccgagaatttgtacacgggaggaatttacgcgcaaagtgagatccaatgccgctatcggagccgtcttcgtggacgagaaccaatggaactctgccaaggaggcggttgaagatgagcggttttgggacctggtgcatcgcgaaagagagcttcacaaacagggcaagtgcgctacctgcgtctacaacatgatggggaagcgggagaagaagctgggagagttcggcaaagccaaggggagccgcgccatttggtacatgtggctcggcgctagattcctggagtttgaagccctgggattcatgaatgaggatcactggttttcccgggaaaactctctcagcggcgtggagggggagggactgcataaacttggctatatcctgcgcgacatttccagaatccccgggggaaatatgtacgctgatgacacagccggctgggatacccggatcacagaagacgatctccagaacgaggcgaagattaccgacatcatggaacctgagcacgccctgcttgctaaatctattttcaagctgacatatcagaataaggtcgtgcgcgttcaaagacccgccaaaaacgggaccgtgatggatgtcatcagccggcgcgaccagagaggctccggacaggtgggcacgtacgggctcaatacctttacaaacatggaagctcagctgattcggcaaatggagagcgagggaatcttctctccttccgaactggagacccccaacctcgccggcagagtgctggattggcttgaaaagcatggggttgagcgcctgaaacggatggcgatcagcggagacgactgtgtggtcaagccgattgatgacagatttgccacagctctcaccgccctgaatgatatgggcaaagtgcgcaaggacatccctcagtgggaaccctctaaggggtggaacgattggcagcaggttcctttctgctcccaccactttcatcaacttattatgaaagacggccgggagatcgtggtcccctgtagaaatcaggatgagctggtgggacgcgctcgggtcagccagggcgccgggtggtccctcagagaaacggcttgcctgggaaagtcttatgcccagatgtggcaactgatgtacttccaccgccgggacctcagactggcggccaacgctatttgtagcgccgtgcctgttgattgggtgcccacatcccgcaccacatggagcatccatgcccaccatcagtggatgaccacggaggacatgctttctgtctggaatcgggtgtggattgaagagaacccgtggatggaagataaaacccacatctccagctggggcgacgttccttatctggggaagagagaggaccagtggtgcggatctctcatcggcctgacagctcgggccacctgggcgacaaatattcaagtggctatcaaccaggtcagacgccttattgggaatgagaactacctggattacatgaccagcatgaaacggtttaagaatgaatccgaccccgagggcgccctctggtga

SEQ ID NO: 19215 - RNA, 9879 nt, synthetic construct
  misc_feature 1..9879: note = derived and/or modified CDS sequence (opt5) from DENV-1__GU131779__SS-prME
  source 1..9879: mol_type = other RNA
agcgtgaccatgctgctcatgctgatgcccacagcccttgctttccacctgacgaccagaggcggggagcctcatatgatcgtgtccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggtgtctgtcgaacttcccaacagcctggaggaactcggggatggactggctatgggcattatgatcctcaaactgcttaccgacttccaatcccatcagctgtgggccacactcctgagcctgacctttattaagacgacattctctcttcactatgcctggaaaaccatggctatggttctgtccatcgtgagcctctttcccctgtgtctctctaccacatcccagaagaccacatggctgcctgtgcttctggggagcctgggatgcaagccgctcacgatgttcctgattgccgagaataaaatctggggccggcgctcttggccccttaacgaaggcatcatggctgtcgggattgtgtccatcctgctcagctccctgctcaagaacgatgttcctctggccggaccccttattgcgggcgggatgctgatcgcctgttacgtgattagcggatctagcgctgacctgtccctcgagaaagccgctgaggtctcttgggaagaggaagccgagcatagcggcgcctcccacaatatcctggtggaagttcaggatgacgggaccatgaagatcaaagatgaggagagagacgatacacttaccattctgctcaaggctacactgctcgcggtgtctggagtctatcctctgagcatccccgccaccctttttgtgtggtacttctggcagaagaagaagcagcggtccggcgtcctgtgggacacgccttctcccccggaagtggagcgcgctgttctggatgacggcatttatagaatcatgcagcgggggctcctgggacgcagccaggtgggcgtcggggtgttccaagaaaacgtttttcataccatgtggcacgtgacaagaggagccgtccttatgtaccagggcaaacggctggagccttcctgggccagcgtgaagaaagacctcatttcttacgggggaggctggagactgcagggctcctggaataccggggaggaagtgcaggttatcgctgtcgagcccggaaagaaccctaaaaatgtgcaaacaacccccggcacattcaagacgccggaaggggaggtgggagccattgcgctcgattttaagcctggcaccagcgggtctcccatcgtcaaccgcgaaggaaaaatcgtgggcctgtatggcaatggggttgtgacaacctccggaacctacgtcagcgctattgcccaggccaaggcttcccaggagggccctcttcccgagatcgaagacgaggtgttccggaaaagaaacctgacaattatggatctgcaccccgggtctggaaagacgcgccggtatctccctgccatcgttagagaagcgattaaacgcaagctgcggacccttatcctggctccgacaagagtggtcgccagcgagatggccgaagctctcaagggcatgcccatccgctaccaaaccacagccgtgaaatccgagcataccgggaaggagattgttgacctgatgtgccacgctacgtttacaatgcggctgctcagccctgtgagagtccccaattataacatgatcattatggatgaagcccatttcaccgacccttcttccatcgcggcccggggctacattagcacccgcgtgggaatgggcgaggctgccgctatctttatgacagccacaccccctgggtctgtggaagccttcccgcagagcaatgctgtcatccaggatgaggaaagagacattcccgagcggtcctggaactctggatatgagtggatcacagattttcctggcaaaaccgtttggttcgtgcccagcattaagtccgggaatgacatcgcgaactgtcttcgcaaaaatggaaagagagtgattcagctgtctcggaagacgtttgatacagaataccagaaaaccaagaacaacgactgggactacgtcgtgacaaccgatatcagcgagatgggcgccaatttcagagctgaccgcgttattgatcctcggagatgcctgaaacccgtgatcctcaaggacgggccggaacgcgtcatcctggccggccctatgcccgtgacggttgcctccgctgcccagcggagaggacgcattggccggaaccacaataaagagggggatcagtatatctacatgggacagccccttaacaatgacgaggatcatgcgcactggaccgaagctaagatgctgctcgacaacattaatacacctgagggcatcattcccgccctgttcgaacctgagagagaaaagagcgccgctatcgatggggagtatcgcctgagaggagaggcccggaaaacctttgtggaactcatgcgcagaggcgaccttccggtctggctgtcttacaaggtggcgtccgaggggttccaatatagcgatcggcgctggtgctttgacggcgaaagaaacaatcaggtcctggaggaaaacatggatgtggagatctggacaaaagagggagaacggaagaaactcagaccccgctggctggacgcccggacctactccgaccctcttgctctgagagagttcaaggaatttgccgctggccgccggtctgttagcggggatctcattctggagatcggaaaactgccccagcacctcacacagagagcccaaaatgctcttgacaacctggtgatgctgcataattccgaacagggcgggcgggcctatcgccacgcgatggaggagctccctgataccattgaaacgctgatgcttctggccctcatcgctgtgctgacaggaggcgtcaccctgttctttctctctggcagagggcttggaaagaccagcattggcctgctgtgtgttatggcctccagcgtgctcctgtggatggcttctgtggagccccattggatcgccgcctccatcattcttgagttctttctgatggtcctcctgatcccggagcctgaccggcagcgcacaccccaggataaccaactggcttacgtggttattgggctccttttcatgatcctgaccgtggcggccaatgagatgggactgctcgaaacaacgaagaaagacctgggcattgggcacgtcgctgtgggaaaccaccatcacgccgccatgcttgatgtcgacctgcatcctgctagcgcctggaccctctacgcggtggccacaaccatcattacacccatgatgagacacaccatcgagaacacgaccgctaatatctctctgacagccattgctaaccaggccgcgatcctgatgggcctcgataagggctggcctatttccaaaatggacatcggggttccccttctggccctgggatgctatagccaggtgaatccgctcaccctgacagctgccgtccttatgctggtggctcattacgccattatcggccctgggctccaagctaaggccacccgggaagcgcagaaacgcacggccgctggaatcatgaagaaccccacagttgatggcattgtggccatcgacctggatcccgtcgtgtatgacgctaagtttgagaaacagctggggcagattatgctccttatcctgtgtacctctcaaattctgctcatgagaacaacctgggccctgtgcgaaagcatcacccttgccacaggacctctgacgaccctctgggagggctccccgggcaagttctggaatacaaccatcgcggtgtctatggctaacatttttcgggggagctacctggccggagctggcctggccttctccctcatgaaaagccttgggggaggccgcagagggacaggagcccagggcgagaccctgggcgaaaagtggaaacggcagctgaatcagctctccaagtctgagttcaacacgtataagagaagcgggatcatggaagttgaccgctccgaggctaaagaaggactgaagcggggcgagacaaccaaacacgccgtctctagagggaccgcgaaacttcgctggtttgtggagcggaatctggtgaaacccgaaggaaaggtcattgatctcggctgtgggagaggaggctggagctactattgcgccggcctgaagaaagttacagaggtgaaggggtacaccaaaggaggccctgggcacgaagaacccatccctatggctacatacggatggaacctggtgaagctccattccggcaaagacgtcttctttattccccctgaaaagtgtgatacgcttctgtgcgacatcggggagtctagcccgaatcccaccattgaggaaggacgcacactgcgggtgctcaaaatggttgagccttggctgagaggcaaccaattctgtatcaagatccttaatccctatatgccttccgtggtcgaaaccctggagcagatgcagcgcaagcacggcgggatgctcgtgcggaaccccctgagcagaaattctacacatgagatgtactgggtttcctgcggaaccggcaacattgtgagcgccgtcaatatgacgtctcgcatgctgctcaaccggtttaccatggctcacagaaaaccgacatatgaacgcgatgtggacctgggggccggaaccagacacgtggcggtcgagcctgaagttgccaaccttgatatcattggccagcggatcgagaatattaagcatgaacacaaatccacatggcattacgacgaggataacccctataagacctgggcttaccacgggagctatgaggtgaaaccctctggatccgccagctccatggtgaatggcgtcgtgaagctgctcacaaagccttgggacgttatccccatggtgacccaaatcgctatgacggatacaacccctttcggccagcagcgcgtctttaaagaaaaggtggacaccagaacaccgaaagccaagcgggggacggctcaaattatggaggttaccgccaaatggctgtggggattccttagcagaaacaagaagccccggatctgtacacgcgaagagtttaccagaaaagtgcggtctaatgcggccattggcgctgtcttcgtggacgaaaaccagtggaatagcgccaaggaggctgttgaggatgaacgcttttgggacctggtgcatagagagcgggaactccacaaacaggggaagtgcgccacatgcgtctacaacatgatgggaaaacgcgagaagaagctgggcgagttcgggaaagccaagggctccagagcgatctggtacatgtggctgggagctcggtttctcgagttcgaggccctgggcttcatgaatgaagatcactggttttctcgcgagaacagcctttccggggtggaaggagagggcctgcataaactcgggtatattctgagagacatctctaagatccctggaggcaatatgtacgccgatgacaccgctgggtgggatacacggattaccgaggacgatcttcagaacgaagcccgcatcacggacattatggagcccgaacacgctctgctcgccaaaagcatcttcaagctgacctatcaaaataaagtcgtgagagttcagcggcctgcgaagaacggcacagtgatggatgtcatttcccgcagagaccagcggggatctggccaggtggggacctacggactgaatacatttaccaacatggaggcccaactcatcagacagatggaaagcgagggcatcttctcccccagcgagctggaaacgccgaaccttgctgagcgcgtgctggattggctcgaaaagtatggggttgagcggctgaaaagaatggccatttctggagacgactgtgtggtcaagcctatcgatgaccgctttgctacagcccttaccgcgctgaatgatatgggcaaagtgcggaaggacattccccagtgggaaccttccaaagggtggaacgattggcagcaagttcccttctgcagccatcactttcaccagctcatcatgaaggacggcagagagattgtggtcccttgtcgcaatcaggatgagctggtgggacgggccagagtctctcagggcgctgggtggtccctgcgcgaaacagcctgcctcggaaagagctacgctcaaatgtggcagctgatgtatttccatcggagagaccttcgcctggccgctaacgccatctgttccgcggtgcccgttgattggattccgacctctcggacgacctggagcatccacgcccatcaccagtggatgacaaccgaggacatgctctccgtgtggaatagagtctggatcgaagagaacccttggatggaagataaaacacatattagctcttggggcgacgtgccctacctggggaagcgggaggaccaatggtgcggatcccttatcggcctgaccgctagagccacatgggccaccaatattcaggttgctatcaaccaggtgcgccggctcattgggaatgagaactacctggattatatgacgagcatgaaaagatttaagaatgaatctgaccccgagggcgccctgtggtga

SEQ ID NO: 19216 - RNA, 9879 nt, synthetic construct
  misc_feature 1..9879: note = derived and/or modified CDS sequence (opt5) from DENV-1__GU131780__SS-prME
  source 1..9879: mol_type = other RNA
agcgtgaccatgctgctcatgctgatgcccaccgcccttgctttccacctgacgaccagaggaggggagcctcatatgatcgtctccaagcaggaacggggaaagtctctcctgtttaagacaagcgccggcgttaacatgtgcacccttattgccatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgttgccctcgctcctcatgtggggctgggactggagacaagaaccgaaacgtggatgagctccgagggcgcctggaagcagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaggacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttctctggccatctgaagtgcagactcaaaatggataagctgacgcttaaagggatgtcctatgtgatgtgtacaggcagcttcaagctggagaaggaagtcgctgagacccagcacggaaccgtgctcgttcagatcaaatacgagggcacagacgccccgtgcaagattcctttttctacccaggatgaaaaaggggtgacacaaaacggacggctgatcacggcgaatcccatcgtcaccgacaaggagaaacctgtgaacattgaagctgagccgcccttcggcgagagctatatcgtgattggggccggagaaaaggccctgaaactttcctggtttaaaaagggctctagcatcgggaaaatgttcgaggctacagccagaggcgctcgccggatggccattctcggagataccgcgtgggactttggctccatcgggggagttttcacaagcgtcggcaagctggtgcatcagatctttgggaccgcctacggagtgctgttctctggcgtctcctggacgatgaaaattgggatcggcgtgctcctgacctggcttggactgaatagcagatctacatccctcagcatgacctgtattgctgttggcctggtgacactgtaccttggggtcatggtgcaggccgattccggatgcgttatcaactggaagggccgcgaactcaagtgtgggtctggaatttttgtgaccaatgaggtccacacatggaccgaacagtataaattccaagctgacagccctaagcggctgtccgccgcgatcggcaaagcctgggaggagggggtgtgcggcattagatctgctacgcgcctggaaaacatcatgtggaagcagatcagcaacgagctcaatcatattctgcttgaaaacgacatgaaatttacagttgtggtcggagatgtggccggcatcctggctcaggggaagaaaatgattcggccgcagcccatggagtacaagtattcctggaaaagctggggaaaagccaagatcattggcgccgacgtgcaaaataccaccttcatcatcgatgggcctaacacacccgaatgtcctgacgatcagagagcttggaatatttgggaggtcgaggactacggatttggcatcttcaccacgaacatttggctcaaactgcgcgattcttatacacaggtttgcgaccaccggctgatgtccgcggccatcaaggatagcaaagctgtgcacgccgacatgggctactggattgaatctgagaagaatgaaacctggaaacttgccagagcttccttcatcgaggtgaaaacatgtatctggcccaagagccataccctctggtctaacggggtcctggaaagcgagatgattatcccgaaaatttatggaggccctatctcccagcacaattaccgccccgggtactttacacaaaccgccggaccttggcatctgggcaagctcgagctggatttcgacctttgcgaagggacgaccgtggttgtggatgagcactgcggaaaccggggccccagcctgagaacaaccacagtcaccggcaaaattatccacgaatggtgttgccggtcttgtacgctccctcccctgcgctttaagggggaggacggatgctggtatggcatggagatcagaccggtgaaggaaaaagaggaaaatctggttaagtccatggtgagcgcggggtccggagaggtcgactctttcagccttggcctcctgtgtatttccatcatgattgaagaggtgatgcggtctagatggagccgcaaaatgctgatgacagggaccctcgctgtctttttcctgcttatcatgggacagctgacatggaacgatctcattcggctgtgcatcatggtgggcgccaatgcctccgacagaatgggcatggggaccacctacctggctcttatggccacatttaagatgcgccctatgttcgcggtcggactgctctttagacggctgacgtctcgcgaggtgctcctgcttaccattggcctgagcctcgtggcttccgtcgaactgcccaacagcctggaggaacttggggatggactggccatgggcatcatgatcctcaaactgctcacagacttccagtctcatcaactgtgggccacccttctgtccctcacatttattaagaccacgttcagcctgcactatgcttggaagacaatggccatggttctgtctatcgtgtccctttttcccctgtgtctcagcaccacctctcagaaaacaacctggctgcctgtgctcctggggtcccttggatgcaagccgctgacaatgttcctgattgctgagaataaaatctggggcagaaagagctggcccctcaacgaaggcattatggccgtcgggatcgtgtccatcctgcttagctctctgctcaaaaacgatgttcctctggcgggacccctcattgccggcgggatgctgatcgcttgttacgtgattagcggatcctctgccgaccttagcctggagaaggctgccgaggtctcctgggaagaggaagccgagcattctggcgctagccacaatatcctggtggaagttcaggatgacgggacgatgaaaattaaggatgaggagcgggacgataccctcacaatcctgcttaaggcgaccctgctcacagtgtccggagtctatcctctgtctatccccgccaccctcttcgtgtggtacttttggcagaaaaagaaacaacgcagcggcgtcctgtgggacacgcctagccctcccaaggtggaaagagctgttcttgatgacggcatttatcggatcatgcagcgcgggctgctgggaagaagccaggtgggcgtcggggtgttccaggagaacgtttttcataccatgtggcacgtgacacggggagccgtcctcatgtaccaaggcaaacgcctggaaccctcttgggcctccgtgaagaaggaccttattagctacgggggaggctggagactgcagggctcttggaataccggggaggaggtgcaggttatcgctgtcgaacccggcaagaaccctaagaatgtgcagacagcccccggcaccttcaaaacatccgagggggaagtgggagcgattgctctcgattttaagccgggcacgagcgggtcccctatcgtcaaccgggagggaaaaattgtgggcctgtatggcaatggggttgtgaccacatctggaacctacgtcagcgccatcgcccaagctaaggcctcccaggaaggccccctccctgagatcgaggacgaagtgttcagaaagcgcaacctgaccattatggatcttcaccccgggagcggaaaaacacggagatatctgcccgcgatcgttcgcgaggctattaagcggaaactgagaacgctcatcctggcccctacccgcgtggtcgcctctgaaatggctgaggcccttaagggcatgccgattcggtaccagacaaccgctgtgaaatccgaacatacagggaaggagatcgttgacctgatgtgccacgccacctttacgatgagactcctgagccccgtgcgcgtccctaattataacatgatcattatggatgaggcgcatttcacagacccctctagcatcgccgctcggggctacatttccaccagagtgggaatgggcgaagccgctgccatctttatgaccgccacacctcccgggtctgtggaggctttccctcaaagcaatgcggtcattcaggatgaagaacgggacatcccggaacgctcctggaactctggatatgagtggatcaccgattttcccggcaagacagtttggttcgtgcctagcattaaatccgggaatgacatcgccaactgtctgagaaagaatggaaaacgggtgattcagctcagccgcaagaccttcgatacggagtaccagaaaacaaagaacaacgactgggactacgtcgtgaccacagatatctctgaaatgggcgctaattttagagccgaccgggttattgatcccagacgctgccttaagcctgtgatcctgaaagacgggcccgagcgggtcattctggccggcccgatgcctgtgaccgttgcttccgccgcgcaaagacgcggacggatcggcagaaaccacaataaggaaggggatcagtatatctacatgggacagcccctcaacaatgacgaggatcatgctcactggacggaggccaaaatgctgcttgacaacattaatacccccgaaggcatcattcctgccctgttcgagcccgaacgcgaaaagtccgctgccatcgatggggaatatcggctcagaggagaggcgcgcaaaacatttgtggagctgatgagacggggcgacctgcctgtctggctctcctacaaggtggcctctgaagggttccagtatagcgatcgcagatggtgctttgacggcgagcggaacaatcaagtccttgaagagaacatggatgtggaaatttggaccaaagagggagagcgcaagaagctgagaccgcggtggctggacgctagaacatactccgaccccctcgccctgcgcgagttcaaagagtttgctgccggccggagatctgttagcggggatcttatcctggaaatcggaaagctccctcagcacctgacccagcgcgctcagaatgccctggacaacctcgtgatgcttcataattccgagcaaggcgggcgggcgtatagacacgccatggaggaactgcccgatacaattgagaccatgatgctgctcgctctgatcgccgtgcttacgggaggcgtcacactgttctttctcagcggccgggggctgggaaaaacctctattggcctgctctgtgttatggcttccagcgtgcttctgtggatggcctctgtggaacctcattggatcgccgcttccattatcctggagttctttctcatggtcctgcttatccccgaaccggaccgccagagaacccctcaggataaccagctggcgtacgtggttattgggctcctgttcatgatcctgacagtggccgctaatgagatgggactccttgagaccacaaagaaagacctgggcattgggcacgtcgccgtggaaaaccaccatcacgccgctatgctggatgtcgacctccatcccgccagcgcgtggacgctgtacgccgtggctaccacaatcattacccctatgatgcggcacacaatcgagaacaccacggccaatatttctcttaccgctatcgccaaccaagcggccatcctgatgggactcgataagggctggcccattagcaagatggacatcggcgttcctctgctggctctcgggtgctattcccaggtgaatccccttacactgaccgccgctgtcctgatgctcgtggcccattacgctattatcggaccgggcctgcaggccaaagcgacacgcgaagcccaaaagagaaccgctgccgggattatgaaaaaccctacggttgatggaatcgtggctatcgaccttgatcccgtcgtgtatgacgccaagtttgagaaacagctgggccagattatgctcctgatcctgtgtacatctcagattctccttatgcggaccacatgggccctgtgcgaaagcatcaccctggcgaccgggcccctcacaacgctgtgggagggatcccctggcaagttctggaataccacaattgctgtgagcatggccaacatcttccgcggctcctaccttgctggggccggactggccttttctctcatgaagtccctgggcgggggaagacggggcaccggggctcaaggagagacactgggcgaaaaatggaagcgccagctcaatcagctttccaaatctgagttcaacacctataagagaagcggcatcatggaagttgaccggtccgaggccaaagaagggctgaagagaggagagacgacaaagcacgcggtctctcgcggcaccgccaaactgcggtggtttgtggagagaaatctcgtgaagccggaagggaaagtcattgatctgggatgtggccgcgggggatggagctactattgcgctggccttaagaaagttaccgaggtgaagggctacacaaaagggggacccggccacgaggagcctatccccatggccacctacgggtggaacctggtgaagctccattccggaaaggacgtcttctttattcctcccgaaaaatgtgatacactgctgtgcgacatcggcgagagctctcctaatccgacgattgaggaagggcggaccctcagagtgcttaagatggttgagccctggctgcgcggaaaccagttctgtatcaaaattctgaatccttatatgccctccgtggtcgaaacactcgagcaaatgcagcggaagcacggcggcatgctggtgagaaaccctcttagccgcaattctacccatgagatgtactgggtttcctgcgggacaggaaacatcgtgagcgctgtcaatatgacctctcggatgctgctcaacagatttacgatggcccaccgcaaacccacctatgaacgggatgtggacctgggcgcggggacaagacacgtggccgtcgagccggaagttgctaacctggatatcattggacagcgcatcgagaatattaagcatgaacacaagtccacctggcattacgacgaggataacccttataaaacatgggcctaccacggcagctatgaggtgaagccctccgggagcgcttctagcatggtgaatggagtcgtgaaactcctgaccaagccctgggacgttatccctatggtgacacagattgccatgaccgatacgacacccttcggccaacagagagtctttaaagaaaaggtggacacccggacccctaaggctaaacgcggcacagcccagatcatggaggttacggcgaagtggctttgggggttcctgtccagaaacaaaaagccgcggatctgtaccagagaagagtttacacggaaagtgcgctctaatgccgctattggagccgtcttcgtggacgaaaaccaatggaatagcgctaaggaggccgttgaggatgaaagattttgggacctcgtgcatcgggagcgcgaactgcacaagcagggcaaatgcgcgacctgcgtctacaacatgatggggaagagagagaagaaacttggagagttcggcaaagcgaaggggtcccgggctatctggtacatgtggctgggcgcccgcttcctcgagtttgaggccctgggattcatgaatgaagatcactggttttctagagagaacagcctgtccggcgtggaaggggagggactccataaactgggctatattcttcgggacatctctaagattcccgggggaaatatgtacgctgatgacacagccggctgggatacccgcatcacagaggacgatctgcagaacgaagctaagatcaccgacattatggagcctgaacacgccctcctggcgaaaagcatcttcaaacttacgtatcagaataaagtcgtgagagttcaacggcccgccaagaacgggaccgtgatggatgtcatttcccgcagagaccagcggggcagcggacaggtgggcacatacgggctgaatacctttacaaacatggaggctcagctcatccgccaaatggaatctgagggaattttctcccctagcgagctggaaacccccaacctggccagacgggtgctcgattggctggagaaacatggcgttgaaagacttaagcgcatggctatctctggggacgactgtgtggtcaagccgatcgatgaccggtttgccacggcgctgacagccctcaatgatatgggaaaagtgagaaaggacattcctcagtgggagccctccaaaggctggaacgattggcagcaggttcctttctgcagccaccactttcatcaactgatcatgaaggacgggcgcgaaattgtggtcccctgtcggaatcaggatgagcttgtgggcagagctcgcgtctcccagggagccggctggtctctgcgggagaccgcttgcctcgggaaaagctatgcccagatgtggcaactgatgtacttccacagacgcgacctgcggctcgctgccaacgcgatctgttccgccgtgcctgttgattgggtgcccacaagcagaaccacgtggtctattcatgctcaccatcagtggatgaccacagaagacatgctgtccgtctggaatcgcgtgtggatcgaggaaaacccgtggatggaggataagacccacattagctcttggggagacgttccttatcttggcaagcgggaagaccagtggtgcgggagcctgatcggactcacagccagagccacctgggctacaaatatccaagtggccattaaccaggtccggagactgatcggcaatgagaactaccttgattacatgacctccatgaaacgctttaagaatgagtctgaccccgaaggggcgctgtggtga

SEQ ID NO: 19217 - RNA, 9879 nt, synthetic construct
  misc_feature 1..9879: note = derived and/or modified CDS sequence (opt5) from DENV-1__GU131781__SS-prME
  source 1..9879: mol_type = other RNA
agcgtgaccatgctgctgatgctgatgcccacggcccttgctttccacctgacgaccagaggaggggagcctcatatgatcgtctccaagcaggaacggggaaagtctctcctgtttaagacaagcgccggcgttaatatgtgcacccttattgcgatggacctgggggagttctgtgaagatacaatgacctacaagtgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagataagcctgtgaacatcgaggccgaaccgcccttcggcgagtcttatattgtgatcggggccggagagaaagctctgaaacttagctggtttaagaaaggctcctctattgggaagatgttcgaagccaccgctagaggcgcccgccggatggcgatcctcggagacacagcctgggattttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgacagcggatgcgttgtgaactggaaaggccgcgagctcaagtgtgggtccggaatttttgtcacaaatgaagtgcacacctggacagagcaatataagttccaggccgactctcctaaacggctgagcgcggccatcggcaaggcttgggaagagggggtttgcggcattagatccgccacccgcctggagaacatcatgtggaaacagatctctaacgaactcaatcatattctgcttgagaacgatatgaagtttacggtggtcgtgggagacgtggctggcatcctggcccaggggaaaaagatgattcggccgcaacccatggaatacaaatatagctggaagtcctggggaaaggccaaaatcattggcgctgatgtccagaatacaaccttcatcatcgacgggcctaacacccccgagtgtcctgatgaccagagagcgtggaatatttgggaagttgaggattacggatttggcatcttcacaaccaacatttggctcaagctgcgcgacagctatacacaggtgtgcgatcaccggctgatgtctgccgctatcaaagactccaaggccgtgcacgccgatatgggctactggattgagagcgagaagaatgagacatggaaacttgctagagcctctttcatcgaagtcaagacctgtatctggcccaaatcccatacactctggagcaacggggtgctggagtctgaaatgattatcccgaagatttatggaggccctatcagccaacacaattaccgccccgggtactttacccagacagcgggaccttggcatctgggcaaactcgagctggacttcgatctttgcgaggggaccacggttgtggtcgacgaacactgcggaaaccggggcccctccctgagaaccacaaccgtgacaggcaagattatccacgagtggtgttgccggagctgtaccctccctcccctgcgctttaaaggggaagacggatgctggtatggcatggagatcagaccggttaaggagaaggaagagaatctggtgaaatctatggtctccgctgggagcggagaagtggattccttctctcttggcctcctgtgtattagcatcatgattgaggaagttatgcggtccagatggtctcgcaagatgctgatgacggggacactcgccgtgtttttcctgcttatcatgggacagctgacctggaacgacctcattcggctgtgcatcatggtcggcgccaatgctagcgatagaatgggcatggggacaacctacctggcccttatggcgacctttaaaatgcgccctatgttcgctgtgggactgctctttagacggctgacatcccgcgaggtgctcctgcttacgattggcctgtctctcgtcgccagcgttgagctgcccaactccctggaagaacttggggacggactggccatgggcatcatgatcctcaagctgctcaccgatttccaaagccatcagctgtgggctacacttctgtctctcacctttattaaaacaaccttctccctgcactatgcctggaagacgatggctatggtgctgagcatcgtgtctctttttcccctgtgtatgtccacaaccagccagaagaccacatggctccctgtcctgctcgggtctctgggatgcaaaccgcttaccatgttcctgattgccgaaaataagatctggggcagaaaatcctggcccctgaacgagggcattatggcggtggggatcgttagcatcctcctgtccagccttctgaagaacgacgtgcctctcgccggacccctgattgctggcgggatgctcatcgcctgttacgtcatttctggaagctccgctgatctgtctcttgaaaaagccgccgaggtgagctgggaggaagaggctgaacattccggcgcgtctcacaatatcctggttgaggtgcaggacgatgggacaatgaagattaaagacgaagaacgggatgacacgctgaccatcctcctgaaggccacacttctggctgtcagcggagtgtatcctctctccatccccgccaccctgttcgtctggtacttttggcaaaagaaaaagcagcgctctggcgtgctctgggatacaccttcccctcccgaggttgaaagagccgtgctggacgacggcatttatcggatcatgcagcgcgggcttctgggaagatcccaggtcggcgtgggggttttccaagagaacgtgtttcataccatgtggcacgtcacgcggggagctgtgctgatgtaccagggcaaacgcctcgaacccagctgggcctctgtgaagaaagatctgatttcctacgggggaggctggagacttcagggcagctggaataccggggaggaggttcaggtcatcgcggtggaacccggaaagaaccctaagaatgtgcaaacagctcccggcaccttcaaaacatctgagggggaagtcggagccattgccctggactttaagccgggcacctccgggagccctatcgtgaaccgggagggaaaaattgttggcctctatggcaatggggtggtcacaacgtccggaacctacgtgtctgctatcgcccaggcgaaggctagccaggaaggccccctgcctgagatcgaggatgaagttttcagaaaacgcaacctcacaattatggacctgcaccccgggtccggaaagacccggagatatcttcccgccatcgtgcgcgaggccattaagcggaaactgagaaccctgatcctcgctcctacacgcgtcgtggccagcgaaatggctgaggccctgaagggcatgccgattcggtaccaaacgaccgcggttaaatctgaacatacagggaaggagatcgtggatcttatgtgccacgccacctttacaatgagactgctctcccccgtccgcgtgcctaattataacatgatcattatggacgaggctcatttcaccgatcccagctctatcgccgctcggggctacattagcacgagagtgggaatgggcgaagccgccgctatctttatgacagcgacccctcccgggtccgtcgaggccttccctcagtctaatgctgttattcaggacgaggaacgggatatcccggaacgcagctggaactccggatatgagtggatcaccgactttcccggcaaaacagtgtggttcgtgccttctattaagagcgggaatgatatcgccaactgtctgagaaagaatggaaaacgggtcattcagctgtcccgcaagaccttcgacacagagtaccagaagaccaagaacaacgactgggattacgtggttacgacagacatcagcgaaatgggcgccaattttagagctgatcgggtgattgaccccagacgctgcctcaaacctgtcatccttaaggatgggcccgagcgggtgattctggccggcccgatgcctgttaccgtggcgtctgctgcccagagacgcggacggatcggcagaaaccacaataaggaaggggaccagtatgtctacatgggacagcccctgaacaatgatgaggaccatgcccactggacagaggctaaaatgctcctggataacatcaatacccccgaaggcattatccctgcccttttcgagcccgaacgcgagaagtccgcggccattgacggggaatatcggctgagaggagaggctcgcaaaacgtttgtggagctcatgagacggggcgatctgcctgtctggctgagctacaaggtggcctccgaagggttccaatattctgaccgcagatggtgctttgatggcgagcggaacaatcaggttctcgaagagaacatggacgtggaaatctggaccaaagagggagagcgcaagaaacttagaccgcggtggctggacgctagaacatacagcgatcccctggccctccgcgagttcaaggagtttgctgccggccggagatccgtgtctggggacctgattcttgaaatcggaaagctgcctcagcacctcacccagcgcgcgcaaaatgccctggataacctggtcatgctccataatagcgagcagggcgggcgggcttatagacacgccatggaggaacttcccgacacaatcgagaccctgatgctgctcgctctgattgccgttcttacaggaggcgtgaccctgttctttctctccggccgggggctgggaaaaacgagcatcggcctgctctgtgtgatggcctcttccgtccttctgtggatggctagcgtggaacctcattggattgcggcctctatcattctggagttctttctcatggttctgcttatccccgaaccggatcgccagagaacacctcaggacaaccaactggcttacgtggtcatcgggctcctgttcatgattctgaccgtggccgccaatgagatgggactccttgagaccacaaagaaagatctgggcatcgggcacgtcgctgtggaaaaccaccatcacgccgcgatgctggacgttgatctccatcccgcctccgcttggaccctgtacgccgtggctacaacgattatcacccctatgatgcggcacacaattgagaacaccacagccaatatcagccttaccgcgattgccaaccaggctgccatcctgatgggactcgacaagggctggcccatctctaaaatggatattggcgtccctctgctggctctcgggtgctatagccaggtgaatccccttacgctgaccgccgctgttctgatgctcgtggcccattacgcgatcattggaccgggcctgcaagccaaggctacacgcgaagcccagaagagaaccgctgccgggatcatgaaaaaccctacagtcgacggaattgtggccatcgatcttgaccccgtggtttatgacgcgaagtttgagaaacagctgggccagatcatgctcctgattctgtgtacctcccaaatcctccttatgcggacgacatgggctctgtgcgaatctattaccctggccacagggcccctcaccaccctgtgggagggaagccctggcaagttctggaatacaacgatcgctgtctccatggccaacattttccgcggcagctaccttgccggggctggactggccttttccctcatgaaatctctgggcgggggaagacggggcaccggggcgcagggagagacactgggcgaaaagtggaagcgccagctcaatcagcttagcaaatccgagttcaacacctataagagatctggcatcatggaagtggatcggagcgaggccaaagaagggctgaagagaggagagacaaccaaacacgctgtgtcccgcggcacggccaagctgcggtggtttgtcgagagaaatctcgttaagccggaagggaaagtgatcgacctgggatgtggccgcgggggatggtcttactattgcgctggccttaagaaagtgacagaggtcaagggctacaccaaagggggacccggccacgaggaacctattcccatggccacctacgggtggaacctggtgaagctccatagcggaaaagatgttttctttatccctcccgaaaagtgtgacacactgctgtgcgatattggcgagtccagccctaatccgaccatcgaggaagggcggacactcagagtgcttaagatggtcgagccctggctgcgcggaaaccaattctgtattaaaatcctgaatccttatatgccctctgtggttgaaacgctcgagcagatgcagcggaagcacggcggcatgctggtgagaaaccctctttcccgcaatagcacccatgagatgtactgggtctcttgcgggacaggaaacattgtgtccgcggtgaatatgaccagccggatgctgctcaacagatttacaatggcccaccgcaaacccacctatgaacgggacgtcgatctgggcgctgggacgagacacgttgccgtggagccggaagtggctaacctggacatcatcggacagcgcattgagaatatcaagcatgaacacaaatctacctggcattacgatgaggacaacccttataagacatgggcctaccacggctcctatgaggtcaagcccagcgggtccgctagctctatggtgaatggagttgtgaaactcctgaccaagccctgggatgtcattcctatggtgacacaaatcgccatgaccgacacaacccccttcggccagcagagagtttttaaagaaaaggtggacacgcggacacctaaagcgaagcgcggcaccgcccaaattatggaggtcaccgctaagtggctttgggggttcctgagcagaaacaaaaagccgcggatctgtacaagagaagagtttacgcggaaagtgcgctccaatgccgctatcggagccgttttcgtggatgaaaaccagtggaactctgccaaggaggcggtcgaggacgaaagattttgggatctcgtgcatcgggagcgcgaactgcacaaacagggcaagtgcgctacctgcgtctacaacatgatggggaagagagagaagaaacttggagagttcggcaaagccaaagggagccgggccatttggtacatgtggctgggcgctcgcttcctcgagtttgaggccctgggattcatgaatgaagaccactggttttccagagagaactctctgagcggcgtggaaggggagggactccataaactgggctatatccttcgggatatttccaagatccccgggggaaatatgtacgctgacgatacagccggctgggacacccgcattacagaggatgacctgcagaacgaagcgaaaatcaccgatatcatggagcctgaacacgccctcctggctagatctattttcaaacttacatatcaaaataaggttgtgcgggtccagcgccccgccaaaaacgggaccgtgatggacgtgatcagcagacgggatcagcgcggctccggacaggttggcacgtacgggctgaatacctttacaaacatggaggctcaactcattagacagatggaaagcgagggaatcttctctccttccgagctggaaacccccaacctggccggccgggtgctcgactggctggagaagcatggggtcgaaagacttaaacgcatggcgattagcggagacgattgtgtggttaagccgatcgacgatcggtttgccacagctctgaccgccctcaatgacatgggcaaagtgagaaaggatatccctcagtgggagccctctaaggggtggaacgactggcagcaagtccctttctgctcccaccactttcatcagctgattatgaaagatggccgcgaaatcgtggtcccctgtcggaatcaggacgagcttgtgggcagagctcgcgttagccagggcgccgggtggtccctgcgggagacggcttgcctcggaaagtcttatgcccaaatgtggcagctgatgtacttccacagacgcgatctgcggctcgcggccaacgctatttgtagcgccgtgcctgtcgactgggtgcccacatccagaaccacatggagcatccatgcccaccatcagtggatgaccacggaagatatgctgtctgtttggaatcgcgtgtggattgaggaaaacccgtggatggaggacaaaacccacatctccagctggggcgacgtcccttatcttgggaagcgggaagatcaatggtgcggatctctgattggcctcacagctagagccacctgggcgacaaatatccaggtggctatcaaccaggtgcggagactgattgggaatgagaactaccttgactacatgaccagcatgaaacgctttaagaatgagtccgatcccgaaggcgccctgtggtga

SEQ ID NO: 19218 - RNA, 9879 nt, synthetic construct
  misc_feature 1..9879: note = derived and/or modified CDS sequence (opt5) from DENV-1__GU131782__SS-prME
  source 1..9879: mol_type = other RNA
agcgtgaccatgctgctcatgctgatgcccaccgcccttgctttccacctgacgaccagaggcggggaacctcatatgatcgtcacaaagcaggaacggggaaagtcccttctgtttaagacctctgccggcgttaacatgtgcacacttattgcgatggacctgggggaactctgtgaagataccatgacatacaagtgcccccgcatcaccgaggctgaacccgacgatgtggactgttggtgcaatgccacggatacctgggtgacatatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggttacacagaacggacggctgatcacggctaatcccattgtgaccgacaaagagaagcctgtcaacatcgaagccgagccgccctttggcgagagctatattgtgatcggggccggagaaaaagctcttaagctctcttggttcaagaaaggcagctccattgggaagatgtttgaggccacagctagaggcgcccgccggatggcgatcctgggagataccgcctgggacttcggctctatcgggggagtgtttacaagcgttggcaaactggtccatcagattttcgggaccgcttacggagtgctcttttccggcgtgagctggacgatgaagatcgggattggcgtcctgcttacctggctgggactcaattctagatccacaagcctgtctatgacctgtatcgccgtgggcctggttacactttacctcggggtgatggtccaggctgattccggatgcgtgattaactggaaaggccgcgaactgaagtgtgggagcggaatcttcgttaccaatgaggtgcacacatggaccgaacaatataagtttcaggccgactcccctaaacggctgtctgcggccattggcaaggcttgggaggagggggtctgcggcatcagaagcgccacgcgcctcgaaaacatcatgtggaaacagatttccaacgagctgaatcatatccttctggaaaacgacatgaagttcacagtggttgtgggagatgtcgtgggcattctcgctcaggggaaaaagatgatccggccgcaacccatggagcacaaatactcttggaaaagctggggaaaggccaagattatcggcgccgacgtgcagaataccacctttatcattgatgggcctaacacacccgaatgtcctgacgatcagagagcttggaatatctgggaggtcgaggactatggattcggcatttttaccacgaacatctggctgaagctgcgcgattcctacacacaggtttgcgaccaccggcttatgagcgcggccattaaagattctaaggctgtgcatgccgacatgggctattggatcgaatccgagaaaaatgaaacctggaagctcgccagagctagcttcatcgaggtgaagacatgtatttggcccaaatctcacaccctgtggtccaacggggtcctggaaagcgagatgatcattccgaagatctacggaggccctatttctcaacataattatcgccccgggtacttcacacagaccgccggaccttggcacctcggcaaactggagcttgattttgacctgtgcgaagggacgaccgtggttgtggatgagcactgcggaaaccggggccccagcctcagaacaaccacagtcaccggcaagatcatccatgaatggtgttgccggtcctgtacgctgcctcccctgcgcttcaaaggggaggacggatgctggtacggcatggagattagaccggtgaaggaaaaggaggaaaatcttgttaaaagcatggtgtctgcggggctcggagaggtcgactcctttagcctgggcctgctctgtatctccattatgatcgaagaggtgatgcggtctagatggagccgcaagatgctgatggctgggacacttgccgttttcctgctcctgattatgggacagctgacctggaacgatcttatccggctgtgcattatggtgggcgccaatgcttccgacagaatgggcatggggacaacctatctcgccctgatggcgacctttaaaatgcgccctatgttcgctgtcggactcctgtttagacggcttacatctcgcgaggtgctgctcctgacgatcggcctgagccttgtggcctccgtcgaactgcccaactctctcgaggaactgggggatggactcgccatgggcatcatgattctgaaacttctgaccgacttccaaccccaccagctctgggctacactgctgagccttacctttatcaaaacaaccctgtccctccattacgcctggaagacgatggctatggttctgagcattgtgtctctcttccctctgtgtctttccacaaccagccagaagaccacatggctgccggtgctgctcgggtctctgggatgcaaaccccttaccatgtttctgatcgccgagaataagatttggggcagaaaatcctggcctctcaacgaaggcatcatggcggtcggggtggttagcatcctgctctcttccctgcttaagaacgatgtgcccctggccggacctctgattgctggcgggatgctcatcgcctgttatgtcattagcggatccagcgctgacctgtctcttgagaaagccgccgaggtgagctgggaagaggaagctgagcactccggcgcgtctcataatatcctggttgaagtgcaggatgacgggacaatgaagattaaagatgaggagcgggacgatacgctcaccatcctgctcaaggccacactgcttgctatcagcggagtctaccccctgtccattcctgccaccctgttcgtgtggtatttttggcaaaagaaaaagcagcgctctggcgtcctctgggacacacccagcccgcctgaagtggagagagccgttctggatgacggcatctaccggattatgcagcgcgggcttctgggaagatcccaggtgggcgtcggggtgttccaagaaaacgttttccacaccatgtggcacgtgacgcggggagctgtcctcatgtatcagggcaaacgcctggagccctcttgggccagcgtgaagaaagacctcatctcctacgggggaggctggagactgcagggcagctggaataccggggaggaagtgcaggttattgcggtcgagcctggaaagaaccccaagaatgtgcaaacagctccgggcacctttaaaacacctgaaggggaggtgggagccatcgcccttgatttcaagcccggcacctctgggtcccctattgtcaaccgggaaggaaaaatcgtgggcctgtacggcaatggggttgtgacaacgagcggaacctatgtctctgctatcgcccaggcgaaggcttcccaggagggccccctgcccgagattgaagacgaggtgtttagaaaacgcaacctcacaatcatggatctgcatcctgggagcggaaagacccggagataccttccggccattgttcgcgaagccatcaagcggaaactgagaaccctcattctggctcccacacgcgtggtcgcctccgagatggctgaagccctgaagggcatgcctatccggtatcaaacgaccgcggtgaaatctgagcacacagggaaggagatcgttgacctcatgtgccatgccaccttcacaatgagacttctgagccccgtgcgcgtccctaattacaacatgattatcatggatgaagctcactttaccgacccctccagcattgccgctcggggctatatctctacgagagtgggaatgggcgaggccgccgctattttcatgacagcgacccctccggggtccgtggaagcctttccccagagcaatgctgtcatccaggatgaggaacgggacatccctgagcgctcttggaacagcggatacgagtggattaccgatttccccggcaaaacagtttggtttgtgccttccatcaagtctgggaatgacattgccaactgtctgagaaagaatggaaaacgggtgatccagctcagccgcaagaccttcgatacagaatatcagaagaccaagaacaacgactgggactacgtcgtgacgacagatatttccgagatgggcgccaattttagagctgaccgggttatcgatcccagacgctgcctgaaaccggtgattcttaaggacgggcctgaacgggtcatcctggccggccccatgcccgtgaccgttgcgtctgctgcccagagacgcggacggatcggcagaaaccataataaggagggggatcagtacatttatatgggacagcctctcaacaatgacgaggatcacgcccactggacagaagctaaaatgctgctggacaacatcaatacccccgagggcattatccctgccctcttcgaaccggagcgcgaaaagagcgcggccattgatggggagtaccggcttagaggagaggctcgcaaaacgttcgtggaactgatgagacggggcgacctgcccgtctggctctcctataaggtggccagcgaggggtttcaatactctgatcgcagatggtgcttcgacggcgaacggaacaatcaggtcctggaggaaaacatggatgtggagatctggaccaaagagggagaacgcaagaaacttagacctcggtggctggacgctagaacatattccgaccccctcgccctgcgcgagtttaaggagttcgctgccggccggagaagcgtttccggggatctgatcctcgagattggaaaacttcctcagcatctgacccagcgcgcgcaaaatgccctggacaacctcgtgatgctgcacaattctgaacagggcgggcgggcttacagacatgccatggaggagcttcccgatacaatcgaaaccctgatgctcctggctctgattgccgtgctcacaggaggcgtcaccctctttttcctgagcggccgggggctgggaaaaacgtccatcggcctcctgtgtgttatggcctctagcgtgcttctgtggatggcttccgtggagccgcactggattgcggccagcatcatcctcgaatttttcctgatggtcctgctcattcctgagcccgaccgccagagaacacctcaggataaccaacttgcttatgtggttatcgggctgctgtttatgattctcaccgtggccgccaatgagatgggactgcttgaaaccacaaagaaagacctgggcatcgggcacgtcgctgtggagaaccatcaccatgccaccatgctcgatgtcgacctgcaccccgcgtctgcctggacactgtacgctgtggccacgaccattatcacacctatgatgcggcataccattgaaaacacaaccgctaatatctccctcacggccatcgcgaaccaggccgctattcttatgggactggataagggctggcccatcagcaaaatggacattggcgttccgctgctcgccctggggtgctactctcaggtgaatcctcttaccctgacagctgccgtcctcatgctggtggctcactatgccatcattggacccggcctgcaagcgaaggccacccgcgaggctcagaagagaacagccgctgggatcatgaaaaaccccaccgttgatggaatcgtggccattgacctcgatcctgtcgtgtacgacgccaagttcgaaaaacagcttggccagatcatgctgctgattctctgtacgtcccaaatcctgcttatgcggacaacctgggcgctgtgcgagagcattacactcgctaccgggccgctgaccacactgtgggagggatctcccggcaagttttggaatacgaccatcgccgtgagcatggctaacatcttccgcggctcctatctcgccggggccggacttgctttttctctgatgaaaagcctgggcgggggaagacggggcacaggggcccagggagaaaccctcggcgagaagtggaagcgccagctgaatcagctttccaaaagcgagttcaacatttacaagagatccggcatcatggaggttgaccggtctgaagcgaaagaggggctgaagagaggagagacaacccgccacgccgtcagccggggcacggctaaactcagatggttcgtggaacgcaatctggtgaagcctgaggggaaggtcattgatctgggatgtggcagaggcgggtggtcctattactgcgccgggctcaaaaaggttacagaagtgaaaggctataccaaagggggacccggccatgaggaacctatccccatggctacctacgggtggaaccttgtgaaactgcactctggaaaggacgtctttttcacacctccggagagatgtgataccctgctctgcgacattggcgagagctcccccaatcctacaatcgaagaggggcgcacgctgcgggtgcttaaaatggttgaaccctggctgagaggaaaccaattttgtattaagatcctcaatccttacatgccctctgtggtcgagaccctggagcagatgcagcgcaagcatggcggcatgctggtgcggaacccgctcagcagaaattccacacacgaaatgtattgggttagctgcgggaccggaaacatcgtgtctgccgtcaatatgacatcccgcatgctgcttaaccggttcaccatggcgcacagaaaacctacgtacgagcgcgatgtggacctgggcgccgggaccagacatgtggctgtcgaacccgaggttgccaacctcgatattatcggacagcggattgaaaatatcaagcacgagcataaaagcacatggcactatgacgaggataacccctacaagacctgggcttatcatggctcttacgaagtgaaaccttccgggagcgcctcttccatggtgaatggagtcgtgaagctgcttacaaagccctgggacgttattcctatggtgacccaaatcgctatgacagataccacgccgtttggccagcagcgcgtcttcaaagagaaggtggacacaagaacccccaaagccaagcggggcaccgcgcaaatcatggaagttacagccagatggctgtgggggtttctcagccggaacaaaaagcctcgcatttgtacgagagaggagttcacccggaaggtgcgctccaatgctgccatcggagctgtctttgtggacgagaaccagtggaatagcgccaaagaggccgttgaagatgagagattctgggacctggtgcagaaggaacgggagctgcacaaacagggcaagtgcgcgacatgcgtctataacatgatggggaaacgcgaaaagaagctcggagagtttggcaaagctaaggggtctagagccatttggtacatgtggctgggcgcccggttccttgagtttgaagctctgggattcatgaatgaggatcactggttcagccgcgaaaactccctctctggcgtggagggggagggactgcataaacttggctacatcctgagagacattagcaagatccccgggggaaatatgtatgccgatgacaccgctggctgggatacacggatcaccgaagacgatctccaaaacgaggccaaaattacagacatcatggaacctgagcacgcgctgctggccacctccatttttaagctcacgtaccagaataaagtcgtgcgcgttcagagacccgctaagaacgggaccgtgatggatgtcatctctcggcgcgaccagagaggcagcggacaagtgggcacatatgggctgaataccttcacaaacatggaagcccagcttattcggcagatggagtccgagggaatctttctgccgtctgaactcgagacccctaacctggctgaaagagtgcttgattggctggagaagcatggcgttgaacgcctcaaacggatggccatcagcggggacgactgtgtggtcaagcccattgatgacagattcgcgacggccctgacagctctgaatgatatgggaaaagtgcgcaaggacatccctcagtgggagccctccaaaggctggaacgattggcaacaggttcctttttgcagccaccacttccatcagctcattatgaaggacgggcgggagatcgtggtcccctgtagaaatcaggatgaactggtgggccgcgcccgggtctctcaaggagctggctggtcccttagagagaccgcctgcctgggaaagagctacgctcagatgtggcagctcatgtattttcaccgccgggacctgagacttgccgcgaacgccatttgttctgctgtgccggttgattgggtgcctacatcccgcaccacgtggagcatccatgcccaccatcaatggatgaccacagaagacatgctgtccgtctggaatcgggtgtggattgaggaaaacccctggatggaggataaaacccacgtttctagctggggagacgtgccctacctcggcaagagagaggaccagtggtgcgggtccctgatcggactgacagcccgggctacctgggccagcaatatccaggtcgcgattaaccaggtgagacgcctcatcggcaatgaaaactatctggattacatgacatctatgaaacggttcaagaatgagggggaccctgaaggcgctctttggtga

SEQ ID NO: 19219 - RNA, 9879 nt, synthetic construct
  misc_feature 1..9879: note = derived and/or modified CDS sequence (opt5) from DENV-1__GU131784__SS-prME
  source 1..9879: mol_type = other RNA
agcgtgaccatgctgctcatgctgatgcccaccgcccttgctttccacctgacgaccagaggcggggaacctcatatgatcgtctccaagcaggaacggggaaagtctctcctgtttaagacaagcgccggcgttaatatgtgcacccttattgcgatggacctgggggagttctgtgaagatacaatgacctacaaatgcccgagaatcacagaggctgaacccgacgatgtggactgttggtgcaatgccaccgatacgtgggtgacctatggaacatgttcccagaccggcgagcacagacgggacaagcgctctgttgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagaacaagacgctaactttgtgtgccggcgcacattcgtcgatagaggctggggcaatgggtgtggactgtttggcaaagggtctctcattacctgcgccaagttcaagtgcgtgacaaaactggagggaaagacggttcagtacgaaaaccttaaatattccgtgatcgtcaccgtgcacacaggcgaccagcatcaagttgggaatgagagcaccgaacacggaacaaccgctacgatcacaccccaggccccttctacagagattcagctgaccgactacggcgccctcacactggattgtagcccccggaccggcctggactttaacgaaatggtgctcctgacgatgaaggagaaaagctggcttgtccataagcagtggttcctggatctccctctgccctggacatccggggcttctaccagccaagagacatggaatcgcaaagaccttctggtgacctttaagaccgcgcacgccaagaaacaggaagtcgtggttctcggatcccaggagggcgctatgcacacagccctgacgggggccaccgaaatccaaacaagcggaaccacaaccattttcgctggccatctgaagtgcagactcaaaatggataagctgacgcttaaagggatgtcttatgtgatgtgtacaggctccttcaagctggagaaggaagtcgccgagacccagcacggaaccgtgctcgttcagatcaaatacgagggcacagacgcgccgtgcaagattccttttagcacccaggatgaaaaaggggtgacacaaaacggacggctgatcacggctaatcccatcgtcaccgacaaggagaaacctgtgaacattgaagccgagccgcccttcggcgagtcttatatcgtgattggggccggagaaaaggctctgaaacttagctggtttaaaaagggctcctctatcgggaaaatgttcgaggccacagctagaggcgcccgccggatggcgattctcggagataccgcctgggactttggcagcatcgggggagttttcacatccgtcggcaagctggtgcatcagatctttgggaccgcttacggagtgctgttcagcggcgtctcttggacgatgaaaattgggatcggcgtgctcctgacctggcttggactcaattccagaagcacatctctctccatgacctgtattgccgttggcctggtgacactgtaccttggggtcatggtgcaggctgatagcggatgcgttatcaactggaagggccgcgaactcaagtgtgggtccggaatttttgtgaccaatgaggtccacacatggaccgaacagtataaattccaagccgactctcctaagcggctgagcgcggccatcggcaaggcttgggaggagggggtgtgcggcattagatccgccacgcgcctggaaaacatcatgtggaagcagatctctaacgagctcaatcatattctgcttgaaaacgacatgaaatttacagttgtggtcggagatgtggctggcatcctggcccaggggaagaaaatgattcggccgcagcccatggagtacaagtatagctggaagtcctggggaaaagccaagatcattggcgctgacgtgcaaaataccaccttcatcatcgatgggcctaacacacccgaatgtcctgacgatcagagagcgtggaatatttgggaggtcgaggactacggatttggcatcttcaccacgaacatttggctcaaactgcgcgatagctatacacaggtttgcgaccaccggctgatgtctgccgctatcaaggattccaaagccgtgcacgccgacatgggctactggattgaaagcgagaagaatgaaacctggaaacttgctagagcctctttcatcgaggtgaaaacatgtatctggcccaagtcccataccctctggagcaacggggtcctggaatctgagatgattatcccgaaaatttatggaggccctatcagccagcacaattaccgccccgggtactttacacaaaccgcgggaccttggcatctgggcaagctcgagctggatttcgacctttgcgaagggacgaccgtggttgtggatgagcactgcggaaaccggggcccctccctgagaacaaccacagtcaccggcaaaattatccacgaatggtgttgccggagctgtacgctccctcccctgcgctttaagggggaggacggatgctggtatggcatggagatcagaccggtgaaggaaaaagaggaaaatctggttaagtctatggtgtccgctgggagcggagaggtcgactccttctctcttggcctcctgtgtattagcatcatgattgaagaggtgatgcggtccagatggtctcgcaaaatgctgatgacagggaccctcgccgtctttttcctgcttatcatgggacagctgacatggaacgatctcattcggctgtgcatcatggtgggcgccaatgctagcgacagaatgggcatggggaccacctacctggcccttatggcgacatttaagatgcgccctatgttcgctgtcggactgctctttagacggctgacgtcccgcgaggtgctcctgcttaccattggcctgtctctcgtggccagcgtcgaactgcccaactccctggaggaacttggggatggactggccatgggcatcatgatcctcaaactgctcacagacttccagagccatcaactgtgggctacccttctgtctctcacatttattaagaccacgttctccctgcaccatgcctggaagacaatggctatggttctgagcatcgtgtctctttttcccctgtgtctctccaccaccagccagaaaacaacctggctgcctgtgctcctggggtctcttggatgcaagccgctgacaatgttcctgattgccgagaataaaatctggggcagaaagtcctggcccctcaacgaaggcattatggcggtcgggatcgtgagcatcctgctttccagcctgctcaaaaacgatgttcctctggccggacccctcattgctggcgggatgctgatcgcctgttatgtgatttctggaagctccgctgacctttctctggagaaggccgccgaggtcagctgggaagaggaagctgagcactccggcgcgtctcataatatcctggtggaagttcaggatgacgggacgatgaaaattaaggatgaggagcgggacgataccctcacaatcctgcttaaggccaccctgctcgctgtgagcggagtctaccctctgtccatccccgccacactcttcgtgtggtatttttggcagaaaaagaaacaacgctctggcgtcctgtgggacaccccttcccctcccgaagtggagagagccgttcttgatgacggcatttaccggatcatgcagcgcgggctgctgggaagatcccaggtgggcgtcggggtgttccaggaaaacgtttttcacacgatgtggcacgtgacccggggagctgtcctcatgtatcaaggcaagcgcctggagcccagctgggcctctgtgaaaaaggaccttatttcctacgggggaggctggagactgcagggcagctggaatacaggggaggaagtgcaggttatcgcggtcgagcccggaaagaaccctaaaaatgtgcagaccgctcccggcacattcaagacctctgaaggggaggtgggagccattgccctcgattttaaaccgggcacatccgggagccctatcgtcaaccgggaaggaaagattgtgggcctgtacggcaatggggttgtgacgacctccggaacatatgtctctgctatcgcccaagcgaaagctagccaggagggccccctccctgagatcgaagacgaggtgttcagaaagcgcaacctgaccattatggatcttcatcccgggtccggaaagacccggagatacctgcccgccatcgttcgcgaagccattaaacggaagctgagaacactcatcctggctcctacgcgcgtggtcgccagcgagatggctgaagcccttaaaggcatgccgattcggtatcagaccacagcggtgaagtctgagcacaccgggaaagagatcgttgacctgatgtgccatgccacatttaccatgagactcctgtcccccgtgcgcgtccctaattacaacatgatcattatggatgaagctcacttcacggaccccagctctatcgccgctcggggctatattagcacaagagtgggaatgggcgaggccgccgctatctttatgaccgcgacccctcccgggtccgtggaagccttccctcaatctaatgctgtcattcaggatgaggaacgggacatcccggagcgcagctggaactccggatacgagtggatcacagattttcccggcaagaccgtttggttcgtgccttctattaagagcgggaatgacatcgccaactgtctgcgcaagaatggaaagcgggtgattcagctctcccgcaaaacattcgataccgaatatcagaagacgaaaaacaacgactgggactacgtcgtgacaaccgatatcagcgagatgggcgccaattttagagctgaccgggttattgatcccagacgctgccttaagcctgtgatcctgaaggacgggcccgaacgggtcattctggccggcccgatgcctgtgacagttgcgtctgctgcccaaagacgcggacggatcggcagaaaccataataaagagggggatcagtacatctatatgggacagcccctcaacaatgacgaggatcacgcccactggaccgaagctaagatgctgcttgacaacattaatacgcccgagggcatcattcctgccctgttcgaacccgagcgcgaaaaatccgcggccatcgatggggagtaccggctcagaggagaggctcgcaagacctttgtggaactgatgagacggggcgacctgcctgtctggctcagctataaagtggcctccgaggggttccagtactctgatcgcagatggtgctttgacggcgaacggaacaatcaagtccttgaggaaaacatggatgtggagatttggacaaaggagggagaacgcaaaaagctgagaccgcggtggctggacgctagaacctatagcgaccccctcgccctgcgcgagttcaaggaatttgctgccggccggagatccgtttctggggatcttatcctggagatcggaaaactccctcagcatctgacacagcgcgcgcagaatgccctggacaacctcgtgatgcttcacaatagcgaacaaggcgggcgggcttacagacatgccatggaggagctgcccgataccattgaaacactgatgctcctggctcttatcgccgtgctgaccggaggcgtcacgctgttctttctgtccggccgggggctgggaaagacaagcattggcctcctttgtgttatggcctcttccgtgctgctgtggatggctagcgtggagcctcactggatcgcggcctctattatcctcgagttctttctgatggtccttctgatccccgagccggaccgccagagaacccctcaggataaccagctcgcttatgtggttattgggctgctgttcatgatcctcaccgtggccgccaatgagatgggacttctggaaacaaccaaaaaggacctgggcattgggcacgctgccgtcgagaaccatcaccatgcggccatgctcgatgtggacctgcaccccgcttccgcctggacactttacgctgtcgccacgaccatcattacacctatgatgcggcataccatcgaaaacacaaccgcgaatattagcctgacggccatcgctaaccaagccgctatcctcatgggactggataaaggctggcccatttctaagatggacatcggcgtgcctctgctcgcccttgggtgctacagccaggttaatcccctgaccctgacagctgccgtgctcatgctggtcgcgcactatgccattatcggaccgggccttcaggctaaggccacccgcgaggctcagaagagaacagccgccgggattatgaagaaccctaccgtggatggaatcgttgcgatcgacctggatcccgtggtctacgacgctaaatttgaaaagcagctcggccagattatgctgctgatcctctgtacgtcccagattcttctgatgcggacaacctgggccctgtgcgagtctatcacactcgctaccgggcccctgaccacactttgggagggaagccctggcaaattctggaatacgaccattgccgtgtccatggccaacatcttccgcggcagctatctggctggggccggactcgcgttttccctgatgaagtctctgggcgggggaagacggggcacaggggcccaaggagaaaccctcggcgagaagtggaaacgccagcttaatcagctgagcaagtccgagttcaacacatacaaaagatctggcatcatggaggtggaccggagcgaagctaaggaggggctgaaaagaggagagaccacgaagcacgccgtttcccgcggcacagctaagctccggtggtttgtcgaaagaaatctggtgaaaccggaggggaaggtgattgatcttggatgtggccgcgggggatggtcttattactgcgccggcctgaaaaaggtcaccgaagttaaaggctataccaaagggggacccggccatgaggaacctatccccatggcgacatacgggtggaacctcgtgaaactgcacagcggaaaggacgtgttctttattcctcccgagaagtgtgataccctgctctgcgacatcggcgagtccagccctaatccgacaattgaagaggggcggacgcttagagtcctgaaaatggtggaaccctggctgcgcggaaaccagttctgtatcaagattctcaatccttacatgccctctgttgtggagaccctggagcaaatgcagcggaaacatggcggcatgcttgtcagaaaccctctgtcccgcaatagcacacacgaaatgtattgggtgtcttgcgggaccggaaacatcgtttccgccgtgaatatgacaagccggatgctcctgaacagatttaccatggctcaccgcaagcccacgtacgagcgggatgtcgacctgggcgccgggaccagacatgtggctgtggaaccggaggtcgccaacctcgatatcattggacagcgcatcgaaaatattaaacacgagcataagtctacatggcactatgacgaggataacccttacaagacctgggcttatcatggctcctacgaagttaaacccagcgggtccgccagctctatggtgaatggagtggtcaagctgcttacaaaaccctgggacgtgatccctatggttacccagattgcgatgacagataccacgcccttcggccaacagagagtgtttaaggagaaagtcgacacacggacccctaaggccaagcgcggcaccgctcagatcatggaagtgacagccaaatggctgtgggggttcctcagcagaaacaagaaaccgcggatctgtacgagagaggaatttacccggaaggttcgctccaatgctgccattggagccgtgttcgtcgacgagaaccaatggaactctgcgaaagaggctgtggaagatgagagattttgggacctggttcaccgggaacgcgagcttcacaagcagggcaagtgcgccacatgcgtgtataacatgatggggaaaagagaaaagaaactgggagagttcggcaaggccaaagggagccgggctatctggtacatgtggctcggcgcccgcttcctggagtttgaagctctgggattcatgaatgaggatcattggttttccagagaaaactctctcagcggcgtcgagggggagggactgcacaaacttggctacattctgcgggacatctccaaaattcccgggggaaatatgtatgccgatgacaccgcgggctgggatacacgcatcaccgaagacgatctccagaacgaggccaagatcacagacattatggaacctgagcatgctctgcttgccaagtctatcttcaaactgacctaccagaataaggtggtcagagtgcaacggcccgctaaaaacgggacggttatggatgtgattagccgcagagaccagcggggctccggacaggtcggcacctatgggctcaatacatttaccaacatggaagcccagctgatccgccaaatggagagcgagggaattttctctccttccgaactggagacacccaacctcgcgagacgggtgctggattggcttgaaaagcacggcgtggagagactgaaacgcatggccatcagcggggacgactgtgttgtgaagccgatcgatgaccggtttgctaccgccctcacggctctgaatgatatgggaaaggtcagaaaagacattcctcagtgggaaccctctaagggctggaacgattggcaacaggtgcctttctgctcccaccattttcaccaacttatcatgaaagacgggcgcgagattgttgtgccctgtcggaatcaggatgagctggtcggcagagcccgcgtgagccagggagctggctggtccctccgggaaacagcctgcctggggaagtcttacgcgcagatgtggcaactgatgtatttccatagacgcgacctccggctggccgctaacgccatctgtagcgccgtccctgtggattgggttcccacctccagaacaacctggagcattcacgctcatcaccagtggatgacgaccgaggacatgctttctgtgtggaatcgcgtctggatcgaagagaacccgtggatggaagataaaacacacatttccagctggggagacgtgccttacctgggcaagcgggaggaccagtggtgcgggtctctcatcggactgaccgccagagcgacatgggctaccaatatccaagttgccattaaccaggtgcggagacttatcggcaatgagaactatctggattacatgacaagcatgaagcgctttaaaaatgaatccgaccccgagggggccctctggtga

SEQ ID NO: 19220 - RNA, 9879 nt, synthetic construct
  misc_feature 1..9879: note = derived and/or modified CDS sequence (opt5) from DENV-1__JF937612__SS-prME
  source 1..9879: mol_type = other RNA
agcgtgaccatgctgctcatgctgatgcccacagctcttgctttccacctgacgacccggggcggggaacctcatatgatcgtctccaagcaggaacggggaaaatctctcctgtttaagaccagcgccggcgttaacatgtgcacccttatcgcgatggacctgggggaactctgtgaagatacaatgacctacaaatgcccccgcatcacagagaccgaacccgacgatgtggactgttggtgcaatgctacggatacctgggtgacatatggaacctgttcccaaacaggcgagcaccggcgggacaagcgctctgtcgccctggcccctcatgtggggctgggactcgagacccggacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaatgctacctttatcattgatgggcctaacacacccgaatgtcctgacgatcagagagcgtggaatatctgggaggtcgaggactacggattcggcatttttaccacgaacatctggctgaagctgcgcgattcctatacacaggtttgcgaccaccggcttatgagcgccgctattagagattctaaagccgtgcacgccgacatgggctactggatcgaatccgagaagaatgaaacctggaaactcgctcgcgccagcttcatcgaggtgaagacatgtatttggcccaagtctcataccctgtggtccaacggggtcctggaaagcgagatgatcattccgaaaatctatggaggccctatttctcaacacaattaccggcccgggtacttcacacaggcggctggaccttggcatctcggcaagctggagcttgattttgacctgtgcgaagggaccacggtggttgtggatgagcactgcggaaacagaggccccagcctccggaccacaaccgtcacaggcaaaatcatccacgaatggtgttgccgctcctgtaccctgcctcccctgagattcagaggggaagacggatgctggtatggcatggagattagaccggtgaaggaaaaagaggaaaatcttgttaagagcatggtgtctgccgggtccggagaggtcgacagcttttccctcggcctgctgtgtatctctattatgatcgaagaggtgatgcgcagccggtggtccagacgcatgctcatgacggggacactggccgttttctttcttctgattatgggacagctcacctggaacgatctgatcagactgtgcattatggtgggcgctaatgcctctgaccggatgggcatggggacaacctaccttgcgctgatggctaccttcaagatgcgccctatgtttgccgtcggactcctgttcagacggctcacaagccgcgaggtgctgcttctgacgatcggcctctccctggtggcctctgtcgaactgcccaacagccttgaggaactgggggatggactcgctatgggcatcatgattctgaaactcctgaccgactttcaatcccatcagctttgggccacactgctcagcctgaccttcatcaagacaaccttttctctgcactatgcttggaaaacgatggccatggttctttccattgtgagcctgttccccctctgtctgtctacaacctcccagaagaccacatggctccctgtgctgcttgggagcctgggatgcaaaccgctgaccatgtttctcatcgcggagaataagatttggggcagacggtcttggcccctgaacgaaggcatcatggccgtcgggatcgtgtccattcttctgagctccctcctgaagaacgatgttcctctcgctggacccctgatcgccggcgggatgcttattgcttgttacgtgatcagcggatctagcgccgacctgtccctggagaaagccgctgaggtctcttgggaagaggaagcggagcatagcggcgcctcccacaatattctcgtggaagttcaggatgacgggacaatgaagatcaaagatgaggagcgcgacgatacgctgaccatccttctgaaggctacactcctggccgtgtctggagtctatcctctcagcattcccgccaccctgttcgtgtggtacttctggcagaagaagaaacagagatccggcgtcctttgggacacaccttctcccccggaagtggagcgggctgttctggatgacggcatctatcgcattatgcagagagggctgctcggacggagccaggtgggcgtcggggtgtttcaagaaaacgttttccataccatgtggcacgtgacgagaggagccgtcctgatgtaccagggcaagcgccttgagccttcctgggcgagcgtgaagaaagacctgatctcttacgggggaggctggcggctccagggctcctggaataccggggaggaagtgcaggttattgctgtcgagcccggaaagaaccctaaaaatgtgcaaacagcccccggcacctttaagacaccggaaggggaggtgggagccatcgctctggatttcaaacctggcaccagcgggtctcccattgtcaacagagaaggaaagatcgtgggcctctatggcaatggggttgtgacaacgtccggaacctacgtcagcgccatcgcgcaggctaaggcctcccaggagggccctctgcccgagattgaagacgaggtgtttcgcaaacggaaccttacaatcatggatctgcaccccgggtctggaaagaccagacgctatctgcctgccattgttcgggaagctatcaaaagaaagctccgcaccctgattcttgccccgacacgggtggtcgctagcgagatggccgaagcgctgaaaggcatgcccatcagataccaaacgaccgccgtgaagtccgagcatacagggaaggagatcgttgacctcatgtgccacgctaccttcacaatgcggctgctgagccctgtgcgcgtccccaattataacatgattatcatggatgaagcccattttaccgacccttcttccattgctgccagaggctacatcagcacgcgggtgggaatgggcgaggccgctgcgattttcatgacagccacaccccctgggtctgtggaggcttttccgcagagcaatgccgtcatccaggatgaggaacgcgacatccccgagagatcctggaactctggatatgagtggattaccgatttccctggcaaaacagtttggtttgtgcccagcatcaagtccgggaatgacattgccaactgtctccggaaaaatggaaagagagtgatccagctttctcgcaaaaccttcgatacagaataccaaaagaccaagaacaacgactgggactacgtcgtgacgacagatattagcgagatgggcgctaatttccgggccgacagagttatcgatcctcgccggtgcctgaaacccgtgattctgaaggacgggccggaaagagtcatcctcgcgggccctatgcccgtgaccgttgcttccgccgcccagcgccggggaagaatcggccgcaaccacaataaagagggggatcagtatatttacatgggacagcccctgaacaatgacgaggatcatgctcactggacagaagccaagatgcttctggacaacatcaatacccctgagggcattatccccgcgctctttgaacctgagagagagaaaagcgccgctattgatggggagtatcggctgcgcggagaggccagaaagacgttcgtggaactgatgcggcgcggcgacctcccggtctggctttcttacaaggtggcttccgaggggtttcaatatagcgatagacggtggtgcttcgacggcgaaagaaacaatcaggtcctggaggaaaacatggatgtggagatctggaccaaagagggagaacgcaagaaactgcggcccagatggctcgacgcccgcacatactccgaccctctggcccttcgggagtttaaggagttcgccgcgggcagacggtctgttagcggggatctgatcctcgagattggaaaactgccccagcacctgacccagcgcgcccaaaatgctctcgacaaccttgtgatgctgcataattccgaacagggcgggagagcctatcggcacgctatggaggagctgcctgatacaatcgaaaccctcatgctgcttgccctgattgccgtgctcacaggaggcgtcaccctgtttttcctgtctggccgcgggctcggaaagacgagcatcggccttctgtgtgttatggcttccagcgtgctgctctggatggcgtctgtggagccccattggattgccgcttccatcatcctggaatttttccttatggtcctgctcattccggagcctgacagacagcggacaccccaggataaccaactggcctacgtggttatcgggctgctctttatgattcttaccgtggccgctaatgagatgggactgctggaaaccaccaaaaaggacctcggcatcgggcacgtcgccgtggagaaccaccatcacgcggccatgctggatgtcgaccttcatcctgctagcgcctggaccctgtacgctgtggccacaacgattatcacccccatgatgcgccacacaattgaaaacaccacagcgaatatctctctcaccgccatcgctaaccaggccgctattctgatgggactggataagggctggcctatctccaaaatggacattggcgttcccctccttgccctggggtgctatagccaggtgaatccgctgacgctcaccgctgccgtcctgatgcttgtggcgcattacgccatcattggacctggcctgcaagctaaggccacaagagaggctcagaaacggaccgccgccgggatcatgaagaaccccacagttgatggaatcgtggcgattgacctcgatcccgtcgtgtatgacgctaaattcgaaaagcagctgggccagatcatgctgctcattctttgtacctctcaaatcctgctgatgcgcacgacatgggccctctgcgagagcattaccctggctacagggcctcttaccaccctgtgggagggatccccgggcaagttttggaatacaacgatcgccgtgtctatggccaacatcttcagaggcagctacctcgctggggccggactggcgttctccctgatgaaaagcctcggcgggggacggagaggcaccggggcccagggagaaacacttggcgagaagtggaaacgccagctgaatcagctgtccaagtctgaatttaacacctataaacggagcggcattatggaggttgacagatccgaagctaaggaggggctcaagcgcggagagacaaccaaacacgccgtctctcggggcacggctaagctgagatggttcgtggaacgcaatcttgtgaaacccgaggggaaggtcatcgatctgggatgtggcagagggggatggagctactattgcgccggcctcaaaaaggttacagaagtgaagggctacaccaaagggggacctggccacgaggaacccattcctatggcgacctacgggtggaacctggtgaagctgcattccggaaaagacgtctttttcattccccctgagaagtgtgatacactcctttgcgacattggcgagtctagcccgaatcccaccatcgaagaggggagaacactgcgcgtgctgaaaatggttgaaccttggctccggggaaaccaattttgtattaagatcctgaatccctatatgccttccgtggtcgagacgcttgagcagatgcagagaaaacacggcggcatgctggtgcgcaaccccctcagcagaaattctacccatgaaatgtactgggtttcctgcgggacaggaaacatcgtgagcgccgtcaatatgacctctagaatgctgctgaaccgcttcacaatggctcacagaaagccgacctatgagcgggatgtggacctcggcgccgggacgcgccacgtggctgtcgaacctgaggttgccaacctggatattatcggacagagaattgaaaatatcaagcatgagcacaaatccacctggcattacgacgaggataacccctataagacatgggcttaccacggcagctatgaagtgaaaccctctgggtccgccagctccatggtgaatggagtcgtgaaacttctgaccaaaccttgggacgttattcccatggtgacacaaatcgcgatgaccgatacaaccccttttggccagcagcgggtcttcaaggagaaggtggacacgagaacaccgaaagccaagcggggcaccgctcaaatcatggaagttaccgccaaatggctctgggggtttctgagccgcaacaagaaacccagaatttgtacacgggaggagttcacgcgcaaggtgagatctaatgctgccatcggagccgtctttgtggacgagaaccagtggaatagcgcgaaggaggctgttgaagatgagcggttctgggaccttgtgcatcgcgaaagagagctgcacaaacagggcaagtgcgctacctgcgtctacaacatgatggggaaacgggaaaagaaactcggagagtttggcaaggccaaggggtcccgcgctatttggtacatgtggctgggcgccagattcctggagttcgaagctctcggatttatgaatgaggatcactggttctctcgggaaaacagcctgtccggcgtggagggggagggacttcataaactgggctatatcctccgcgacatttctaagatccctgggggaaatatgtacgccgatgacacagcgggctgggataccagaatcacagaagacgatctgcagaacgaggcccggattaccgacatcatggaacccgagcacgcccttctggccaaaagcatttttaagctcacatatcaaaataaagtcgtgcgcgttcagagacctgctaagaacgggaccgtgatggatgtcatctcccggagagaccagcgcggctctggacaggtgggcacgtacgggctgaataccttcacaaacatggaagcccaactgattcggcagatggagagcgagggaatcttttcccccagcgaactcgagaccccgaacctggcggaaagagtgcttgattggctggagaaatatggcgttgaacgcctcaagcggatggccatctctggggacgactgtgtggtcaagcctattgatgacagattcgctacagccctgaccgctcttaatgatatgggaaaagtgcgcaaggacatcccccagtgggagccttccaaaggctggaacgattggcagcaagttcccttttgcagccatcacttccaccagctgattatgaaggacgggcgggagatcgtggtcccttgtagaaatcaggatgaactcgtgggccgcgcccgggtctctcagggagctggctggtccctgagagagacggcctgcctggggaaaagctacgcgcaaatgtggcagctcatgtattttcatcgccgggacctgagacttgccgctaacgccatttgttccgccgtgcccgttgattggatcccgacatctcggaccacatggagcattcacgctcatcaccagtggatgaccacggaagacatgctgtccgtgtggaatagagtctggatcgaggaaaacccttggatggaggataagacccatatcagctcttggggagacgtgccctacctcggcaagcgcgaggaccaatggtgcgggtccctgattggacttacagcccgggcgacctgggctacaaatatccaggttgccattaaccaggtgagacgcctgatcggcaatgaaaactacctcgattatatgaccagcatgaaaagattcaagaatgagtctgaccccgaaggggccctgtggtga

SEQ ID NO: 19221 - RNA, 9879 nt, synthetic construct
  misc_feature 1..9879: note = derived and/or modified CDS sequence (opt5) from DENV-1__GU131786__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaagagcaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgttccccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccccccttcggcgagtcttatattgtgatcggggccggagaaaaagctctgaagcttagctggtttaagaaaggctcctctattgggaagatgttcgaggcccctgctagaggcgcccgccggatggcgatcctcggagccaccgcttgggattttggcagcatcgggggagttttcccgtccgtcggcaaactggtgcatcagatttttgggacagcctacggagtgctgttcagcggcgtctcttggaccatgaagatcgggattggcgtgctcctgacatggcttggactgaattccagaagcacctctctctccatgacgtgtatcgctgttggcctggtgaccctgtaccttggggtcatggtgcgcgccgacagcggatgcgttattaactggaaaggccgggaactcaagtgtgggtccggaatctttgtgacaaatgaggtccacacctggacagaacagtataagttccaagcggattctcccaaaagactgagcgccgctattggcaaggcctgggaggagggggtgtgcggcatccgctccgctacccggctggaaaacatcatgtggaaacagatttctaacgagctcaatcatatcctgcttgaaaacgacatgaagctgacagttgtggtcggagacgtggccggcattctcgcccaggggaaaaagatgatcagacctcagcccatggagtacaaatatagctggaagtcctggggaaaggctaaaattatcggcgcggatgtgcaaaataccacgtttatcattgacgggcctaacacacccgaatgtccggatgaccagcgcgcctggaatatctgggaggtcgaggattacggattcggcatttttaccaccaacatctggctgaagctgcgggacagctatacacaggtttgcgatcacagacttatgtctgctgccattaaagactccaaggccgtgcacgctgatatgggctactggatcgaaagcgagaaaaatgaaacctggaagctcgcccgcgcgtctttcatcgaggtgaagacgtgtatttggcctaaatcccatacactgtggagcaacggggtcctggaatctgagatgatcattcccaagatctatggaggccctattagccagcacaattaccggcccgggtacttcacccaaacagctggaccttggcatctcggcaaactggagcttgactttgatctgtgcgaagggaccacagtggttgtggacgagcactgcggaaacagaggcccctccctccggaccacgaccgtcacaggcaagatcatccacgaatggtgttgccgcagctgtaccctgccgcctctgagattcaaaggggaggatggatgctggtatggcatggagattcggcccgtgaaggaaaaggaggaaaatcttgttaaatctatggtgtccgccgggagcggagaggtcgactccttttctctcggcctgctgtgtatcagcattatgatcgaagaggtgatgagatcccgctggtctcggaagatgctcatgacagggaccctggccgttttctttcttctgattatgggacagctcacgtggaacgacctgatcagactgtgcattatggtgggcgctaatgccagcgatcgcatgggcatggggacaacctaccttgcgctgatggctacattcaaaatgagacccatgtttgccgtcggactcctgttccggcgcctcacctccagagaggtgctgcttctgaccatcggcctctctctggtggccagcgtcgaactgcctaactcccttgaggaactgggggacggactcgctatgggcatcatgattctgaagctcctgacagattttcagagccatcaactttgggccacgctgctctctctgaccttcatccggacaaccttttccctgcactatgcttggaaaacaatggccatggttcttagcattgtgtctctgttcccgctctgtctgtccaccacgagccagaagacaacctggctccccgtgctgcttgggtctctgggatgcaagcctctgaccatgtttctcatcgcggagaataaaatttggggccgcaagtcctggcccctgaacgaaggcatcatggccgtcgggatcgtgagcattcttctgtccagcctcctgaaaaacgacgttcctctcgctggacccctgatcgccggcgggatgcttattgcttgttacgtgatctctggaagctccgccgatctgtctctggagaaggccgctgtcgtgagctgggaggaagaggcggaacattccggcgcctctcacaatattctcgttgaggtgcaggacgatgggacaatgaaaatcaaggacgaagagagagatgacaccctgacaatccttctgaaagctacgctcctggccgtcagcggagtgtatcctctctccattcccgccaccctgttcgtctggtacttctggcagaagaagaaacaacggtctggcgtgctttgggatacaccgagccctcccgaggttgaacgcgctgtgctggacgatggcatctatagaattatgcagcgggggctgctcggacgctcccaggtcggcgtgggggtttttcaggagaacgtgttccataccatgtggcacgtcacaagaggagccgtgctgatgtaccaaggcaagcggcttgaacctagctgggcgtctgtgaaaaaggacctgatctcctacgggggaggctggagactccagggcagctggaataccggggaggaggttcaggtcattgctgtggaacccggaaaaaacccgaagaatgtgcagacggcccctggcacctttaagacatctgagggggaagtcggagccatcgctctggacttcaaacccggcacctccgggagccctattgtgaaccgcgagggaaagatcgttggcctctatggcaatggggtggtcacaacctccggaacatacgtgtctgccatcgcgcaagctaaagccagccaggaaggccccctgcccgagattgaggatgaagtttttcggaagagaaaccttacgatcatggacctgcaccctgggtccggaaaaacccgccggtatctgccggccattgtgagagaggctatcaagcgcaagctccggacactgattcttgcccccaccagagtcgtggctagcgaaatggccgaggcgctgaaaggcatgcctatccgctaccagaccacagccgttaagtctgaacatacggggaaagagatcgtggatctcatgtgccacgctaccttcacaatgcggctgctgtcccccgtcagagtgcctaattataacatgattatcatggacgaggcccattttaccgatcccagctctattgctgcccggggctacatcagcacacgcgtgggaatgggcgaagccgctgcgattttcatgaccgccacgcctccggggtccgtcgaggcttttccccaatctaatgccgttatccaggacgaagagagagatatccctgaacggagctggaactccggatatgagtggattacagacttccccggcaagaccgtgtggtttgtgccttctatcaaaagcgggaatgatattgccaactgtctccgcaagaatggaaagagagtcatccagctttcccggaaaaccttcgacacagagtaccagaagaccaaaaacaacgattgggactacgtggttacaaccgacattagcgaaatgggcgctaatttcagagccgatcgcgtgatcgacccccggagatgcctgaagccggtcattctgaaagatgggcctgagcgcgtgatcctcgcgggccccatgcccgttacggtggcttctgccgcccaacggagaggacgcatcggccggaaccacaataaggaaggggaccagtatatttacatgggacagcctctgaacaatgatgaggaccatgctcactggacagaggccaagatgcttctggataacatcaatacccccgaaggcattatccctgcgctctttgagccggaaagagagaaatccgccgctattgacggggaatatcgcctgagaggagaggcccggaagacattcgtcgagctgatgcgcagaggcgatctccccgtgtggcttagctacaaagtcgcttccgaagggtttcagtattctgaccggcgctggtgcttcgatggcgagagaaacaatcaagtgctggaagagaacatggacgttgaaatctggaccaaggagggagagcggaaaaagctgagacctcgctggctcgatgcccggacgtacagcgaccccctggctcttagagaatttaaagagttcgccgcgggccgccggtccgtgtctggggacctgatcctcgaaattggaaagctgcctcagcacctgacccagagagcccagaatgctctcgataaccttgtgatgctgcataatagcgagcaaggcgggcgggcctatcgccacgctatggaagagctgcccgacacaatcgagaccctcatgctgcttgccctgattgccgtcctcacaggaggcgttaccctgtttttcctgtccggcagagggctcggaaagacaagcatcggccttctgtgtgtgatggcttcttccgtgctgctctggatggcgagcgtcgaaccgcattggattgccgcttctatcatcctggagtttttccttatggtgctgctcattcctgaacccgatcggcagcgcacccctcaggacaaccagctggcctacgttgtgatcgggctgctctttatgattcttacggtcgccgctaatgagatgggactgctggagacaaccaaaaaggatctcggcatcgggcacgtggccgtcgaaaaccaccatcacgcggccatgctggacgtggatcttcatcccgcttccgcctggaccctgtacgctgttgccacaaccattatcacacctatgatgagacacacgattgagaacaccacagcgaatatcagcctcaccgccatcgctaaccaagccgctattctgatgggactggacaaaggctggcccatctctaagatggatattggcgtgccgctccttgccctggggtgctatagccaggtcaatcctctgacactcaccgctgccgtgctgatgcttgttgcgcattacgccatcattggacccggcctgcaggctaaagccacgcgggaagctcaaaagcgcaccgccgccgggatcatgaagaaccccacagtggacggaatcgtcgcgattgatctcgaccctgtggtgtatgatgctaaattcgagaagcagctgggccagatcatgctgctcattctttgtacctcccagatcctgctgatgagaacaacctgggccctctgcgaatctattacgctggctacagggccgcttaccacactgtgggagggaagccccggcaaattttggaataccaccatcgccgtttccatggccaacatcttccggggcagctacctcgctggggccggactggcgttctccctgatgaagtctctcggcgggggacgcagaggcacaggggcccaaggagagacgcttggcgaaaaatggaagcggcagctgaatcagctgagcaagtccgagtttaacacctataaaagatctggcattatggaagtcgaccgcagcgaggctaaggaagggctcaaacggggagagacaaccaagcacgccgtgtccagaggcacagctaaactgcgctggttcgtggagcggaatcttgtcaagcctgaagggaaggttatcgacctgggatgtggcagagggggatggtcttactattgcgccggcctcaaaaaggtgaccgaggtgaaaggctacacgaaggggggacccggccacgaagagcctattcccatggcgacatacgggtggaacctggtcaaactgcatagcggaaaggatgtgtttttcatccctccggaaaaatgtgacaccctcctttgcgatattggcgagtccagccccaatcctaccatcgaggaagggcgcacactgcgggttctgaagatggtggagccctggctcagaggaaaccagttttgtattaagatcctgaatccttatatgccctctgtcgtggaaacccttgagcaaatgcagcgcaaacacggcggcatgctggttcggaacccgctctccagaaatagcacacatgagatgtactgggtgtcttgcgggacgggaaacatcgtctccgccgtgaatatgaccagccgcatgctgctgaaccggttcacaatggctcacagaaagcctacctatgaacgcgacgtggatctcggcgccgggacaagacacgtcgctgttgagcccgaagtggccaacctggacattatcggacagcggattgagaatatcaaacatgaacacaagtctacctggcattacgatgaggacaacccctataaaacgtgggcttaccacggctcctatgaggtgaagcctagcgggtccgccagctctatggtcaatggagtggttaagcttctgaccaaaccctgggatgtgattcctatggtcacacagatcgcgatgaccgacacaaccccgtttggccaacagcgcgtgttcaaggaaaaagttgatacaagaacccccaaggccaaacggggcacggctcagatcatggaggtgacagccaagtggctctgggggtttctgagcagaaacaagaaacctcggatttgtacccgcgaagagttcaccagaaaggtccggtccaatgctgccatcggagccgtgtttgttgacgaaaaccaatggaattctgcgaaagaggctgtggaggacgaacgcttctgggatcttgtccatagagagcgggaactgcacaagcagggcaaatgcgccacatgcgtgtacaacatgatggggaagcgcgagaagaaactcggagaatttggcaaggccaaagggagcagagctatttggtacatgtggctgggcgcccggttcctggagttcgaggctctcggatttatgaatgaagaccactggttctcccgcgagaactctctgagcggcgtcgaaggggagggacttcataagctgggctatatcctcagagatatttccaaaatccccgggggaaatatgtacgccgacgatacggcgggctgggacacccggatcacagaggatgacctgcagaacgaagccaagattaccgatatcatggagcctgaacacgctcttctggccaaatctatttttaagctcacatatcagaataaggtggttcgcgtgcaaagacccgctaaaaacgggaccgtcatggacgtgatcagccggcgcgatcagagaggctccggacaggtgggcacatacgggctgaataccttcacgaacatggaggcccagctgattcggcaaatggaaagcgagggaatcttttctccgtccgagctcgaaacccctaacctggcgggcagagttcttgactggctggagaagcatggggtggaacgcctcaaacggatggccatcagcggagatgactgtgtcgtgaagcccattgacgatagattcgctacagccctgaccgctcttaatgacatgggcaaagttcgcaaggatatccctcagtgggagccctctaaggggtggaacgactggcagcaggtgcctttttgctcccaccacttccatcaactgattatgaaagatggccgggaaatcgtcgtgccctgtagaaatcaggacgagctcgtcggacgcgcccgggtgagccagggcgctgggtggtccctgagagagacagcctgcctgggaaagtcttatgcgcagatgtggcaactcatgtactttcaccgccgggatctgagacttgccgctaacgccatttgtagcgccgttccggtggactgggtccctacctcccgcacgacatggagcatccatgctcaccatcagtggatgaccacagaagatatgctgtctgtgtggaatcgggtttggattgaggaaaacccctggatggaggacaaaacccacatctccagctggggcgatgtgccctatctcgggaagagagaagaccagtggtgcggatctctgatcggccttacggcccgggcgacctgggctacaaatattcaagtcgccatcaaccaggtgagacgcctgctcgggaatgagaactacctggactacatgaccagcatgaaacggttcaagaatgagtccgatcctgaaggcgccctgtggtga

SEQ ID NO: 19222 - RNA, 9879 nt, synthetic construct
  misc_feature 1..9879: note = derived and/or modified CDS sequence (opt5) from DENV-1__GU131787__SS-prME
  source 1..9879: mol_type = other RNA
agcgtgaccatgctgctcatgctgatgcccacagcccttgctttccacctgacgaccagaggaggggaacctcatatgatcgtctccaagcaggaacggggaaaatctctcctgtttaagacaagcgccggagttaacatgtgcacccttatcgcgatggacctgggggagctctgtgaagatacaatgacctacaaatgcccccgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacggaatgaagttcaccgttgtggtcggcgacgtggccgggattctcgctcagggcaagaagatgatccggccgcaacccatggagtacaaatattcttggaaaagctggggcaaggccaagattatcggggccgatgtgcagaataccacatttatcattgacggacctaacacccccgaatgtcctgatgaccagagagcttggaatatctgggaggtcgaggattacggcttcggcatttttacgacaaacatctggctgaagctgcgcgactcctatacccaggtttgcgatcaccggcttatgagcgcggccattaaagactctaaggctgtgcacgccgatatggggtactggatcgaatccgagaaaaatgaaacatggaagctcgccagagctagcttcatcgaggtgaagacctgtatttggcccaaatctcatacactgtggtccaacggagtcctggaaagcgagatgatcattccgaagatctatggcgggcctatttctcaacacaattaccgccccggatacttcacccagacggccggcccttggcatctcgggaaactggagcttgactttgatctgtgcgaaggaaccacagtggttgtggacgagcactgcggcaaccggggccccagcctcagaaccacaaccgtcacggggaagatcatccacgaatggtgttgccggtcctgtacactgcctcccctgcgcttcagaggagaggatggctgctggtatgggatggagattcggccggtgaaagaaaaggaggaaaatcttgttaagagcatggtgtctgcgggatccggcgaggtcgacagcttttccctcgggctgctgtgtatctctattatgatcgaagaggtgatgagaagccgctggtcccggaaaatgctcatgaccggaacactggctgttttctttcttctgattatgggccagctcacctggaacgacctgatcagactgtgcattatggtgggcgccaatgcctctgatcgcatggggatgggaaccacataccttgctctgatggccacgttcaagatgagacctatgtttgcggtcggcctcctgttccggcgcctcaccagcagagaggtgctgcttctgacaatcgggctctccctggtggcttctgtcgaactgcccaacagccttgaggaactgggagacggcctcgccatggggatcatgattctgaaactcctgaccgattttcaatcccatcagctttgggccacactgctcagcctgaccttcatcaagacgacattttctctgcactatgcttggaaaaccatggccatggttctttccattgtgagcctgttccccctctgtctgtctaccacatcccagaagaccacatggctccctgtgctgcttggaagcctgggctgcaagccgctgacgatgtttctcatcgctgagaataaaatttggggccggcgctcttggcccctgaacgaagggatcatggccgtcggaatcgtgtccattcttctgagctccctcctgaagaacgacgttcctctcgcgggccccctgatcgccgggggaatgcttattgcttgttacgtgatcagcggctctagcgccgatctgtccctggagaaagctgccgaggtctcttgggaagaggaagccgagcatagcggggcttcccacaatattctcgtggaagttcaggacgatggaaccatgaagatcaaagacgaggagagagatgacacactgaccatccttctgaaggcgacactcctggccgtgtctggcgtctatcctctcagcattcccgctaccctgttcgtgtggtacttctggcagaaaaagaagcagcggtccggcgtcctttgggatacgccttctcccccggaagtggagcgcgccgttctggacgatgggatctatagaattatgcagcggggactgctcggccgcagccaggtgggggtcggagtgtttcaagaaaacgttttccataccatgtggcacgtgacaagaggcgccgtcctgatgtaccaggggaaacggcttgagccttcctgggctagcgtgaagaaagacctgatctcttacggaggcggctggagactccaggggtcctggaataccggagaggaagtgcaggttattgccgtcgagcccggcaagaaccctaaaaatgtgcaaacagcgcccgggacctttaagacaccggaaggagaggtgggcgctatcgccctggacttcaagcctgggacgagcggatctcccattgtcaaccgcgaaggcaaaatcgtgggcctctatgggaatggagttgtgaccacatccggcacctacgtcagcgccatcgctcaggccaaggcgtcccaggaggggcctctgcccgagattgaagatgaggtgtttcggaaaagaaaccttaccatcatggacctgcaccccggatctggcaagacacgccggtatctgcctgctattgttagagaagccatcaaacgcaagctccggacgctgattcttgccccgaccagagtggtcgctagcgagatggccgaagctctgaaggggatgcccatccgctaccaaacaaccgccgtgaaatccgagcatacaggcaaggagatcgttgatctcatgtgccacgcgaccttcacgatgcggctgctgagccctgtgagagtccccaattataacatgattatcatggacgaagcccattttacagatccttcttccattgctgcccggggatacatcagcacccgcgtgggcatgggggaggctgccgccattttcatgaccgctacaccccctggatctgtggaagcgtttccgcagagcaatgccgtcatccaggacgaggaaagagatatccccgagcggtcctggaactctggctatgagtggattaccgacttccctgggaaaacagtttggtttgtgcccagcatcaagtccggaaatgatattgctaactgtctccgcaaaaatggcaagagagtgatccagctttctcggaagaccttcgacacggaataccagaaaaccaagaacaacgattgggactacgtcgtgaccacagacattagcgagatgggggccaatttcagagccgatcgcgttatcgaccctcggagatgcctgaaacccgtgattctgaaggatggcccggaacgcgtcatcctcgctggacctatgcccgtgaccgttgcctccgcggctcagcggagaggccgcatcgggcggaaccacaataaagagggagaccagtatatttacatgggccagcccctgaacaatgatgaggaccatgcccactggacggaagccaagatgcttctggataacatcaatacccctgaggggattatccccgctctctttgaacctgagagagaaaagagcgccgcgattgacggagagtatcgcctgagaggcgaggcccggaaaacattcgtggaactgatgcgcagaggggatctcccggtctggctttcttacaaggtggcttccgagggctttcaatatagcgaccggcgctggtgcttcgatggagaaagaaacaatcaggtcctggaggaaaacatggacgtggagatctggaccaaagagggcgaacggaagaaactgagaccccgctggctcgatgcccggacatactccgaccctctggctcttagagagtttaaggagttcgccgctgggcgccggtctgttagcggagacctgatcctcgagattggcaaactgccccagcacctgacccagagagcccaaaatgcgctcgataaccttgtgatgctgcataattccgaacaagggggacgggcctatcgccacgctatggaggagctgcctgacacaatcgaaaccctcatgctgcttgccctgattgctgtgctcacgggcggcgtcacactgtttttcctgtctgggagaggactcggcaagaccagcatcgggcttctgtgtgttatggcctccagcgtgctgctctggatggcctctgtggagccccattggattgctgcgtccatcatcctggaatttttccttatggtcctgctcattccggagcctgatcggcagcgcacaccccaggacaaccaactggcctacgtggttatcggactgctctttatgattcttacagtggctgccaatgagatgggcctgctggaaaccacaaagaaagatctcgggatcggacacgtcgccgtggagaaccaccatcacgctgccatgctggacgtcgatcttcatcctgcgagcgcctggacgctgtacgctgtggccaccacaattatcacccccatgatgagacacacaattgaaaacaccacggctaatatctctctcaccgccatcgcgaaccaggccgctattctgatgggcctggacaagggctggcctatctccaaaatggatattggggttcccctccttgccctgggatgctatagccaggtgaatccgctgacactcaccgctgccgtcctgatgcttgtggctcattacgccatcattggccctgggctgcaagcgaaggccacacgggaggctcagaaacgcaccgccgctggaatcatgaagaaccccacggttgacggcatcgtggccattgatctcgaccccgtcgtgtatgatgccaagttcgaaaaacagctggggcagatcatgctgctcattctttgtacatctcaaatcctgctgatgagaaccacatgggcgctctgcgagagcattaccctggctaccggacctcttacaacgctgtgggagggctccccgggcaagttttggaataccacaatcgccgtgtctatggctaacatcttccgggggagctacctcgccggagccggcctggctttctccctgatgaaaagcctcgggggaggccgcagagggaccggagcccagggcgaaacacttggcgagaagtggaaacggcagctgaatcagctgtccaagtctgaatttaacacctataagagaagcgggattatggaggttgaccgctccgaagcgaaagagggactcaagcggggcgagacgacaaaacacgccgtctctagagggaccgctaagctgcgctggttcgtggaacggaatcttgtgaaacccgagggaaaggtcatcgacctgggctgtgggagaggaggctggagctactattgcgccggcctcaagaaagttaccgaagtgaaggggtacacaaaaggaggccctgggcacgaggaacccattcctatggctacctacggatggaacctggtgaagctgcattccggcaaagatgtctttttcattccccctgagaagtgtgacacactcctttgcgatattggggagtctagcccgaatcccacgatcgaagagggacgcaccctgcgggtgctgaaaatggttgaaccttggctcagaggcaaccaattttgtattaagatcctgaatccctatatgccttccgtggtcgagacacttgagcagatgcagcgcaagcacggcgggatgctggtgcggaaccccctcagcagaaattctacccatgaaatgtactgggtttcctgcggaacaggcaacatcgtgagcgccgtcaatatgacctctcgcatgctgctgaaccggttcacgatggcgcacagaaaaccgacctatgagcgcgacgtggatctcggggccggaacaagacacgtggctgtcgaacctgaggttgccaacctggacattatcggccagcggattgaaaatatcaagcatgagcacaaatccacctggcattacgatgaggacaacccctataagacatgggcttaccacgggagctatgaagtgaaaccctctggatccgccagctccatggtgaatggcgtcgtgaaacttctgaccaagccttgggatgttattcccatggtgacacaaatcgctatgaccgacacgacaccttttggccagcagcgcgtcttcaaagagaaggtggataccagaaccccgaaagccaagcgggggacagcgcaaatcatggaagttacggccaaatggctctggggatttctgagcagaaacaagaagccccggatttgtacccgcgaggagttcacaagaaaagtgcggtctaatgctgccatcggcgctgtctttgtggacgagaaccagtggaatagcgccaaggaggccgttgaagacgagcgcttctgggatcttgtgcatagagaacgggagctgcacaaacaggggaagtgcgcgacctgcgtctacaacatgatgggaaaacgcgaaaagaagctcggcgagtttgggaaagctaagggctccagagccatttggtacatgtggctgggagcccggttcctggagttcgaagctctcggctttatgaatgaggaccactggttctctcgcgaaaacagcctgtccggggtggagggagagggccttcataaactggggtatatcctcagagatatttctaagatccctggaggcaatatgtacgccgacgatacagctgggtgggacacccggatcacagaagatgacctgcagaacgaggcccgcattaccgatatcatggaacccgagcacgcgcttctggccagaagcatttttaaactcacgtatcaaaataaggtcgtgcgggttcagcgccctgctaaaaacggcaccgtgatggacgtcatctccagacgggatcagagaggatctggccaggtggggacatacggactgaataccttcacaaacatggaagcccaactgattcgccagatggagagcgagggcatcttttcccccagcgaactcgagaccccgaacctggctgaacgggtgcttgactggctggagaagtatggggttgaaagactcaagcgcatggccatctctggagatgactgtgtggtcaaacctattgacgatcggttcgcgacggccctgacagctcttaatgacatgggcaaggtgagaaaagatatcccccagtgggagccttccaaggggtggaacgactggcagcaagttcccttttgcagccatcacttccaccagctgattatgaaagatggccgcgagatcgtggtcccttgtcggaatcaggacgaactcgtgggcagagcccgcgtctctcagggcgctgggtggtccctgcgggagaccgcctgcctgggaaagagctacgctcaaatgtggcagctcatgtattttcatagacgcgatctgcggcttgccgcgaacgccatttgttccgctgtgcccgttgactggatcccgacatctagaaccacgtggagcattcacgcccatcaccagtggatgaccacagaagatatgctgtccgtgtggaatcgggtctggatcgaggaaaacccttggatggaggacaagacccatatcagctcttggggcgatgtgccctacctcgggaaaagagaggaccaatggtgcggatccctgattggccttacagcccgcgctacctgggccacaaatatccaggttgcgattaaccaggtgcggagactgatcgggaatgaaaactacctcgactatatgaccagcatgaagcgcttcaaaaatgagtctgatcccgaaggcgctctgtggtga

SEQ ID NO: 19223 - RNA, 9879 nt, synthetic construct
  misc_feature 1..9879: note = derived and/or modified CDS sequence (opt5) from DENV-1__HM181968__SS-prME
  source 1..9879: mol_type = other RNA
agcgtgaccatgctgctcatgctgatgcccaccgcccttgctttccacctgacgacccggggcggggaacctcatatgatcgtgaccaagcaggaacggggaaagtccctcctgtttaagacctctgccggcgttaacatgtgcacccttattgcgatggacctgggggaactctgtgaagataccatgacatacaaatgcccccgcatcaccgaggctgaacccgacgatgtggactgttggtgcaatgccacggatacctgggtgacctatggaacctgtagccaaacaggcgagcaccggcgggacaagcgctccgtcgccctggctcctcatgtggggctgggactcgagaccagaacggaaacatggatgtctagcgagggcgcctggaaacagattcagcgggttgaaacctgggctctgcgccaccccggcttcacagtgatcgccctttttctggcgcatgccattgggacctccatcacccagaagggaatcattttcatcctcctgatgcttgtcacaccttctatggctatgagatgcgtgggcattgggagccgggattttgttgagggactgtccggcgccacgtgggtggacgtcgtgctcgagcacgggagctgtgtgaccacaatggctaaggataaacccaccctggacatcgaactgctcaagacagaggtcaccaaccctgccgttctgcgcaaactttgcattgaagcgaagatctctaatacgacaaccgattccagatgtccgacccaaggagaggccacactgatggaagaacaagacgctaacttcgtgtgccggcgcacctttgtggatagaggctggggcaatgggtgtggactcttcggcaaagggagcctgattacatgcgccaagtttaagtgcgtcacgaaacttgagggaaagatcgtgcagtacgaaaacctgaaatattctgttatcgtgaccgtccacacaggcgaccagcatcaagtggggaatgagtccaccgaacacggaacaaccgctacgattacaccccaggcccctacaagcgagatccagctcaccgactacggcgccctgacactggattgttctccccggaccggcctcgacttcaacgaaatggttctgcttacgatgaaggagaaatcctggctggtgcataagcagtggtttctcgatctgcctcttccctggacaagcggggcttccacctctcaagagacatggaatcgccaggacctgctcgtcaccttcaaaaccgcgcacgccaagaagcaggaagtggtcgtgctgggaagccaagagggcgctatgcacacagccctgacgggggccaccgaaattcagacatccggaaccacaaccatctttgctggccatctcaaatgcagactgaagatggataaacttacgctgaaggggatgagctatgttatgtgtacaggctctttcaaactcgagaaggaagtggccgagacccagcacggaaccgtcctggtgcagattaagtacgagggcacagacgcgccgtgcaaaatccctttctccacccaagatgaaaagggggctacacagaacggacggctgatcacggccaatcccattgttaccgacaaagagaagcctgtgaacatcgaagccgagccgccctttggcgagagctatattgtcatcggggctggagaaaaagcccttaagctctcttggttcaagaaaggcagctccattgggaagatgtttgaggctacagccagaggcgcgcgccggatggccatcctgggagataccgcttgggacttcggctctgtcgggggagtgtttacaagcgttggcaaactggtccatcagatcttcgggaccgcctacggagtgctcttttccggcgtgagctggacgatgaagattgggatcggcgtcctgcttacctggctgggactcaattctagatccacaagcctgtctatgacctgtattgctgtgggcctggttacactttacctcggggtgatggtccaggccgattccggatgcgtgatcaactggaaaggccgcgaactgaagtgtgggagcggaattttcgttaccaatgaggtgcacacatggaccgaacaatataagtttcaggcggactcccctaaacggctgtctgccgctatcggcaaggcctgggaggagggggtctgcggcattagaagcgctacgcgcctcgaaaacatcatgtggaaacagatctccaacgagctgaatcatattcttctggaaaacgacatgaagttcacagtggttgtgggagatgtcgtgggcatcctcgcccaggggaaaaagatgattcggccgcaacccatggagcacaaatactcttggaaaagctggggaaaggccaagatcattggcgctgacgtgcagaataccacctttatcatcgatgggcctaacacacccgaatgtcctgacgatcagagagcgtggaatatttgggaggtcgaggactatggattcggcatctttgccaccaacatttggctgaagctgcgcgattcctacacgcaggtttgcgaccaccggcttatgagcgctgccatcaaagattctaaggccgtgcatgctgacatgggctattggattgaatccgagaaaaatgaaacatggaagctcgccagagcgagcttcatcgaggtgaagacctgtatctggcccaaatctcacacactgtggtccaacggggtcctggaaagcgagatgattatcccgaagatttacggaggccctatctctcaacataattatcgccccgggtacttcacccagacagctggaccttggcacctcggcaaactggagcttgattttgacctgtgcgaagggaccacggtggttgtggatgagcactgcggaaaccggggccccagcctcagaaccacaaccgtcacaggcaagattatccatgaatggtgttgccggtcctgtaccctgcctcccctgcgcttcaaaggggaggacggatgctggtacggcatggagatcagaccggtgaaggaaaaggaggaaaatcttgttaaaagcatggtgtctgccgggtccggagaggtcgacagcttttccctcggcctgctgtgtatttctatcatgattgaagaggtgatgcggagcagatggtcccgcaagatgctcatgacggggacactggccgttttccttctgctcatcatgggacagctgacctggaacgatctgattcggctttgcatcatggtgggcgctaatgcctctgacagaatgggcatggggacaacctatctggcgctcatggctacctttaaaatgcgccctatgttcgccgtcggactgctcctgagacggcttacaagccgcgaggtgctgctcctgacgattggcctgtcccttgtggcctctgtcgaactgcccaacagcctcgaggaactgggggatggactcgctatgggcatcatgatcctgaaacttctgaccgactttcaatcccaccagctctgggccacactgctgagccttaccttcattaaaacaaccctgtctctccattacgcttggaagacgatggccatggttctgtccatcgtgagcctctttcccctgtgtctttctacaacctcccagaagaccacatggctgcctgtgctgctcgggagcttcggatgcaaaccgctgaccatgtttcttattacagagaataagatctggggcagaaaatcttggcccctgaacgaaggcattatggcggtcggggtggtttccatcctcctgagctccctcctgaagaacgatgtgcctcttgccggacccctgatcgctggcgggatgctgattgcctgttatgtcatcagcggatctagcgctgacctctccctggagaaagccgccgaggtgtcttgggaagaggaagctgagcacagcggcgcgtcccataatattcttgttgaagtgcaggatgacgggacgatgaagatcaaagatgaggagcgggacgataccctgacaattctcctgaaggccaccctcctggctgtctctggagtgtaccctcttagcatccccgccacactgttcgtctggtatttttggcaaaagaaaaagcagcgctccggcgtgctgtgggacaccccttctcccccggaagttgagagagccgtgctcgatgacggcatctaccggattatgcagcgcgggctgcttggaagaagccaggtcggcgtgggggttttccaagaaaacgtgttccacacgatgtggcacgtcacccggggagctgtgctgatgtatcagggcaaacgcctcgagccttcctgggccagcgtgaagaaagacctgatctcttacgggggaggctggagactccagggctcctggaatacaggggaggaagttcaggtcattgcggtggagcccggaaagaaccctaagaatgtgcaaaccgctcccggcacatttaaaaccccggaaggggaggtcggagccatcgccctggatttcaagcctggcacaagcgggtctcccattgtgaaccgggaaggaaaaatcgttggcctttacggcaatggggtggtcacgacctccggaacatatgtgagcgctattgcccaggcgaaggcttcccaggagggccctctgcccgagatcgaagacgaggtttttagaaaacgcaacctgaccatcatggatctccatcccgggtctggaaagacccggagatacctgcctgccattgtgcgcgaagccatcaagcggaaacttagaacactgattctcgctccgacgcgcgtcgtggccagcgagatggctgaagccctgaagggcatgcccatccggtatcaaaccacagcggttaaatccgagcacaccgggaaggagattgtggacctgatgtgccatgccacattcaccatgagactccttagccctgtccgcgtgcccaattacaacatgatcatcatggatgaagctcactttacggacccttcttccattgccgctcggggctatatcagcacaagagtgggaatgggcgaggccgccgctattttcatgaccgcgacaccccctgggtctgtcgaagcctttccgcagagcaatgctgttatccaggatgaggaacgggacattcccgagcgctcctggaactctggatacgagtggatcacagatttccctggcaaaaccgtgtggtttgtgcccagcatcaagtccgggaatgacattgccaactgtctgagaaagaatggaaaacgggtcatccagctgtctcgcaagacattcgataccgaatatcagaagacgaagaacaacgactgggactacgtggttacaaccgatattagcgagatgggcgccaattttagagctgaccgggtgatcgatcctagacgctgcctcaaacccgtcattctgaaggacgggccggaacgggtgatccttgccggccctatgcccgttacagtggcgtccgctgcccagagacgcggacggattggcagaaaccataataaggagggggatcagtacatctatatgggacagcccctgaacaatgacgaggatcacgcccactggaccgaagctaaaatgctcctggacaacatcaatacgcctgagggcattatccccgccctgttcgaacctgagcgcgaaaagagcgcggccattgatggggagtaccggctcagaggagaggctcgcaaaaccttcgtcgaacttatgagacggggcgacctgccggtgtggctgtcttataaggtcgcctccgaggggtttcaatacagcgatcgcagatggtgcttcgacggcgaacggaacaatcaggtgctcgaggaaaacatggatgttgagatctggacaaaagagggagaacgcaagaaactgagaccccggtggcttgacgctagaacctattccgaccctctggccctccgcgagtttaaggagttcgctgccggccggagatctgtgagcggggatctgattctggagatcggaaagctcccccagcatcttacacagcgcgcgcaaaatgccctggacaacctggtgatgctccacaattccgaacagggcgggcgggcttacagacatgccatggaggagctgcctgataccatcgaaacacttatgctgctcgctctgattgccgtcctgaccggaggcgttacgctctttttcctttctggccgggggctgggaaaaacaagcatcggcctgctctgtgtgatggcctccagcgtgctgctttggatggcttctgtcgagccccactggattgcggcctccatcattctggaatttttcctcatggtgctgctgatcccggagcctgaccgccagagaacaccccaggataaccaactcgcttatgttgtgatcgggcttctgtttatgattctgaccgtcgccgccaatgagatgggactcctggaaacaaccaagaaagaccttggcatcgggcacgtggctgtcgagaaccatcaccatgccacaatgctggatgtggacctccaccctgcgagcgcctggacgctgtacgctgttgccaccacaattatcacccccatgatgcggcatacaattgaaaacaccacggctaatatctctctgaccgccattgcgaaccaggccgctatcctcatgggacttgataagggctggcctatctccaaaatggacattggcgtgcccctgctggccctcgggtgctacagccaggtcaatccgctgacacttaccgctgccgtgctgatgctcgttgctcactatgccatcattggacctggcctgcaagcgaaggccacacgcgaggctcagaagagaaccgccgctgggatcatgaaaaaccccacggtggatggaattgtcgccatcgacctggatcccgtggtgtacgacgccaagttcgaaaaacagctcggccagatcatgcttctgattctgtgtacatctcaaatcctcctgatgcggaccacatgggcgctttgcgagagcattaccctggctaccgggcctctcacaacgctgtgggagggatccccgggcaagttttggaataccacaatcgccgtttctatggctaacattttccgcggcagctatctggccggggccggactcgctttttcccttatgaaaagcctgggcgggggaagacggggcaccggggcccagggagaaacactgggcgagaagtggaagcgccagctcaatcagctgtccaaatctgagttcaacatctacaagagaagcggcatcatggaggtcgaccggtccgaagcgaaagaggggcttaagagaggagagaccacgcgccacgccgtgtctcggggcacagctaaactgagatggttcgtggaacgcaatctcgtcaagcccgaggggaaggttattgatctgggatgtggcagagggggatggagctattactgcgccggcctgaaaaaggtgaccgaagtgaaaggctataccaaagggggacctggccatgaggaacccatccctatggctacatacgggtggaacctcgtcaaacttcactccggaaaggacgtgtttttcacaccccctgagaaatgtgatacactgctgtgcgacattggcgagtctagcccgaatcccacgatcgaagaggggagaaccctccgcgttctgaagatggtggaaccttggcttcggggaaaccaattttgtattaagatcctgaatccctacatgccttccgtcgtggagacactcgagcagatgcagagaaaacatggcggcatgctggttcgcaaccccctgagcagaaattctacccacgaaatgtattgggtgtcctgcgggacaggaaacattgtcagcgccgtgaatatgacctctagaatgctcctgaaccgcttcacgatggcgcaccggaagccgacctacgagagagatgtggaccttggcgccgggacacgccatgtcgctgttgaacctgaggtggccaacctggatatcatcggacagagaattgaaaatatcaaacacgagcataagtccacctggcactatgacgaggataacccctacaaaacatgggcttatcatggcagctacgaagtgaagccctctgggtccgccagctccatggtcaatggagtggttaagctcctgaccaaaccttgggacgtgattcccatggtcacacaaatcgctatgaccgatacgacaccttttggccagcagcgggtgttcaaggagaaagttgacacccgcaccccgaaggccaaaagaggcacagcgcaaattatggaagtgacggcccggtggctttgggggtttctgagcagaaacaagaagccccggatctgtacccgcgaggagttcacaagaaaagtccggtctaatgctgccatcggagctgtgtttgttgacgagaaccagtggaatagcgccaaggaggccgtggaagatgagcgcttctgggacctcgtccagaaagaaagagagctgcacaagcagggcaaatgcgcgacctgcgtgtataacatgatggggaagcgggaaaagaaactgggagagtttggcaaggctaaagggtcccgcgccatttggtacatgtggctcggcgccagattcctggagtttgaagctcttggattcatgaatgaggatcactggttctctcgggaaaacagcctgtccggcgtcgagggggagggactccataagctgggctacatccttcgcgacatttctaaaatccctgggggaaatatgtatgccgatgacacagctggctgggataccagaattacagaagacgatctgcaaaacgaggccaagatcaccgacatcatggaacccgagcacgcgctcctggccacgagcatttttaaactgacctaccagaataaggtggttcgggtgcagcgccctgctaagaacgggacagtcatggatgtgatctccagacgggaccagcgcggctctggacaagtgggcacctatgggctcaatacattcaccaacatggaagcccagctgattagacagatggagagcgagggaatctttcttccctccgaactggagacgccgaacctcgctgaacgggttctggattggcttgagaaatacggcgtggaaagactgaagcgcatggccattagcggggacgactgtgtcgtgaaacctatcgatgaccggttcgcgacagccctcaccgctctgaatgatatgggaaaggttagaaaagacatcccccagtgggagccttctaagggctggaacgattggcaacaggtgcccttttgctcccatcacttccaccagctgattatgaaggacgggcgcgagatcgtcgtgccttgtcggaatcaggatgaactcgtcggcagagcccgcgtgagccaaggagctggctggtctctgcgggagacagcctgccttgggaaatcctatgctcagatgtggcagctgatgtactttcatagacgcgacctccggctggccgcgaacgccatttgtagcgctgttcccatcgattgggtgccgacctccagaacgacctggtctattcacgcccatcaccaatggatgacaaccgaagacatgcttagcgtctggaatcgcgtgtggatcgaggaaaacccttggatggaggataagacacatgtttccagctggggagacgtgccctatctgggcaaacgggaggaccagtggtgcgggtctctcattggactgaccgccagagctacatgggcctccaatatccaggtcgcgatcaaccaggtgcggagactgattggcaatgaaaactacctcgattacatgaccagcatgaagcgcttcaaaaatgagggggaccccgaaggcgctctgtggtga

SEQ ID NO: 19224 - RNA, 9879 nt, synthetic construct
  misc_feature 1..9879: note = derived and/or modified CDS sequence (opt5) from DENV-1__GU131789__SS-prME
  source 1..9879: mol_type = other RNA
agcgtgaccatgctgctcatgctgatgcccacagcccttgctttccacctgacgaccagaggcggggaacctcatatgatcgtgtccaagcaggaacggggaaaatctctcctgtttaagaccagcgccggcgttaacatgtgcacccttattgcgatggacctgggggagctctgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtggccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctattctgcgcaaactttgcatcgaagccaagatttccaatacgacaaccgatagcagatgtccgacccaaggagaggcgacactggttgaagaacaagacgccaacttcgtgtgccggcgcacctttgtggatagaggctggggcaatgggtgtggactcttcggcaaagggtctctgatcacatgcgctaagtttaagtgcgtcacgaaacttgagggaaagatcgtgcagtacgaaaacctgaaatattccgttattgtgaccgtccacacaggcgaccagcatcaagtggggaatgagagcaccgaacacggaacaaccgccacgatcacaccccaagctcctaccaccgagattcagctcacagactacggcgccctgaccctggattgttctccccggacgggcctcgacttcaacgaaatggttctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggtcgtgctgggaagccaagagggcgccatgcacacggctctgaccggggccacagaaatccagacctccggaacaaccacgatttttgccggccatctcaaatgcagactgaagatggataaacttacactgaaggggatgagctatgttatgtgtaccggctctttcaaactcgagaaggaagtggctgagacccagcacggaacagtcctggtgcagatcaagtacgagggcaccgacgccccgtgcaaaatccctttctccacacaagatgaaaagggggttacgcagaacggacggctgattaccgcgaatcccatcgtgacagacaaagagaagcctgtcaacattgaagctgagccgccctttggcgagagctatatcgtgattggggccggagaaaaagcccttaagctctcttggttcaagaaaggcagctccatcgggaagatgtttgaggctaccgccagaggcgctcgccggatggccatcctgggagatacagcgtgggacttcggctctattgggggagtgtttaccagcgttggcaaactggtccatcagatcttcgggacggcctacggagtgctcttttccggcgtgagctggaccatgaagattgggatcggcgtcctgcttacatggctgggactcaattctagatccaccagcctgtctatgacatgtattgctgtgggcctggttaccctttacctcggggtgatggtccaggccgattccggatgcgtgatcaactggaaaggccgcgaactgaagtgtgggagcggaattttcgttacaaatgaggtgcacacctggacggaacaatataagtttcaggctgactcccctaaacggctgtctgccgcgatcggcaaggcctgggaggagggggtctgcggcatcagaagcgctacacgcctcgaaaacattatgtggaaacagatctccaacgagctgaatcatattcttctggaaaacgacatgaagttcaccgtggttgtgggagatgtcgccggcatcctcgctcaggggaaaaagatgattcggccgcaacccatggagtacaaatattcttggaaaagctggggaaaggccaagatcatcggcgccgacgtgcagaataccacatttattatcgatgggcctaacacccccgaatgtcctgacgatcagagagcttggaatatttgggaggtggaggactacggattcggcatctttacgacaaacatttggctgaagctgcgcgattcctatacccaggtctgcgaccaccggcttatgagcgcggccatcaaagattctaaggctgttcacgccgacatgggctactggatcgaatccgagaaaaatgaaacatggaagctcgccagagctagcttcattgaggtgaagacctgtatctggcccaaatctcatacactgtggtccaacggggtgctggaaagcgagatgattatcccgaagatttatggaggccctatctctcaacacaattaccgccccgggtacttcacccagacggccggaccttggcatctcggcaaactggagcttgattttgacctgtgcgaagggaccacagtcgtggttgatgagcactgcggaaaccggggccccagcctcagaaccacaaccgtgacgggcaagatcattcacgaatggtgttgccggtcctgtacactgcctcccctgcgcttcagaggggaggacggatgctggtatggcatggagatccggccggtcaaagaaaaggaggaaaatcttgtcaagagcatggtttctgcggggtccggagaggtggacagcttttccctcggcctgctgtgtatttctatcatgattgaagaggtcatgagaagccgctggtcccggaaaatgctcatgaccgggacactggctgtgttccttctgctcatcatgggacagctgacctggaacgatctgattagactttgcatcatggttggcgccaatgcctctgaccgcatgggcatggggaccacatacctggctctcatggccacgtttaagatgagacctatgttcgcggtgggactgctctttcggcgcctgaccagcagagaggtccttctgctcacaatcggcctgtccctggtggcttctgtggaacttcccaacagcctggaggaactcggggatggactggccatgggcattatgatcctcaaactgcttaccgacttccaatcccatcagctgtgggccacactcctgagcctgacctttattaagacgacattctctcttcactatgcttggaaaaccatggccatggtcctgtccatcgttagcctctttcccctgtgtctctctaccacatcccagaagaccacatggctgcctgtgcttctggggagcctgggatgcaagccgctcacgatgttcctgattgctgagaataaaatctggggccggcgctcttggccccttaacgaaggcatcatggccgtggggattgtctccatcctgctcagctccctgctcaagaacgatgtgcctctggcgggaccccttattgccggcgggatgctgatcgcttgttacgttattagcggatctagcgccgacctgtccctcgagaaagctgccgaggtgtcttgggaagaggaagccgagcatagcggcgcttcccacaatatcctggtcgaagtgcaggatgacgggaccatgaagatcaaagatgaggagagagacgatacacttaccattctgctcaaggcgacactgctcgccgtttctggagtgtatcctctgagcatccccgctaccctttttgtctggtacttctggcagaagaagaagcagcggtccggcgtgctgtgggacacgccttctcccccggaagtcgagcgcgccgtgctggatgacggcatttatagaatcatgcagcgggggctcctgggacgcagccaggttggcgtgggggtcttccaagaaaacgtgtttcataccatgtggcacgttacaagaggagccgtgcttatgtaccagggcaaacggctggagccttcctgggctagcgtcaagaaagacctcatttcttacgggggaggctggagactgcagggctcctggaataccggggaggaagtccaggtgatcgccgttgagcccggaaagaaccctaaaaatgtccaaacaacccccggcacattcaagacgccggaaggggaggtgggagcgattgctctcgattttaagcctggcaccagcgggtctcccatcgtgaaccgcgaaggaaaaatcgtcggcctgtatggcaatggggtggttacaacctccggaacctacgtgagcgccattgcccaggctaaggcctcccaggagggccctcttcccgagatcgaagacgaggtcttccggaaaagaaacctgacaattatggatctgcaccccgggtctggaaagacgcgccggtatctccctgcgatcgtgagagaagctattaaacgcaagctgcggacccttatcctggccccgacaagagttgtggccagcgagatggctgaagccctcaagggcatgcccatccgctaccaaaccacagctgtcaaatccgagcataccgggaaggagattgtggacctgatgtgccacgccacgtttacaatgcggctgctcagccctgttagagtgcccaattataacatgatcattatggatgaagcgcatttcaccgacccttcttccatcgccgctcggggctacattagcacccgcgtcggaatgggcgaggccgctgccatctttatgacagccacaccccctgggtctgtggaggctttcccgcagagcaatgcggtgatccaggatgaggaaagagacattcccgagcggtcctggaactctggatatgagtggatcacagattttcctggcaaaaccgtctggttcgttcccagcattaagtccgggaatgacatcgccaactgtcttcgcaaaaatggaaagagagtgattcagctgtctcggaagacgtttgatacagaataccagaaaaccaagaacaacgactgggactacgtggtcacaaccgatatcagcgagatgggcgctaatttcagagccgaccgcgtgattgatcctcggagatgcctgaaacccgttatcctcaaggacgggccggaacgcgtgatcctggccggccctatgcccgtcacggtggcttccgccgcgcagcggagaggacgcattggccggaaccacaataaagagggggatcagtatatctacatgggacagccccttaacaatgacgaggatcatgctcactggaccgaagccaagatgctgctcgacaacattaatacacctgagggcatcattcccgccctgttcgaacctgagagagaaaagagcgctgccatcgatggggagtatcgcctgagaggagaggcgcggaaaacctttgttgaactcatgcgcagaggcgaccttccggtgtggctgtcttacaaggtcgcctccgaggggttccaatatagcgatcggcgctggtgctttgacggcgaaagaaacaatcaggtgctggaggaaaacatggatgtcgagatctggacaaaagagggagaacggaagaaactcagaccccgctggctggacgctcggacctactccgaccctcttgccctgagagagttcaaggaatttgctgccggccgccggtctgtgagcggggatctcattctggagatcggaaaactgccccagcacctcacacagagagctcaaaatgcccttgacaacctggttatgctgcataattccgaacagggcgggcgggcgtatcgccacgccatggaggagctccctgataccattgaaacgctgatgcttctggctctcatcgccgtgctgacaggaggcgtgaccctgttctttctctctggcagagggcttggaaagaccagcattggcctgctgtgtgtcatggcttccagcgttctcctgtggatggcctctgtggagccccattggatcgccgcttccatcattcttgagttctttctgatggtgctcctgatcccggagcctgaccggcagcgcacaccccaggataaccaactggcgtacgtcgtgattgggctccttttcatgatcctgaccgttgccgctaatgagatgggactgctcgaaacaacgaagaaagacctgggcattgggcacgtggccgtcggaaaccaccatcacgccgctatgcttgatgtggacctgcatcctgccagcgcgtggaccctctacgccgtcgctacaaccatcattacacccatgatgagacacaccatcgagaacacgaccgccaatatctctctgacagctattgccaaccaggcggccatcctgatgggcctcgataagggctggcctatttccaaaatggacatcggggtgccccttctggctctgggatgctatagccaggttaatccgctcaccctgacagccgctgtgcttatgctggtcgcccattacgctattatcggccctgggctccaagccaaggcgacccgggaagcccagaaacgcacggctgccggaatcatgaagaaccccacagtggatggcattgttgctatcgacctggatcccgtggtctatgacgccaagtttgagaaacagctggggcagattatgctccttatcctgtgtacctctcaaattctgctcatgagaacaacctgggccctgtgcgaaagcatcacccttgcgacaggacctctgacgaccctctgggagggctccccgggcaagttctggaatacaaccatcgctgtgtctatggccaacatttttcgggggagctacctggctggagccggcctggccttctccctcatgaaaagccttgggggaggccgcagagggacaggagctcagggcgagaccctgggcgaaaagtggaaacggcagctgaatcagctctccaagtctgagttcaacacgtataagagaagcgggatcatggaagtggaccgctccgaggccaaagaaggactgaagcggggcgagacaaccaaacacgcggtttctagagggaccgccaaacttcgctggtttgtcgagcggaatctggtgaaacccgaaggaaaggtgattgatctcggctgtgggagaggaggctggagctactattgcgctggcctgaagaaagtcacagaggttaaggggtacaccaaaggaggccctgggcacgaagaacccatccctatggccacatacggatggaacctggtgaagctccattccggcaaagacgtgttctttattccccctgaaaagtgtgatacgcttctgtgcgacatcggggagtctagcccgaatcccaccattgaggaaggacgcacactgcgggtcctcaaaatggtggagccttggctgagaggcaaccaattctgtatcaagatccttaatccctatatgccttccgttgtggaaaccctggagcagatgcagcgcaagcacggcgggatgctcgtccggaaccccctgagcagaaattctacacatgagatgtactgggtgtcctgcggaaccggcaacattgttagcgctgtgaatatgacgtctcgcatgctgctcaaccggtttaccatggcccacagaaaaccgacatatgaacgcgatgtcgacctgggggcgggaaccagacacgtggccgtggagcctgaagtcgctaaccttgatatcattggccagcggatcgagaatattaagcatgaacacaaatccacatggcattacgacgaggataacccctataagacctgggcctaccacgggagctatgaggttaaaccctctggatccgctagctccatggtgaatggcgtggtcaagctgctcacaaagccttgggacgtgatccccatggttacccaaatcgccatgacggatacaacccctttcggccagcagcgcgtgtttaaagaaaaggtcgacaccagaacaccgaaagctaagcgggggacggcccaaattatggaggtgaccgcgaaatggctgtggggattccttagcagaaacaagaagccccggatctgtacacgcgaagagtttaccagaaaagttcggtctaatgccgctattggcgccgtgttcgtcgacgaaaaccagtggaatagcgctaaggaggccgtggaggatgaacgcttttgggacctggttcatagagagcgggaactccacaaacaggggaagtgcgccacatgcgtgtacaacatgatgggaaaacgcgagaagaagctgggcgagttcgggaaagcgaagggctccagagctatctggtacatgtggctgggagcccggtttctcgagttcgaggccctgggcttcatgaatgaagatcactggttttctcgcgagaacagcctttccggggtcgaaggagagggcctgcataaactcgggtatattctgagagacatctctaagatccctggaggcaatatgtacgctgatgacaccgccgggtgggatacacggattaccgaggacgatcttcagaacgaagctcgcatcacggacattatggagcccgaacacgccctgctcgcgaaaagcatcttcaagctgacctatcaaaataaagtggtcagagtgcagcggcctgccaagaacggcacagttatggatgtgatttcccgcagagaccagcggggatctggccaggtcgggacctacggactgaatacatttaccaacatggaggctcaactcatcagacagatggaaagcgagggcatcttctcccccagcgagctggaaacgccgattcttgccgagcgcgtgctggattggctcgaaaagtatggggtggagcggctgaaaagaatggctatctctggagacgactgtgttgtgaagcctattgatgaccgctttgccacagcgcttaccgccctgaacgatatgggcaaagtccggaaggacatcccccagtgggaaccttccaaagggtggaatgattggcagcaagtgcccttctgcagccatcactttcaccagctcattatgaaggacggcagagagatcgttgtgccttgtcgcaaccaggatgagctggtcggacgggctagagtgtctcagggcgccgggtggtccctgcgcgaaacagcttgcctcggaaagagctacgcccaaatgtggcagctgatgtatttccatcggagagaccttcgcctggctgccaatgcgatttgttccgccgtccccgtggattggatcccgacctctcggacgacctggagcatccacgctcatcaccagtggatgacaaccgaggacatgctctccgtttggaacagagtgtggattgaagagaatccttggatggaagataaaacacatatcagctcttggggcgacgtcccctacctggggaagcgggaggaccaatggtgcggatcccttattggcctgaccgccagagccacatgggctaccaacatccaggtggccattaatcaggttcgccggctcatcgggaacgagaattacctggattatatgacgagcatgaaaagatttaagaacgaatctgaccccgagggcgcgctgtggtga

SEQ ID NO: 19225 - RNA, 9879 nt, synthetic construct
  misc_feature 1..9879: note = derived and/or modified CDS sequence (opt5) from DENV-1__GU131790__SS-prME
  source 1..9879: mol_type = other RNA
agcgtgaccatgctgctcatgctggtgcccacagcccttgctttccacctgacgaccagaggcggggaacctcatatgattgtttccaagcaggaacggggaaaatctctcctgtttaagacaagcgccggcgtgaacatgtgcacccttattgcgatggacctgggggagctctgtgaagatacaatgacctacaaatgcccccgcatcacagagaccgaacccgacgatgtggactgttggtgcaatgctacggatacctgggtcacatatggaacctgttcccaaacaggcgagcacagacgggacaagcgctctgtggccctggcccctcatgttgggctgggactcgagaccagaacggaaacatggatgagctccgagggcgcttggaaacagattcagcgggtggaaacctgggccctgcgccaccccggcttcacagtcatcgctctttttctggcccatgcgattgggacctctatcacccagaagggaatcattttcatcctcctgatgcttgtgacacctagcatggccatgagatgcgttggcattgggtcccgggattttgtggagggactgagcggcgctacgtgggtcgacgtggtgctcgagcacgggtcttgtgtcaccacaatggccaaggataaacccaccctggacatcgaactgctcaagacagaggttaccaaccctgctgtgctgcgcaaactttgcattgaagccaagatctccaatacgacaaccgatagcagatgtccgacccaaggagaggcgacactggtggaagaacaagacgccaacttcgtctgccggcgcacctttgtggatagaggctggggcaatgggtgtggactcttcggcaaagggtctctgattacatgcgctaagtttaagtgcgttacgaaacttgagggaaagatcgtgcagtacgaaaacctgaaatattccgtcatcgtgaccgttcacacaggcgaccagcatcaagtggggaatgagagcaccgaacacggaacaaccgccacgattacaccccaagctcctaccaccgagatccagctcacagactacggcgccctgaccctggattgttctccccggacgggcctcgacttcaacgaaatggtcctgcttacaatgaaggagaaatcctggctggtgcataagcagtggtttctcgatctgcctcttccctggaccagcggggcctccacatctcaagagacctggaatcgccaggacctgctcgtcaccttcaaaacagctcacgcgaagaagcaggaagtggttgtgctgggaagccaagagggcgccatgcacacggctctgaccggggccacagaaattcagacctccggaacaaccacgatctttgccggccatctcaaatgcagactgaagatggataaacttacactgaaggggatgagctatgtcatgtgtaccggctctttcaaactcgagaaggaagtggctgagacccagcacggaacagttctggtgcagattaagtacgagggcaccgacgccccgtgcaaaatccctttctccacacaagatgaaaagggggtcacgcagaacggacggctgatcaccgcgaatcccattgtgacagacaaagagaagcctgtgaacatcgaagctgagccgccctttggcgagagctatattgttatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtctttaccagcgtgggcaaactggtgcatcagattttcgggacggcctacggagtcctcttttccggcgtgagctggaccatgaagatcgggattggcgttctgcttacatggctgggactcaattctagatccaccagcctgtctatgacatgtatcgctgtgggcctggtcaccctttacctcggggtgatggttcaggccgattccggatgcgtgattaactggaaaggccgcgaactgaagtgtgggagcggaatcttcgtcacaaatgaggtgcacacctggacggaacaatataagtttcaggctgactcccctaaacggctgtctgccgcgattggcaaggcctgggaggagggggtttgcggcatcagaagcgctacacgcctcgaaaacatcatgtggaaacagatttccaacgagctgaatcatatccttctggaaaacgacatgaagttcaccgtggtcgtgggagatgtggccggcattctcgctcaggggaaaaagatgatccggccgcaacccatggagtacaaatattcttggaaaagctggggaaaggccaagctgattggcgccgacgtccagaataccacatttatcatcgatgggcctaacacccccgaatgtcctgacgatcagagagcttggaatatttgggaggttgaggactacggattcggcatctttacgacaaacatttggctgaaacttcgcgattcctatacccaggtgtgcgaccaccggctcatgagcgcggccatcaaagattctaaggctgtgcacgccgacatgggctactggattgaatccgagaaaaatgaaacatggaagctggccagagctagcttcatcgaggtcaagacctgtatctggcccaaatctcatacactgtggtccaacggggtgctcgaaagcgagatgattatcccgaagatttatggaggccctatctctcaacacaattaccgccccgggtacttcacccagacggccggaccttggcatctgggcaaacttgagctggattttgacctctgcgaagggaccacagttgtggtcgatgagcactgcggaaaccggggccccagcctgagaaccacaaccgtgacgggcaagattatccacgaatggtgttgccggtcctgtacactgcctccccttcgcttcagaggggaggacggatgctggtatggcatggagatccggccggttaaagaaaaggaggaaaatctcgtcaagagcatggtctctgcggggtccggagaggtggacagcttttccctgggcctgctctgtatttctatcatgattgaagaggttatgagaagccgctggtcccggaaaatgctgatgaccgggacacttgctgtgttctttctgctcatcatgggacagctgacctggaacgatctgattagactttgcatcatggtcggcgccaatgcctctgaccgcatgggcatggggaccacatacctggctctcatggccacgttcaagatgagacctatgtttgcggtgggactcctgttccggcgcctgaccagcagagaggtgcttctgctcacaattggcctgtccctggtcgcttctgttgaacttcccaacagcctggaggaactcggggatggactggccatgggcatcatgatcctcaaactgcttaccgactttcaatcccatcagctgtgggccacactcctgagcctgaccttcattaagacgacattttctcttcactatgcttggaaaaccatggccatggtgctgtccatcgtgagcctcttccccctgtgtctctctaccacatcccagaagaccacatggctgcctgtccttctggggagcctgggatgcaagccgctcacgatgtttctgattgctgagaataaaatctggggccggcgctcttggccccttaacgaaggcattatggccgtggggatcgtttccatcctgctcagctccctgctcaagaacgatgtgcctctggcgggaccccttattgccggcgggatgctgatcgcttgttacgtcattagcggatctagcgccgacctgtccctcgagaaagctgccgaggtgtcttgggaagaggaagccgagcatagcggcgcttcccacaatatcctggttgaagtgcaggatgacgggaccatgaagattaaagatgaggagagagacgatacacttaccatcctgctcaaggcgacactgctcgccgtctctggagtgtatcctctgagcatccccgctacccttttcgtctggtacttctggcagaagaagaagcagcggtccggcgtgctgtgggacacgccttctcccccggaagttgagcgcgccgtgctggatgacggcatttatagaatcatgcagcgggggctcctgggacgcagccaggtcggcgtgggggtttttcaagaaaacgtgttccataccatgtggcacgtcacaagaggagccgtgcttatgtaccagggcaaacggctggagccttcctgggctagcgtgaagaaagacctcatttcttacgggggaggctggagactgcagggctcctggaataccggggaggaagttcaggtcatcgccgtggagcccggaaagaaccctaaaaatgtgcaaacagcgcccggcacctttaagacaccggaaggggaggtcggagctattgccctcgatttcaagcctggcacgagcgggtctcccatcgtgaaccgcgaaggaaaaattgttggcctgtatggcaatggggtggtcaccacatccggaacctacgtgagcgccatcgctcaggccaaggcgtcccaggagggccctcttcccgagatcgaagacgaggtttttcggaaaagaaacctgaccattatggatctgcaccccgggtctggaaagacacgccggtatctccctgctatcgtgagagaagccattaaacgcaagctgcggacgcttatcctggccccgaccagagtcgtggctagcgagatggccgaagctctcaagggcatgcccattcgctaccaaacaaccgccgttaaatccgagcatacagggaaggagatcgtggacctgatgtgccacgcgaccttcacgatgcggctgctcagccctgtcagagtgcccaattataacatgatcattatggatgaagcccattttacagacccttcttccatcgctgcccggggctacattagcacccgcgtgggaatgggcgaggctgccgccatcttcatgaccgctacaccccctgggtctgtcgaagcgtttccgcagagcaatgccgttattcaggatgaggaaagagacatccccgagcggtcctggaactctggatatgagtggatcaccgatttccctggcaaaacagtgtggtttgtgcccagcattaagtccgggaatgacatcgctaactgtcttcgcaaaaatggaaagagagtcattcagctgtctcggaagaccttcgatacggaataccagaagaccaagaacaacgactgggactacgtggttaccacagatatcagcgagatgggcgccaatttcagagccgaccgcgtgattgatcctcggagatgcctgaaacccgtcatcctcaaggacgggccggaacgcgtgattctggctggccctatgcccgttaccgtggcctccgcggctcagcggagaggacgcatcggccggaaccacaataaagagggggatcagtatatctacatgggacagccccttaacaatgacgaggatcatgcccactggacggaagccaagatgctgctcgacaacattaatacccctgagggcatcattcccgctctgtttgaacctgagagagaaaagagcgccgcgatcgatggggagtatcgcctgagaggagaggcccggaaaacattcgtcgaactcatgcgcagaggcgaccttccggtgtggctgtcttacaaggtcgcttccgaggggtttcaatatagcgatcggcgctggtgcttcgacggcgaaagaaacaatcaggtgctggaggaaaacatggatgttgagatttggaccaaagagggagaacggaagaaactcagaccccgctggctggacgcccggacatactccgaccctcttgctctgagagagtttaaggagttcgccgctggccgccggtctgtgagcggggatctcatcctggagatcggaaaactgccccagcacctcacccagagagcccaaaatgcgcttgacaacctggtgatgctgcataattccgaacagggcgggcgggcctatcgccacgctatggaggagctccctgatacaattgaaaccctgatgcttctggccctcatcgctgtcctgacgggaggcgttacactgtttttcctctctggcagagggcttggaaagaccagcattggcctgctgtgtgtgatggcctccagcgtgctcctgtggatggcctctgtcgagccccattggatcgctgcgtccattatccttgaatttttcctgatggtgctcctgatcccggagcctgaccggcagcgcacaccccaggataaccaactggcctacgttgtgattgggctcctttttatgatcctgacagtcgctgccaatgagatgggactgctcgaaaccacaaagaaagacctgggcattgggcacgtggccgtcgagaaccaccatcacgctgccatgcttgatgtggacctgcatcctgcgagcgcctggacgctctacgctgttgccaccacaatcattacccccatgatgagacacacaatcgaaaacaccacggctaatatttctctgaccgccatcgcgaaccaggccgctatcctgatgggactcgataagggctggcctatttccaaaatggacatcggcgtgccccttctggccctggggtgctatagccaggtcaatccgctcacactgaccgctgccgtgcttatgctggttgctcattacgccattatcggacctggcctccaagcgaaggccacacgggaggctcagaaacgcaccgccgctgggattatgaagaaccccacggtggatggaatcgtcgccatcgacctggatcccgtggtgtatgacgccaagttcgaaaaacagctgggccagattatgctccttatcctgtgtacatctcaaattctgctcatgagaaccacatgggcgctgtgcgagagcatcacccttgctaccgggcctctgacaacgctctgggagggatccccgggcaagttttggaataccacaattgccgtttctatggctaacatcttccggggcagctacctggccggggccggactggctttctccctcatgaaaagccttggcgggggacgcagaggcaccggggcccagggagaaacactgggcgagaagtggaaacggcagctgaatcagctctccaagtctgaatttaacacctataagagaagcggcatcatggaggtcgaccgctccgaagcgaaagaggggctgaagcggggagagacgacaaaacacgccgtgtctagaggcaccgctaaacttcgctggttcgtggaacggaatctggtcaaacccgaggggaaggttattgatctcggatgtggcagagggggatggagctactattgcgccggcctgaagaaagtgaccgaagtgaagggctacacaaaagggggacctggccacgaggaacccatccctatggctacctacgggtggaacctggtcaagctccattccggaaaagacgtgtttttcattccccctgagaagtgtgatacacttctgtgcgacatcggcgagtctagcccgaatcccacgattgaagaggggcgcaccctgcgggttctcaaaatggtggaaccttggctgagaggaaaccaattttgtatcaagattcttaatccctatatgccttccgtcgtggagacactggagcagatgcagcgcaagcacggcggcatgctcgttcggaaccccctgagcagaaattctacccatgaaatgtactgggtgtcctgcgggacaggaaacatcgtcagcgccgtgaatatgacctctcgcatgctgctcaaccggttcacgatggcgcacagaaaaccgacctatgagcgcgatgtggacctgggcgccgggacaagacacgtcgctgttgaacctgaggtggccaaccttgatatcattggacagcggatcgaaaatattaagcatgagcacaaatccacctggcattacgacgaggataacccctataagacatgggcttaccacggcagctatgaagtgaaaccctctgggtccgccagctccatggtcaatggagtggttaagctgctcaccaagccttgggacgtgatccccatggtcacacaaattgctatgaccgatacgacaccttttggccagcagcgcgtgttcaaagagaaggttgacaccagaaccccgaaagccaagcggggcacagcgcaaatcatggaagtgacggccaaatggctgtgggggtttcttagcagaaacaagaagccccggatctgtacccgcgaggagttcacaagaaaagtccggtctaatgctgccattggagctgtgtttgttgacgagaaccagtggaatagcgccaaggaggccgtggaagatgagcgcttctgggacctggtccatagagaacgggagctccacaaacagggcaagtgcgcgacctgcgtgtacaacatgatggggaaacgcgaaaagaagctgggagagtttggcaaagctaaggggtccagagccatctggtacatgtggctgggcgcccggttcctcgagttcgaagctctgggatttatgaatgaggatcactggttctctcgcgaaaacagcctttccggcgtcgagggggagggactgcataaactcggctatattctgagagacatctctaagattcctgggggaaatatgtacgccgatgacacagctggctgggatacccggatcacagaagacgatcttcagaacgaggcccgcatcaccgacattatggaacccgagcacgcgctgctcgccaaaagcatctttaagctgacgtatcaaaataaagtggttagagtgcagcggcctgctaagaacgggaccgtcatggatgtgatttcccgcagagaccagcggggctctggacaggtgggcacatacgggctgaataccttcacaaacatggaagcccaactcatcagacagatggagagcgagggaatcttttcccccagcgaactggagaccccgaaccttgctgaacgcgttctggattggctcgagaagtatggcgtgaaacggctgaagagaatggccatctctggggacgactgtgtcgtgaaacctatcgatgaccgcttcgcgacggcccttacagctctgaatgatatgggaaaggttcggaaagacattccccagtgggaaccttccaagggctggaacgattggcagcaagtgcccttttgcagccatcacttccaccagctcatcatgaaggacgggagagagattgtcgtgccttgtcgcaatcaggatgagctggtcggccgggccagagtgtctcagggagctggctggtccctgcgcgaaaccgcctgcctcgggaaaagctacgctcaaatgtggcagctgatgtattttcatcggagagaccttcgcctggccgcgaacgccatctgttccgctgttcccgtggattggattccgacatctcggaccacgtggagcatccacgcccatcaccagtggatgaccacagaggacatgctctccgtctggaatagagtgtggattgaagagaacccttggatggaagataagacccatatcagctcttggggagacgttccctacctgggcaaacgggaggaccaatggtgcgggtcccttatcggactgacagccagagctacctgggccacaaatattcaggtggcgatcaaccaggtccgccggctcattggcaatgagaactacctggattatatgaccagcatgaagagattcaaaaatgaatctgaccccgagggggctctgtggtga

SEQ ID NO: 19226 - RNA, 9879 nt, synthetic construct
  misc_feature 1..9879: note = derived and/or modified CDS sequence (opt5) from DENV-1__GU131791__SS-prME
  source 1..9879: mol_type = other RNA
agcgtgaccatgctgctcatgctgatgcccaccgcccttgctttccacctgacgaccagaggaggggaacctcatatgatcgtctccaagcaggaacggggaaaatctctcctgtttaagacaagcgccggcgttaacatgtgcacccttattgcgatggacctgggggaactctgtgaagatacaatgacctacaaatgccccagaatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgaaggggatgagctatgtgatgtgtaccggctctttcaaactcgagaaggaagtcgctgagacccagcacggaacagtgctggttcagattaagtacgagggcaccgacgccccgtgcaaaatccctttctccacacaagatgaaaagggggtgacgcagaacggacggctgatcaccgcgaatcccattgtcacagacaaagagaagcctgtgaacatcgaagctgagccgccctttggcgagagctatattgtgatcggggccggagaaaaagcccttaagctctcttggttcaagaaaggcagctccattgggaagatgtttgaggctaccgccagaggcgctcgccggatggccatcctgggagatacagcgtgggacttcggctctatcgggggagtttttaccagcgtcggcaaactggtgcatcagattttcgggacggcctacggagtgctcttttccggcgtcagctggaccatgaagatcgggattggcgtgctgcttacatggctgggactcaattctagatccaccagcctgtctatgacatgtatcgctgttggcctggtgaccctttacctcggggtcatggtgcaggccgattccggatgcgttattaactggaaaggccgcgaactgaagtgtgggagcggaatcttcgtgacaaatgaggtccacacctggacggaacaatataagtttcaggctgactcccctaaacggctgtctgccgcgattggcaaggcctgggaggagggggtgtgcggcatcagaagcgctacacgcctcgaaaacatcatgtggaaacagatttccaacgagctgaatcatatccttctggaaaacgacatgaagttcaccgttgtggtcggagatgtggccggcattctcgctcaggggaaaaagatgatccggccgcaacccatggagtacaaatattcttggaaaagctggggaaaggccaagattatcggcgccgacgtgcagaataccacatttatcattgatgggcctaacacccccgaatgtcctgacgatcagagagcttggaatatctgggaggtcgaggactacggattcggcatttttacgacaaacatctggctgaagctgcgcgattcctatacccaggtttgcgaccaccggcttatgagcgcggccattaaagattctaaggctgtgcacgccgacatgggctactggatcgaatccgagaaaaatgaaacatggaagctcgccagagctagcttcatcgaggtgaagacctgtatttggcccaaatctcatacactgtggtccaacggggtcctggaaagcgagatgatcattccgaagatctatggaggccctatttctcaacacaattaccgccccgggtacttcacccaggccgcgggaccttggcatctcggcaaactggagcttgattttgacctgtgcgaagggacgaccgtggttgtggatgagcactgcggaaaccggggccccagcctcagaacaaccacagtcaccggcaagatcatccacgaatggtgttgccggtcctgtacgctgcctcccctgcgcttcagaggggaggacggatgctggtatggcatggagattcggccggtgaaagaaaaggaggaaaatcttgttaagagcatggtgtctgctgggtccggagaggtcgacagcttttccctcggcctgctgtgtatctctattatgatcgaagaggtgatgagaagccgctggtcccggagaatgctcatgacagggaccctggccgttttctttcttctgattatgggacagctcacatggaacgatctgatccgcctgtgcattatggtgggcgccaatgcttctgacagaatgggcatggggaccacctaccttgccctgatggcgacattcaaaatgcggcctatgtttgctgtcggactcctgttccgcagactcacgagccgggaggtgctgcttctgaccatcggcctctccctggtggcctctgtcgaactgcccaacagccttgaggaactgggggatggactcgccatgggcatcatgattctgaagctcctgacagactttcaatcccatcagctttgggctaccctgctcagcctgacattcatcaaaaccacgttttctctgcactatgcctggaagacaatggctatggttctttccattgtgagcctgttccccctctgtctgtctaccacctcccagaaaacaacctggctccctgtgctgcttgggagcctgggatgcaagccgctgacaatgtttctcatcgccgagaataagatttggggccgcagatcttggcccctgaacgaaggcatcatggcggtcgggatcgtgtccattcttctgagctccctcctgaaaaacgatgttcctctcgccggacccctgatcgctggcgggatgcttattgcctgttacgtgatcagcggatctagcgctgacctgtccctggagaaggccgccgaggtctcttgggaagaggaagctgagcatagcggcgcgtcccacaatattctcgtggaagttcaggatgacgggcctatgaaaatcaaggatgaggagcgggacgatacgctgaccatccttctgaaagccacactcctggctgtgtctggagtctatcccctcagcattcctgccaccctgttcgtgtggtacttctggcaaaagaaaaagcagcgctccggcgtcctttgggacacaccctctccgcctgaagtggagagagccgttctggatgacggcatctatcggattatgcagcgcgggctgctcggaagaagccaggtgggcgtcggggtgtttcaagaaaacgttttccataccatgtggcacgtgacgcggggagctgtcctgatgtaccagggcaagagacttgagccctcctgggccagcgtgaaaaaggacctgatctcttacgggggaggctggcgcctccagggctcctggaataccggggaggaagtgcaggttattgcggtcgagcctggcaagaaccccaagaatgtgcaaacagctccgggcacctttaaaacacctgaaggggaggtgggagccatcgccctggatttcaagcccggcaccagcgggtctcctattgtcaaccgggaaggaaagatcgtgggcctctatggcaatggggttgtgacaacgtccggaacctacgtcagcgctatcgcccaggcgaaggcttcccaggagggccccctgcccgagattgaagacgaggtgtttagaaagcgcaaccttacaatcatggatctgcaccctgggtctggaaaaacccggagatatctgccggccattgttcgcgaagccatcaagcggaaactcagaaccctgattcttgctcccacacgcgtggtcgccagcgagatggctgaagccctgaagggcatgcctatccggtaccaaacgaccgcggtgaagtccgagcatacagggaaagagatcgttgacctcatgtgccacgccaccttcacaatgagactgctgagccccgtgcgggtccctaattataacatgattatcatggatgaagctcattttaccgacccctcttccattgccgctcgcggctacatcagcacgagagtgggaatgggcgaggccgccgctattttcatgacagcgacccctccggggtctgtggaagcctttccccagagcaatgctgtcatccaggatgaggaacgggacatccctgagcgctcctggaactctggatatgagtggattaccgatttccccggcaagacagtttggtttgtgcctagcatcaaatccgggaatgacattgccaactgtctcagaaagaatggaaaacgggtgatccagctttctagaaagaccttcgatacagaataccaaaagaccaaaaacaacgactgggactacgtcgtgacgacagatattagcgagatgggcgccaatttccgcgctgaccgggttatcgatcccagacgctgcctgaagccggtgattctgaaagacgggcctgaacgggtcatcctcgccggccccatgcccgtgaccgttgcgtccgctgcccagagacgcggacggatcggcagaaaccacaataaggagggggatcagtatatttacatgggacagcctctgaacaatgacgaggatcatgcccactggacagaagctaaaatgcttctggacaacatcaatacccccgagggcattatccctgccctctttgaaccggagcgcgaaaagagcgcggccattgatggggagtatagactgcggggagaggctcgcaagacgttcgtggaactgatgagacggggcgacctccccgtctggctttcttacaaagtggcctccgaggggtttcaatatagcgatcgcagatggtgcttcgacggcgaacggaacaatcaggtcctggaggaaaacatggatgtggagatctggaccaaggagggagaacgcaagaaactgcgccctcggtggctcgacgctagaacatactccgaccccctggcccttcgcgagtttaaagagttcgctgccggccggagatctgttagcggggatctgatcctcgagattggaaagctgcctcagcacctgacccagcgggcgcaaaatgccctcgacaaccttgtgatcctgcataattccgaacagggcgggcgcgcttatagacacgccatggaggagctgcccgatacaattgaaaccctcatgctgcttgctctgatcgccgtgctcacaggaggcgtcaccctgtttttcctgtctggccgggggctcggaaaaacgagcattggccttctgtgtgttatggcctccagcgtgctgctctggatggcttctgtggagccgcattggatcgcggcctccatcattctggaatttttccttatggtcctgctcatccctgagcccgaccgccagagaacacctcaggataaccaactggcttacgtggttattgggctgctctttatgatccttaccgtggccgccaatgagatgggactgctggaaaccacaaagaaggacctcggcattgggcacgtcgctgtggagaaccaccatcacgccgcgatgctggatgtcgaccttcatcccgccagcgcttggaccctgtacgccgtggctacaacgatcattacccctatgatgcggcacacaatcgaaaacaccacagccaatatctctctcaccgcgattgccaaccaggctgccatcctgatgggactggataaaggctggcccatttccaagatggacatcggcgttccgctccttgctctggggtgctatagccaggtgaatcctctgacgctcaccgccgctgtcctgatgcttgtggcccattacgcgattatcggacccggcctgcaagccaaagctacacgcgaggcccagaagagaaccgctgccgggatcatgaaaaaccccacagttgatggaattgtggccatcgacctcgatcctgtcgtgtatgacgcgaagttcgaaaagcagctgggccagattatgctgctcatcctttgtacctctcaaattctgctgatgcggacgacatgggctctctgcgagagcatcaccctggccacagggccgcttaccaccctgtgggagggatcccccggcaaattttggaatacaacgatcgctgtgtctatggccaacattttccgcggcagctacctcgccggggctggactggccttctccctgatgaaaagcctcggcgggggaagacggggcaccggggcgcagggagaaacacttggcgagaaatggaagagacagctgaatcagctgtccaaatctgaatttaacacctataagcgcagcggcatcatggaggttgaccggtccgaagccaaggaggggctcaaaagaggagagacaaccaagcacgctgtctctcgcggcacggccaaactgcggtggttcgtggaaagaaatcttgtgaagcctgaggggaaagtcattgatctgggatgtggccgcgggggatggagctactattgcgctggcctcaagaaggttacagaagtgaaaggctacaccaaaggcgggcccgggcacgaggaacctatccccatggccacctacgggtggaacctggtgaaactgcattccggaaaggacgtctttttcattcctccggagaaatgtgatacactcctttgcgacatcggcgagtctagccccaatcctaccattgaagaggggcggacactgagagtgctgaagatggttgaaccctggctccgcggaaaccaattttgtatcaaaatcctgaatccttatatgccctccgtggtcgagacgcttgagcagatgcagcggaagcacggcggcatgctggtgagaaacccgctcagccgcaattctacccatgaaatgtactgggtttcctgcgggacaggaaacattgtgagcgcggtcaatatgacctctcggatgctgctgaacagattcacaatggcccaccgcaagcctacctatgagagagatgtggacctcggcgctgggacgcggcacgtggccgtcgaacccgaggttgctaacctggatatcattggacagcgcatcgaaaatattaaacatgagcacaagtccacctggcattacgacgaggataacccctataaaacatgggcctaccacggcagctatgaagtgaagccttctgggtccgctagctccatggtgaatggagtcgtgaaacttctgaccaagccctgggacgttatccctatggtgacacaaatcgccatgaccgatacaaccccgtttggccagcagagagtcttcaaggagaaagtggacacgcggacacccaaggcgaaaagaggcaccgcccaaattatggaagttaccgctaagtggctctgggggtttctgagccggaacaaaaagcctcgcatctgtacaagagaggagttcacgcggaaggtgcgctctaatgccgctattggagccgtctttgtggacgagaaccagtggaatagcgccaaagaggcggttgaagatgagagattctgggaccttgtgcatcgggaacgcgagctgcacaagcagggcaaatgcgctacctgcgtctacaacatgatggggaagagagagaaaaagctcggagagtttggcaaggccaaagggtcccgggccatctggtacatgtggctgggcgctcgcttcctggagttcgaagccctcggatttatgaatgaggatcactggttctctagagaaaacagcctgtccggcgtggagggggagggacttcataagctgggctatattctccgggacatctctaaaatccccgggggaaatatgtacgctgatgacacagccggctgggatacccgcattacagaagacgatctgcagaacgaggcgagaatcaccgacattatggaacctgagcacgcccttctggctaagagcatctttaaactcacatatcaaaataaggtcgtgcgggttcagcgccccgccaaaaacgggaccgtgatggatgtcatttccagacgggaccagagaggctctggacaggtgggcacgtacgggctgaataccttcacaaacatggaagctcaactgatccgccagatggagagcgagggaatcttttccccgagcgaactcgagacccctaacctggccgaacgggtgcttgattggctggagaagtatggcgttgaaagactcaagcgcatggcgatttctggggacgactgtgtggtcaaacccatcgatgaccggttcgccacagctctgaccgcccttaatgatatgggaaaggtgagaaaagacattcctcagtgggagccctccaagggctggaacgattggcagcaagttcctttttgcagccatcacttccaccagctgatcatgaaagacgggcgcgagattgtggtcccctgtcggaatcaggatgaactcgtgggcagagctcgcgtctctcagggagccggctggtccctgcgggagacggcttgcctgggaaagagctacgcccaaatgtggcagctcatgtattttcatagacgcgacctgcggcttgcggccaacgctatctgttccgccgtgccggttgattggattcctacatctagaaccacatggagcatccacgcccatcaccagtggatgaccacggaagacatgctgtccgtgtggaatcgggtctggatcgaggaaaacccctggatggaggataagacccatattagctcttggggagacgtgccctacctcggcaaaagagaggaccaatggtgcgggtccctgatcggacttacagctcgcgccacctgggcgacaaatattcaggttgctatcaaccaggtgcggagactgattggcaatgaaaactacctcgattatatgaccagcatgaagcgcttcaaaaatgagtctgaccctgaaggggccctgtggtga

SEQ ID NO: 19227 - RNA, 9879 nt, synthetic construct
  misc_feature 1..9879: note = derived and/or modified CDS sequence (opt5) from DENV-1__GU131792__SS-prME
  source 1..9879: mol_type = other RNA
agcgtgaccatgctgctgatgctgatgcccacagcccttgctttccacctgacgaccagaggaggggaacctcatatgatcgtcacaaagcaggaacggggaaaatccctcctgtttaagacctctgccggcgttaacatgtgcacacttattgcgatggacctgggggaactctgtgaagataccatgacatacaaatgcccgcgcatcaccgaggctgaacccgacgatgtggactgttggtgcaatgccacggatacctgggtgacatatggaacctgtagccagacaggcgagcacagacgggacaagcgctccgtcgccctggctcctcatgtggggctgggactcgagaccagaacggaaacatggatgtctagcgagggcgcctggaaacagattcagcgggttgaaccctgggctctgcgccaccctggcttcaccgtgatcgccctttttctggcgcatgccattgggacatccatcacccagaagggaatcattttcatcctcctgatgcttgtcaccccctctatggctatgagatgcgtgggcattgggagccgggcctttgttgagggactgtccggcgctacatgggtggatgtcgtgctcgagcacgggagctgtgtgacgaccatggccaaggacaaacctacactggatatcgaactgctcaagaccgaggtcacaaaccccgcggttctgcgcaaactttgcattgaagccaagatctctaataccacgacagactccagatgtcccacccaaggagaggctaccctgatggaagaacaagatgccacattcgtgtgccggcgcacctttgtggacagaggctggggcaacgggtgtggactcttcggcaaagggagcctgattacatgcgctaagtttaagtgcgtcacgaaacttgagggaaagatcgtgcagtacgaaaatctgaaatattctgttatcgtgaccgtccacacaggcgatcagcatcaagtggggaacgagtccaccgaacacggaacaaccgccacgattacccctcaggcccccacaagcgagatccagctccctgactacggcgctctgaccctggactgttctccccggacaggcctcgatttcaatgaaatggttctgcttaccatgaaggagaaatcctggctggtgcataagcagtggtttctcgacctgccgcttccttggacgagcggggcgtccacatctcaagagacctggaaccgccaggatctgctcgtcacattcaaaaccgcccacgctaagaagcaggaagtggtcgtgctgggaagccaagagggcgccatgcacaccgggctgacaggagccacggaaattcagacctccggcacaaccacaatctttgctgggcatctcaaatgcagactgaagatggacaaacttaccctgaagggcatgagctatgttatgtgtacgggatctttcaaactcgagaaggaagtggccgagacacagcacggcaccgtcctggtgcagattaagtacgaggggaccgatgcgccctgcaaaatccctttctccacacaagacgaaaagggagttacccagaatggccggctgatcacagctaaccccattgtgacggataaagagaagcccgtcaatatcgaagccgagcctccgtttggggagagctatattgtgatcggagccggcgaaaaagctcttaagctctcttggttcaagaaagggagctccattggcaagatgtttgaggccaccgctagaggagcccgccggatggcgatcctgggcgacacagcctgggatttcgggtctgtgggaggcgtttttaccagcgtcgggaaactggtgcatcagatcttcggaacagcttacggcgtgctcttttccggggtcagctggaccatgaagattggcatcggagtgctgcttacgtggctgggcctcaactctagatccaccagcctgtctatgacatgtattgccgttgggctggtgaccctttacctcggagtcatggtgcaggctgactccggctgcgttatcaattggaaagggcgcgaactgaagtgtggaagcggcattttcgggacaaacgaggtgcacacctggacagaacaatataagtttcaggccgattcccccaaacggctgtctgcggccatcggcaagccttgggaggagggagtctgcggcattagaagcgctacccgcctcgaaaatatcatgtggaaacagatctccaacgagctgaaccatattcttctggaaaatgacatgaagttcacggtggttgtgggggacgtcgtgggaatcctcgcccagggcaaaaagatgattcggccccaacctatggagcacaaatactcttggaaaagctgggggaaggctaagatcattggagccgatgtgcagaacacaacctttatcatcgacggccccaataccccggaatgtcctgatgaccagagagcctggaacatttgggaggtcgaggattatggcttcgggatctttacaaccaatatttggctgaagctgcgcgactcccacacgcaggtttgcgatcatcggcttatggctgcggccatcaaagacagaaaggctgtgcacgccgatatgggatactggattgaaagcgagaaaaacgaaccctggaagctcgcccgcgcttctttcatcgaggtgaagacatgtatctggcctaaatcccataccctgtggagcaatggcgtcctggaatctgagatgattatccccaagatttatgggggacctatctcccaacacaactaccggcccggctatttcacacagaccgccgggccgtggcacctcggaaaactggagcttgactttgatctgtgcgaaggcacaaccgtggttgtggacgagcattgcggcaatagagggcctagcctccggacgaccacagtcaccggaaagattatccacgaatggtgttgccgctcttgtacactgccgcccctgagattcaaaggcgaggatgggtgctggtacggaatggagatccggcctgtgaaggaaaaggaggaaaaccttgttaaaagcatggtgtccgcgggcagcggggaggtcgactctttttccctcggactgctgtgtattagcatcatgattgaagaggtgatgagatcccgctggtctcggaagatgctcatgaccggcacgctggctgttttccttctgctcatcatgggccagctgacatggaatgacctgattagactttgcatcatggtgggggccaacgccagcgatcgcatgggaatgggcaccacatacctggctctcatggccacctttaaaatgagaccgatgttcgcggtcgggctgctctttcggcgcctgacctccagagaggtgcttctgctcacaattggactgtctctggtggctagcgtcgaacttcccaattccctggaggaactcggcgacgggctggccatgggaatcatgatcctcaagctgcttacggatttccaatctcatcagctgtgggccaccctcctgagcctgacatttattaaaaccacactttccctgcactatgcttggaagaccatggccatggttctcagcatcgtgtctctgttccctctctgtctgtccacgacaagccagaagaccacctggcttcccgtgctgctgggctctctcggctgcaaacctctgacaatgtttcttattaccgagaacaagatctgggggcggaaatcctggcccctgaatgaaggaattatggctgtcggcgtggttagcatcctcctgtcttccctcctgaagaacgacgtgcctcttgccgggcccctgatcgcgggaggcatgctgattgcctgttacgtcatcagcgggtccagcgctgatctctctctggagaaagccgctgaggtgagctgggaagaggaagccgagcattccggagcctctcacaacattcttgttgaagtgcaggacgatggcacaatgaagatcaaagacgaggagcgcgatgacacgctgaccattctcctgaaggctacactcctggcggtcagcggcgtgtatccgctttccatccctgccaccctgttcgtctggtacttttggcaaaagaaaaagcagagatctggggtgctgtgggatacacccagccctcccgaagttgagcgggctgtgctcgacgatggaatctatcgcattatgcagagaggcctgcttgcccggtcccaggtcggggtgggagttttccaagaaaatgtgttccacaccatgtggcatgtcacgcgcggcgccgtgctgatgtaccaggggaaaagactcgagccgtcttgggctagcgtgaagaaagacctgatctcctatggaggcggctggcggctccaggggagctggaacaccggagaggaagttcaggtcattgccgtggagcctggcaagaatcccaagaacgtgcaaacagcgcctgggacctttaaaacacccgaaggagaggtcggcgctatcgccctggacttcaagcccgggacctctggatcccctattgtgaatagagaaggcaaaatcgttggcctttacgggaacggagtggtcacaacgagcggcacctacgtgtctgccattgctcaggccaaggcgtcccaggaggggccgctgcccgagatcgaagatgaggtttttcgcaaacggaatctgacaatcatggacctccaccctggaagcggcaagaccagacgctatctgcccgctattgtgcgggaagccatcaagagaaaacttcgcaccctgattctcgcccctacacgggtcgtggcttccgagatggccgaagctctgaaggggatgcccatcagataccaaacgaccgccgttaaatctgagcatacaggcaaggagattgtggatctgatgtgccacgcgaccttcacaatgcgcctccttagccctgtccgggtgccgaactataatatgatcatcatggacgaagcccattttaccgatccctccagcattgctgccagaggatacatctctacgcgggtgggcatgggggaggctgccgccattttcatgacagctacccctcccggatccgtcgaagcgtttcctcagagcaacgccgttatccaggacgaggaacgcgatattcccgagagatcttggaatagcggctatgagtggatcaccgacttcccggggaaaacagtgtggtttgtgccttccatcaagtctggaaacgatattgctaattgtctgcggaagaacggcaaacgcgtcatccagctgagcagaaagaccttcgacacagaataccagaaaaccaagaataacgattgggactatgtggttacgacagacatttccgagatgggggccaactttcgggccgatagagtgatcgacccccgccggtgcctcaaacccgtcattctgaaggatggccctgaaagagtgatccttgctggacccatgcctgttaccgtggcctctgcggctcagcgccggggcagaattgggcgcaatcacaacaaggagggagaccagtacatctacatgggccagccgctgaataacgatgaggaccacgcccattggacagaagccaaaatgctcctggataatatcaacacccccgaggggattatccctgctctgttcgaacccgagcgggaaaagagcgccgcgattgacggagagtatagactccgcggcgaggccagaaaaacgttcgtcgaacttatgcggcgcggggatctgcctgtgtggctgtcctacaaggtcgctagcgagggctttcaatattctgacagacggtggtgcttcgatggagaacgcaataaccaggtgctcgaggaaaatatggacgttgagatctggaccaaagagggcgaaagaaagaaactgcggcccagatggcttgatgcccgcacatactccgacccgctggctctccgggagtttaaggagttcgccgctgggagacgcagcgtgtccggagacctgattctggagatcggcaagctccctcagcaccttacccagcgggcccaaaacgcgctggataatctggtgatgctccataactctgaacaagggggcagagcctatcggcacgctatggaggagctgcccgacacaatcgaaacccttatgctgctcgccctgattgctgtcctgacaggcggcgttaccctctttttccttagcgggcgcggactgggcaaaacgtccatcgggctgctctgtgtgatggcctctagcgtgctgctttggatggcctccgtcgagcctcactggattgctgcgagcatcattctggaatttttcctcatggtgctgctgatccccgagcctgatagacagcggacaccccaggacaatcaactcgcctacgttgtgatcggacttctgtttatgattctgaccgtcgctgccaacgagatgggcctcctggaaaccacaaagaaagatcttgggatcggacatgtggccgtcgagaatcaccatcacgctaccatgctggacgtggatctccatccggcctctgcgtggacactgtatgccgttgctacgaccattatcacacctatgatgcgccacaccattgaaaacacaaccgccaacatctccctgacggctattgccaatcaggcggccatcctcatgggccttgacaagggctggcccatcagcaaaatggatattggggtgcccctgctggctctcggatgctactctcaggtcaaccctctgacccttacagccgctgtgctgatgctcgttgcccactacgctatcattggcccggggctgcaagccaaggcgaccagagaggcccagaagcggacagctgccggaatcatgaaaaatcccaccgtggacggcattgtcgctatcgatctggaccctgtggtgtatgatgccaagttcgaaaaacagctcgggcagatcatgcttctgattctgtgtacgtcccaaatcctcctgatgcgcacaacctgggccctttgcgagagcattacactggcgaccggacccctcaccacactgtgggagggctctcctggcaagttttggaacacgaccatcgctgttagcatggccaatattttcagagggtcctacctggctggagccggcctcgccttttctcttatgaaaagcctcgggggaggccggcgcgggacaggagctcagggcgaaaccctgggcgagaagtggaagagacagctcaaccagctgtccaaaagcgagttcaatatctataagcggtccgggatcatggaggtcgacagatctgaagccaaagagggacttaagcgcggcgagacaacccggcatgcggtgagcagagggacggccaaactgcgctggttcgtggaacggaacctcgtcaagcccgagggaaaggttattgacctgggctgtgggagaggaggctggtcctactattgcgctggcctgaaaaaggtgacagaagtgaaagggtacaccaagggaggccctgggcacgaggaaccgatccccatggccacctatggatggaatctcgtcaaacttcattctggcaaggatgtgtttttcacacctcccgagaaatgtgacaccctgctgtgcgatattggggagagctcccctaaccccacaatcgaagagggacgcacgctccgggttctgaagatggtggaaccgtggcttagaggcaatcaattttgtattaagatcctgaacccttacatgccctctgtcgtggagaccctcgagcagatgcagcgcaaacacggcgggatgctggttcggaatcccctgagcagaaactccacacacgaaatgtactgggtgagctgcggaaccggcaatattgtctctgctgtgaacatgacatcccgcatgctcctgaatcggttcaccatggcccatagaaagcctacgtatgagcgcgacgtggatcttggggcgggaaccagacacgtcgccgttgaacccgaggtggctaacctggacatcatcggccagcggattgaaaacatcaaacatgagcacaagagcacatggcattacgatgaggacaatccttataaaacctgggcctaccacgggtcttatgaagtgaagccgtccggaagcgcttcttccatggtcaacggcgtggttaagctcctgacaaaaccctgggatgtgattcctatggtcacccaaatcgccatgacagacaccacgccctttggccagcagcgcgtgttcaaggagaaagttgatacaagaacccctaaggctaaacgggggaccgcccaaattatggaagtgacagcgagatggctttggggatttctgagccggaataagaagccccgcatctgtacgagagaggagttcacccggaaagtccgctccaacgccgctatcggcgccgtgtttgttgacgagaatcagtggaacagcgctaaggaggccgtggaagacgagagattctgggatctcgtccagaaagaacgggagctgcacaagcaggggaaatgcgccacatgcgtgtacaatatgatgggaaagcgcgaaaagaaactgggcgagtttgggaaggcgaaaggctctagagctatttggtatatgtggctcggagcccggttcctggagtttgaagcccttggcttcatgaacgaggaccattggttcagccgcgaaaattccctgtctggggtcgagggagagggcctccacaagctggggtacatccttagagatattagcaaaatcccgggaggcaacatgtacgctgacgataccgccgggtgggacacacggattaccgaagatgacctgcaaaatgaggctaagatcacagatatcatggaacctgagcatgccctcctggcgacctccatttttaaactgacgtatcagaacaaggtggttcgcgtgcagagacccgccaagaatggcaccgtcatggacgtgatctctcggcgcgatcagagaggaagcggccaagtggggacatacggactcaacaccttcacaaatatggaagctcagctgattcggcagatggagtccgagggcatctttcttccttctgaactggagacccccaacctcgccgaaagagttctggactggcttgagaaatatggggtggaacgcctgaagcggatggctattagcggagatgactgtgtcgtgaaacctatcgacgatagattcgccacggcgctcacagccctgaacgacatgggcaaggttcgcaaagatatcccccagtgggagccgtccaaggggtggaatgactggcaacaggtgcctttttgcagccaccacttccatcagctgattatgaaggatggccgggagatcgtcgtgccctgtagaaaccaggacgaactcgtcggacgcgctcgggtgtctcaaggcgccgggtggtccctgagagagaccgcttgccttggaaaaagctacgcccagatgtggcagctgatgtattttcaccgccgggatctcagactggctgccaatgcgatttgttctgccgttcccgtggactgggtccctacatcccgcaccacgtggagcatccatgctcaccatcaatggatgaccacagaagatatgctttccgtgtggaaccgggtttggattgaggaaaatccgtggatggaggacaagacccacgtgtctagctggggcgatgtcccctacctggggaaaagagaggaccagtggtgcggatccctcatcggcctgacagcccgggccacctgggctagcaacattcaggtggccatcaatcaggtgagacgcctgatcgggaacgaaaattatctcgactacatgacatctatgaagcggttcaaaaacgagggcgatcctgaaggagcgctgtggtga

SEQ ID NO: 19228 - RNA, 9879 nt, synthetic construct
  misc_feature 1..9879: note = derived and/or modified CDS sequence (opt5) from DENV-1__HM488256__SS-prME
  source 1..9879: mol_type = other RNA
agcgtgaccatgctgctcatgctgatgcccacagcccttgctttccacctgacgaccagaggaggggaacctcatatgattgtctccaagcaggaacggggaaaatctctcctgtttaagacaagcgccggcgttaatatgtgcacccttattgccatggacctgggggagctctgtgaagatacaatgacctacaaatgcccgcgcatcacagagaccgaacccgacgatgtggactgttggtgcaatgctacggatacctgggtgacatatggaacctgttcccagacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagaacaagacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattacaccccaagctcctaccaccgagatccagctccccgactacggcgccctgacactggattgttctcctcggaccggcctcgacttcaacgaaatggtgctgcttacgatgaaggagaaatcctggctggtccataagcagtggtttctcgatctgccccttccgtggacaagcggggcctccacctctcaagagacatggaatcgccaggacctgctcgtgaccttcaaaaccgctcacgcgaagaagcaggaagtcgtggttctgggaagccaagagggcgccatgcacacagctctgacgggggccaccgaaattcagacatccggaaccacaaccatctttgccggccatctcaaatgcagactgaagatggataaacttacgctgaaggggatgagctatgtgatgtgtacaggctctttcaaactcgagaaggaactggctgagacccagcacggaaccgtcctggtgcagattaagtacgagggcacagacgccccttgcaaaatccccttctccacccaagatgaaaagggggttacacagaacggacggcttatcacggcgaatcctattgtgaccgacaaagagaagcccgtcaacatcgaagctgagcccccttttggcgagagctatattgtgatcggggccggagaaaaagccctcaagctgtcttggttcaagaaaggcagctccattgggaagatgtttgaggctacagccagaggcgctcgccggatggccatcctgggagcgccggcctgggatttcggctctatcgggggagtgtttaccagcgttggcaaactcgtccatcagattttcgggacagcttacggagtgctgttttccggcgtgagctggaccatgaagatcgggattggcgtccttctgacgtggctcggactcaattctagatccaccagcctgtctatgacatgtatcgccgtgggccttgttaccctctacctgggggtgatggtccaggctgactccggatgcgtgattaactggaaaggccgcgaactgaagtgtgggagcggaatcttcgttacaaatgaggtgcacacctggacagaacaatataagtttcaggccgattcccccaaacggctctctgcggccattggcaaggcttgggaggagggggtctgcggcatcagaagcgccacccgcctggaaaacatcatgtggaaacagatttccaacgagcttaatcatatcctgctcgaaaacgacatgaagttcacggtggttgtgggagacgtcgctggcattctggcccaggggaaaaagatgatccggcctcaacccatggagcacaaatactcttggaaaagctggggaaaggccaagattatcggcgctgatgtgcagaatacaacctttatcattgacgggcctaacacccccgaatgtccggatgaccagagagcgtggaatatctgggaggtggaggattatggattcggcatttttacaaccaacatctggctgaaacttcgcgactcctacacgcaggtctgcgatcaccggctcatgagcgccgctattaaagactctaaggccgttcatgccgatatgggctattggatcgaatccgagaaaaatgaaacatggaagctggctagagccagcttcatcgaggtgaagacctgtatttgggcgaaatctcacacactgtggtccaacggggtgctcgaaagcgagatgatcattcctaagatctacggaggccccatttctcaacataattatcgccctgggtacttcacccagacagctggaccctggcacctgggcaaacttgagctggactttgatctctgcgaagggaccacggtcgtggttgacgagcactgcggaaaccggggccctagcctgagaaccacaaccgtgacaggcaagatcatccatgaatggtgttgccggtcctgtaccctgcccccgcttcgcttcagaggggaggatggatgctggtacggcatggagattagccctgtcaaagaaaaggaggaaaatctcgtgaagtctatggtttccgccgggagcggagaggtggactccttttctctgggcctgctctgtatcagcattatgatcgaagaggtcatgcggtccagatggtctcgcaaaatgctgatgacggggacacttgccgtgttctttctgctcattgttggacagctgccctggaacgacctgatccggctttgcattatggtgggcgctaccgccagcgcgagaatgggcatggggacaacctccctggctctcatggccaccttcaagatgcgccccatgtttgccgtcggactgctgttcagacggctgacatctcgcgaggtgcttctgctcacgatcggcctgagcctggtggcttccgtcgaacttcctaatagcctggaggaactcggggatggactggccatgggcatcatgattctcaaactgcttaccgactttcaatctcaccagctgtgggctacactcctgtccctgaccttcatcaagacaacctttagccttcattatgcctggaaaacgatggcgatggggctgtctgttgtgtccctcttcccgctgtgtctcagcacaacctctcagaagaccacatggctgcccgtgcttctgggatccctgggctgcaagcctctcaccatgtttctgattgccgagaacaaaatctggggcagacggagctggccccttaatgaagggattatggctgtcggaatcgtgtccatcctgctcagctctctgctcaagaacgatgttcctctggccggcccccttattgctgggggaatgctgatcgcctgttacgtgattagcggctcctctgccgacctgagcctcgagaaagctgcggaggtctcctgggaagaggaagccgagcactctggggctagccataacatcctggtggaagttcaggatgacggaacaatgaagattaaagatgaggagcgcgacgatacgcttaccatcctgctcaaggccacactgctcgccgtgtccggcgtctatcctctgtctatccccgctacccttttcgtgtggtacttctggcagaagaagaagcagagaagcggcgtcctgtgggacacaccgtcccctcccgaagtggagcgggccgttctggatgacgggatttatcgcatcatgcagagaggactcctgggccggagccaggtgggggtcggagtgtttcaagaaaatgttttccacaccatgtggcacgtgacgcgcggcgcggtccttatgtaccaggggaaaagactggagccttcttgggcttccgtgaagaaagatctcattagctatggaggcggctggcggctgcaggggtcttggaacaccggagaggaagtgcaggttatcgccgtcgagcccggcaagaatccgaaaaacgtgcaaacagcccctgggacctttaagacacccgaaggagaggtgggcgctattgccctcgacttcaagcctgggacctccggaagccccatcgtcaatagagaaggcaaaattgtgggcctgtacgggaacggagttgtgacaacgtccggcacctacgtctctgcgatcgctcaggccaaggccagccaggaggggccccttcctgagatcgaagacgaggtgtttcgcaaacggaatctgacaattatggatctgcatccgggatccggcaagaccagacgctatctccccgctatcgttcgggaagccattaaaagaaagctgcgcacccttatcctggctcctacacgggtggtcgccagcgagatggcggaagccctcaaggggatgcccattagataccaaacgaccgctgtgaaatctgagcacacaggcaaggagatcgttgacctgatgtgccatgccaccttcacaatgcgcctgctctcccctgtgcgggtccccaactataatatgatcattatggatgaagctcactttaccgaccctagctctatcgccgccagaggatacattagcacgcgggtgggcatgggggaggctgcggccatcttcatgacagctaccccgcccggatccgtggaagcctttcctcagtctaacgccgtcattcaggatgaggaacgcgacatccccgagagaagctggaactccggctatgagtggatcaccgatttccctgggaaaacagtttggtttgtgccctctattaagagcggaaacgacatcgctaattgtcttcggaaaaacggcaagcgcgtgattcagctgtccagaaagaccttcgatacagaataccagaagaccaagaataacgactgggattatgtcgtgacgacagacatcagcgagatgggggccaacttccgggcggacagagttattgatccgcgccggtgcctgaaacctgtgatcctcaaggacggccccgaaagagtcattctggctggacccatgcctgtgaccgttgcctctgccgctcagcgccggggcagaatcgggcgcaatcataacaaagagggagatcagtacatctacatgggccagccccttaataacgacgaggatcacgcccactggacagaagcgaagatgctgctcgacaatattaacacccctgaggggatcattccggccctgtttgaacccgagcgggaaaagtccgctgccatcgatggagagtatagactgcgcggcgaggctagaaaaacgttcgtggaactcatgcggcgcggggaccttcctgtctggctgagctacaaggtggcctccgagggctttcaatattctgatagacggtggtgcttcgacggagaacgcaataaccaggtcctggaggaaaatatggatgtggagatttggaccaaagagggcgaaagaaagaaactccggcccagatggctggacgctcgcacatacagcgatcctcttgccctgcgggagtttaaggagttcgcggccgggagacgctccgtttctggagacctcatcctggagatcggcaaactgccccagcatctcacccagcgggctcaaaacgcccttgacaatctggtgatgctgcacaacagcgaacaagggggcagagcttatcggcatgccatggaggagctcccggatacaattgaaaccctgatgcttctggccctcatcgctgtgctgacaggcggcgtcaccctgtttttcctctccgggcgcggacttggcaagacgagcattgggctgctgtgtgttatggcgtcttccgtgctcctgtggatggccagcgtggagcctcactggatcgctgcctctattatccttgaatttttcctgatggtcctcctgatccccgagcctgacagacagcggacaccccaggataatcaactggcctacgtggttattggactcctttttatgatcctgaccgtggctgccaacgagatgggcctgctcgaaaccacaaagaaagacctggggattggacacgtcgcggtggagaatcatcaccatgccgctatgcttgatgtcgacctgcaccctgcctccgcttggaccctctatgccgtggcgacaacgatcattacccccatgatgcgccatacaatcgaaaacaccacagccaacattagcctgaccgctatcgccaatcaggctgccatcctgatgggcctcgataagggctggccgatttctaaaatggacatcggggttcctcttctggctctgggatgctacagccaggtgaaccccctcacgctgaccgccgcggtccttatgctggtggcccactacgctattatcggccccgggctccaagccaaggctacaagagaggcccagaaacggaccgccgcgggaattatgaagaatcctacagttgatggcatcgtggctatcgacctggatccggtcgtgtatgacgccaagttcgaaaaacagctggggcagattatgctccttatcctgtgtacctcccaaattctgctcatgcgcacgacatgggctctgtgcgagtctatcacccttgccacaggacccctgaccaccctctgggagggcagccctggcaagttttggaacacaacgattgccgtgtccatggctaatatcttcagagggagctacctggccggagcgggcctggccttctccctcatgaaatctcttgggggaggccggcgcgggaccggagctcagggcgaaacactgggcgagaagtggaaaagacagctgaaccagctcagcaagtccgaatttaatacctataagcggtctgggatcatggaggttgatagaagcgaagccaaagagggactgaagcgcggcgagacaaccaaacacgctgtctcccgggggacggccaaacttagatggttcgtggaacgcaacctggtgaaacccgagggaaaggtcattgacctcggctgtgggcggggaggctggtcttactattgcgcgggcctgaagaaagttacagaagtgaaggggtacaccaaaggaggccctgggcatgaggaacccatccctatggccacctatggatggaatctggtgaagctccacagcggcaaagacgtctttttcattccgcccgagaagtgtgatacacttctgtgcgacatcggggagtccagccctaaccccaccattgaagagggaagaacactgcgcgtgctcaaaatggttgaaccttggctgcggggcaatcaattttgtatcaagattcttaacccctacatgccgtctgtggtcgagacgctggagcagatgcagagaaagcatggcgggatgctcgtgcgcaatcctctgtcccggaacagcacccacgaaatgtactgggtttcttgcggaacaggcaatatcgtgtccgctgtcaacatgaccagcagaatgctgctcaatcgcttcacaatggcccaccggaaacccacctatgagagagatgtggacctgggggctggaacgcgccatgtggccgtcgaacccgaggttgctaaccttgatatcattggccagagaatcgaaaacattaagcacgagcataaatctacctggcactacgacgaggataatccttataagacatgggcctaccatgggtcctatgaagtgaaacccagcggatccgcgagctctatggtgaacggcgtcgtgaagctgctcaccaagccttgggacgttatcccgatggtgacacaaattgccatgaccgatacaaccccctttggccagcagcgggtcttcaaagagaaggtggacacgcgcacacctaaagctaagagagggaccgcccaaatcatggaagttaccgctaaatggctgtggggatttcttagccggaataagaagcccagaatctgtacacgggaggagttcacgcgcaaagtgagatccaacgccgccattggcgcggtctttgtggatgagaatcagtggaactctgctaaggaggccgttgaagacgagcggttctgggacctggtgcaccgcgaaagagagctccacaaacaggggaagtgcgcgacctgcgtctacaatatgatgggaaaacgggaaaagaagctgggcgagtttgggaaagctaagggcagccgcgccatctggtatatgtggctgggagctagattcctcgagttcgaagccctgggctttatgaacgaggatcattggttctcccgggaaaattctcttagcggggtggagggagagggcctgcacaaactcgggtacattctgcgcgacatctccaagattcctggaggcaacatgtacgcggatgacacagccgggtgggataccagaatcacagaagacgatcttcagaatgaggctcggatcaccgacattatggaacccgagcatgccctgctcgctaaatctatctttaagctgacatatcaaaacaaagtcgtgcgcgttcagagaccggccaagaatggcaccgtgatggatgtcattagccggcgcgaccagagaggatccggccaggtggggacgtacggactgaacaccttcacaaatatggaagcgcaactcatccggcagatggagagcgagggcatcttttctccttccgaactggagacccccaaccttgccgaaagagtgctggattggctcgagaagtatggggttgaacgcctgaaacggatggctatcagcggagacgattgtgtggtcaagcctatcgacgacagattcgccacagctcttaccgccctgaacgatatgggcaaagtgcgcaaggacattccccagtgggagccttctaaagggtggaatgattggcagcaagttcccttttgctcccaccacttccatcagctcatcatgaaggacggccgggagattgtggtcccgtgtagaaaccaggatgaactggtgggacgcgctcgggtcagccagggcgccgggtggtccctgagagagacggcgtgcctcggaaagtcttacgcccaaatgtggcagctgatgtattttcaccgccgggaccttagactggctgccaatgccatctgtagcgctgtgcctgttgattggattcccacatcccgcaccacatggagcatccatgcccaccatcagtggatgaccacggaagacatgctctctgtgtggaaccgggtctggattgaggaaaatccctggatggaggataaaacccacatctccagctggggcgacgtgccttacctggggaagagagaggatcaatggtgcggatctcttatcggcctgacagcgcgggctacctgggccacaaacattcaggttgccatcaatcaggtgagacgcctcattgggaacgaaaattatctggactacatgaccagcatgaaacggttcaagaacgagtccgacccggaaggcgctctgtggtga

SEQ ID NO: 19229 - RNA, 9879 nt, synthetic construct
  misc_feature 1..9879: note = derived and/or modified CDS sequence (opt5) from DENV-1__GU131793__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctaccacacagaagggaatcatcttcattctcctgatgcttgtcacgcctagcatggccatgagatgcgtgggcatcgggtcccgggattttgttgagggactgagcggcgctacctgggtggacgtcgtgctcgagcacgggtcttgtgtgacaaccatggccaaggataaacccacactggacattgaactgctcaagaccgaggtcacgaaccctgctgttctgcgcaaactttgcatcgaagccaagatttccaatacaaccaccgatagcagatgtccgacacaaggagaggcgaccctggtggaagagcaggacgccaacttcgtgtgccggcgcacatttgtcgatagaggctggggcaatgggtgtggactcttcggcaaagggtctctgatcacgtgcgctaagtttaagtgcgtgaccaaacttgagggaaagattgttcagtacgaaaacctgaaatattccgtgatcgtcacagtgcacaccggcgaccagcatcaagttgggaatgagagcacagaacacggaaccacggccaccatcacaccccaggctcctaccacagagattcagctcaccgactacggcgccctgacgctggattgttctccccggacaggcctcgacttcaacgaaatggtgctgcttaccatgaaggagaaatcctggctggtccataagcagtggtttctcgatctgcctcttccctggacaagcggggcctccacctctcaagagacctggaatcgccaggacctgctcgtgacattcaaaacggctcacgcgaagaagcaggaagtcgtggttctgggaagccaagagggcgccatgcacaccgctctgacaggggccaccgaaatccagacatccggaaccacgacaatttttgccggccatctcaaatgcagactgaagatggataaacttaccctgcgggggatgagctatgtgatgtgtaccggctctttcaagctcgagaaagaagtcgctgagacacagcacggaaccgtgctggttcagatcaagtacgagggcacagacgccccgtgcaagattcctttctccacgcaagatgaaaaaggggtgacccagaacggaagactgatcacagcgaatcccatcgtcaccgacaaggagaaacctgtgaacattgaagctgagcccccctttggcgagagctatatcgtgattggggccggagaaaaggcccttaaactctcttggttcaagaagggcagctccatcgggaaaatgtttgaggctacagcccgcggcgctcggagaatggccattctgggagataccgcgtgggacttcggctctatcgggggagtttttacgagcgtcggcaagctggtgcatcagatcttcgggaccgcctacggagtgctcttttccggcgtcagctggacaatgaaaattgggatcggcgtgctgcttacctggctgggactcaattctcgctccacaagcctgtctatgacctgtattgctgttggcctggtgacactttacctcggggtcatggtgcaggccgattccggatgcgttatcaactggaagggccgggaactgaaatgtgggagcggaattttcgtgaccaatgaggtccacacgtggacagaacaatataagtttcaggctgactcccctaagagactgtctgccgcgatcggcaaagcctgggaggagggggtgtgcggcattcgcagcgctacccggctcgaaaacatcatgtggaagcagatctccaacgagctgaatcatattcttctggaaaacgacatgaaattcaccgttgtggtcggagatgtggccggcatcctcgctcaggggaagaaaatgattagaccgcaacccatggagtacaagtattcttggaaaagctggggaaaggccaagatcattggcgccgacgtgcagaatacaacctttatcatcgatgggcctaacacgcccgaatgtcctgacgatcagcgcgcttggaatatttgggaggtcgaggactacggattcggcatctttacaaccaacatttggctgaaactgcgggattcctatacacaggtttgcgaccacagacttatgagcgcggccatcaaggattctaaagctgtgcacgccgacatgggctactggattgaatccgagaagaatgaaacctggaaactcgcccgcgctagcttcatcgaggtgaagacatgtatctggcccaagtctcataccctgtggtccaacggggtcctggaaagcgagatgattatcccgaaaatttatggaggccctatctctcaacacaattaccggcccgggtacttcacgcagaccgccggaccttggcatctcggcaagctggagcttgattttgacctgtgcgaagggacaaccgtggttgtggatgagcactgcggaaacagaggccccagcctccggacaaccacggtcacaggcaaaattatccacgaatggtgttgccgctcctgtaccctgcctcccctgagattccggggggaggacggatgctggtatggcatggagatcagaccggtgaaggaaaaagaggaaaatcttgttaagagcatggtgtctgcggggtccggagaggtcgacagcttttccctcggcctgctgtgtatttctatcatgattgaagaggtgatgcgcagccggtggtccagaaagatgctcatgacagggaccctggctgttttctttcttctgatcatgggacagctcacctggaacgatctgattcgcctgtgcatcatggtgggcgccaatgcctctgacagaatgggcatggggacaacgtaccttgctctgatggccaccttcaaaatgcggcctatgtttgcggtcggactcctgttccgcagactcacaagccgggaggtgctgcttctgaccattggcctctccctggtggcttctgtcgaactgcccaacagccttgaggaactgggggatggactcgccatgggcatcatgatcctgaagctcctgacagactttcaatcccatcagctttgggccaccctgctcagcctgacgttcattaaaacaaccttttctctgcactgtgcttggaagaccatggccatggttctttccatcgtgagcctgttccccctctgcctgtctacaacctcccagaaaacaacgtggctccctgtgctgcttgggagcctgggatgtaagccgctgaccatgtttctcattgctgagaataagatctggggccgcagatcttggcccctgaacgaaggcattatggccgtcgggatcgtgtccatccttctgagctccctcctgaaaaacgatgttcctctcgcgggacccctgattgccggcgggatgcttatcgcttgctatgtgattagcggatctagcgccgacctgtccctggagaaggctgccgaggtctcttgggaagaggaagccgagcatagcggcgcttcccacaatatcctcgtggaagttcaggatgacgggacaatgaaaattaaggatgaggagcgggacgataccctgacaatccttctgaaagcgaccctcctggccgtgtctggagtctaccctctcagcatccccgctacgctgttcgtgtggtatttctggcaaaagaaaaagcagcgctccggcgtcctttgggacaccccttctcccccggaagtggagagagccgttctggatgacggcatttaccggatcatgcagcgcgggctgctcggaagaagccaggtgggcgtcggggtgtttcaagaaaacgttttccatacaatgtggcacgtgacccggggagccgtcctgatgtatcagggcaagagacttgagccttcctgggctagcgtgaaaaaggacctgatttcttacgggggaggctggcgcctccagggctcctggaatacaggggaggaagtgcaggttatcgccgtcgagcccggaaaaaaccctaagaatgtgcaaaccgcgcccggcacatttaaaacgccggaaggggaggtgggagctattgccctggatttcaagcctggcaccagcgggtctcccatcgtcaaccgggaaggaaagattgtgggcctctacggcaatggggttgtgacaacctccggaacctatgtcagcgccatcgctcaggccaaagcgtcccaggagggccctctgcccgagatcgaagacgaggtgtttagaaagcgcaaccttacaattatggatctgcaccccgggtctggaaaaacgcggagatacctgcctgctatcgttcgcgaagccattaagcggaaactcagaaccctgatccttgccccgacacgcgtggtcgctagcgagatggccgaagctctgaagggcatgcccattcggtatcaaaccacagccgtgaagtccgagcataccgggaaagagatcgttgacctcatgtgtcacgcgacgttcacaatgagactgctgagccctgtgcgggtccccaattacaacatgatcattatggatgaagcccattttaccgacccttcttccatcgctgcccgcggctatattagcaccagagtgggaatgggcgaggctgccgccatcttcatgacagctaccccccctgggtctgtggaagcgtttccgcagagcaatgccgtcattcaggatgaggaacgggacatccccgagcgctcctggaactctggatacgagtggatcacagatttccctggcaagaccgtttggtttgtgcccagcattaaatccgggaatgacatcgctaactgcctcagaaagaatggaaaacgggtgattcagctttctagaaagacgttcgatacagaatatcaaaagaccaaaaacaacgactgggactacgtcgtgacaaccgatatcagcgagatgggcgccaatttccgcgccgaccgggttattgatcctagacgctgcctgaagcccgtgatcctgaaagacgggccggaacgggtcattctcgctggccctatgcccgtgacggttgcctccgcggctcagagacgcggacggatcggcagaaaccacaataaggagggggatcagtacatctatatgggacagcccctgaacaatgacgaggatcatgcccactggaccgaagccaaaatgcttctggacaacattaatacacctgagggcatcattcccgctctctttgaacctgagcgcgaaaagagcgccgcgatcgatggggagtacagactgcggggagaggcccgcaagaccttcgtggaactgatgagacggggcgacctcccggtctggctttcttataaagtggcttccgaggggtttcaatacagcgatcgcagatggtgtttcgacggcgaacggaacaatcaggtcctggaggaaaacatggatgtggagatttggacaaaggagggagaaagaaaaaagctgcgcccccggtggctcgacgccagaacctattccgaccctctggctcttcgcgagtttaaagaattcgccgctggccggagatctgttagcggggatctgatcctcgagatcggaaagctgccccagcacctgacacagcgggcccaaaatgcgctcgacaaccttgtgatgctgcataattccgaacagggcgggcgcgcctacagacacgctatggaggagctgcctgataccattgaaacgctcatgctgcttgccctgatcgctgtgctcacaggaggcgtcaccctgtttttcctgtctggccgggggctcggaaaaaccagcattggccttctgtgcgttatggcctccagcgtgctgctctggatggcctctgtggagccccattggatcgctgcgtccattatcctggaatttttccttatggtcctgctcatcccggagcctgacaagcagcgcacaccccaggataaccaactggcctatgtggttattgggctgctctttatgatccttaccgtggctgccaatgagatgggactgctggaaacaacgaagaaagacctcggcattgggcacgtcgccgtggagaaccaccatcacgctgccatgctggatgtcgaccttcatcctgcgagcgcctggaccctgtacgctgtggccacaaccatcattacacccatgatgagacacaccatcgaaaacacgaccgctaatatttctctcacagccatcgcgaaccaggccgctatcctgatgggactggataagggctggcctatttccaaaatggacatcggcgttcccctccttgccctggggtgttacagccaggtgaatccgctgaccctcacagctgccgtcctgatgcttgtggctcattatgccattatcggacctggcctgcaagcgaaggccacccgggaggctcagaaacgcacggccgctgggattatgaagaaccccacagttgatggaatcgtggccatcgacctcgatcccgtcgtgtacgacgccaagttcgaaaaacagctgggccagattatgctgctcatcctttgcacctctcaaattctgctgatgagaacaacctgggcgctctgtgagagcatcaccctggctacagggcctcttacgaccctgtgggagggatccccgggcaagttttggaatacaaccattgccgtgtctatggctaacatcttccggggcagctatctcgccggggccggactggctttctccctgatgaaaagcctcggcgggggacgcagaggcacaggggcccagggagaaacccttggcgagaagtggaaacggcagctgaatcagctgtccaagtctgaatttaacacgtacaagagaagcggcatcatggaggttgaccgctccgaagcgaaagaggggctcaagcggggagagacaaccaaacacgccgtctctagaggcaccgctaagctgcgctggttcgtggaacggaatcttgtgaaacccgaggggaaggtcattgatctgggatgcggcagagggggatggagctattactgtgccggcctcaagaaagttacagaagtgaagggctataccaaagggggacctggccacgaggaacccatccctatggctacatacgggtggaacctggtgaagctgcattccggaaaagacgtctttttcattccccctgagaagtgcgatacgctcctttgtgacatcggcgagtctagcccgaatcccaccattgaagaggggcgcacactgcgggtgctgaaaatggttgaaccttggctcagaggaaaccaattttgcatcaagattctgaatccctacatgccttccgtggtcgagacccttgagcagatgcagcgcaagcacggcggcatgctggtgcggaaccccctcagcagaaattctacacatgaaatgtattgggtttcctgtgggaccggaaacatcgtgagcgccgtcaatatgacgtctcgcatgctgctgaaccggttcaccatggcgcacagaaaaccgacatacgagcgcgatgtggacctcggcgccgggaccagacacgtggctgtcgaacctgaggttgccaacctggatatcattggacagcggatcgaaaatattaagcatgagcacaaatccacatggcattatgacgaggataacccctacaagacctgggcttatcacggcagctacgaagtgaaaccctctgggtccgccagctccatggtgaatggagtcgtgaagcttctgacaaagccttgggacgttatccccatggtgacccaaattgctatgacggatacaaccccttttggccagcagcgcgtcttcaaagagaaggtggacaccagaacaccgaaagccaagcggggcacggcgcaaatcatggaagttaccgccaaatggctctgggggtttctgagcagaaacaagaagccccggatctgcacacgcgaggaattcaccagaaaagtgcggtctaatgctgccattggagctgtctttgtggacgagaaccagtggaatagcgccaaggaggccgttgaagatgagcgcttctgggaccttgtgcatagagaacgggagctgcacaaacagggcaagtgcgcgacatgtgtctataacatgatggggaaacgcgaaaagaagctcggagagtttggcaaagctaaggggtccagagccatctggtacatgtggctgggcgcccggttcctggagttcgaagctctcggatttatgaatgaggatcactggttctctcgcgaaaacagcctgtccggcgtggagggggagggacttcataaactgggctacattctcagagacatctctaagattcctgggggaaatatgtatgccgatgacaccgctggctgggatacacggatcaccgaagacgatctgcagaacgaggcccgcatcacggacattatggaacccgagcacgcgcttctggccaaaagcatctttaagctcacctaccaaaataaagtcgtgagagttcagcggcctgctaagaacgggacagtgatggatgtcatttcccgcagagaccagcggggctctggacaggtgggcacctatgggctgaatacattcaccaacatggaagcccaactgatcagacagatggagagcgagggaattttttcccccagcgaactcgagacgccgaacctggctgaacgcgtgcttgattggctggagaagtacggcgttgaacggctcaaaagaatggccatctctggggacgactgcgtggtcaagcctatcgatgaccgcttcgcgacagccctgaccgctcttaatgatatgggaaaagtgcggaaggacattccccagtgggagccttccaaaggctggaacgattggcagcaagttcccttttgtagccatcacttccaccagctgatcatgaaggacgggagagagattgtggtcccttgccgcaatcaggatgaactcgtgggccgggccagagtctctcagggagctggctggtccctgcgcgagacagcctgtctggggaagagctatgctcaaatgtggcagctcatgtactttcatcggagagacctgcgccttgccgcgaacgccatctgctccgctgtgcccgttgattggattccgacctctcggacgacctggagcatccacgcccatcaccagtggatgacaaccgaagacatgctgtccgtgtggaatagagtctggattgaggaaaacccttggatggaggataaaacacatatcagctcttggggagacgtgccctatctcggcaagcgggaggaccaatggtgtgggtccctgatcggacttaccgccagagctacatgggccaccaatattcaggttgcgatcaaccaggtgcgccggctgattggcaatgaaaactacctcgattacatgacgagcatgaaaagattcaagaatgagtctgaccccgaaggggctctgtggtga

SEQ ID NO: 19230 - RNA, 9879 nt, synthetic construct
  misc_feature 1..9879: note = derived and/or modified CDS sequence (opt5) from DENV-1__GU131794__SS-prME
  source 1..9879: mol_type = other RNA
agcgtgacaatgctgctgatgctgatgcccacagcccttgctttccacctgacgacccggggaggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacaaaccctgccgttctccgcaaactgtgcattgaagcgaagatctccaataccacgacagatagcagatgtccgacccaaggagaggccacccttgtggaggaacaggacgctaactttgtgtgccggcgcacattcgtcgatagaggctggggcaatgggtgtggactgtttggcaaagggtctctcattacctgcgccaagttcaagtgcgtgacaaaactggagggaaagatcgttcagtacgaaaaccttaaatattccgtgatcgtcacggtgcacaccggcgaccagcatcaagttgggaatgagagcacagaacacggaaccacagctaccattacgccccaggccccttctaccgagatccagctgacagactacggcgccctcaccctggattgtagcccccggacaggcctggactttaacgaaatggtgctcctgaccatgaaggagaaaagctggcttgtccataagcagtggttcctggatctccctctgccctggacgtccggggcttctacaagccaagagacctggaatcgccaggaccttctggtgacatttaaaaccgcgcacgccaagaagcaggaagtcgtggttctcggatcccaagagggcgctatgcacaccgccctgacaggggccacggaaattcagaccagcggaacaaccacaatcttcgctggccatctgaaatgcagactcaagatggataaactgacccttaaggggatgtcttatgtgatgtgtacgggctccttcaaactggagaaggaagtcgccgagacacagcacggaaccgtgctcgttcagattaagtacgagggcaccgacgcgccgtgcaaaatcccttttagcacacaagatgaaaagggggtgacccagaacggacggctgatcacagctaatcccattgtcacggacaaagagaagcctgtgaacatcgaagccgagccgcccttcggcgagtcttatattgtgatcggggccggagaaaaagctctgaaacttagctggtttaagaaaggctcctctattgggaagatgttcgaggccaccgctagaggcgcccgccggatggcgatcctcggagatacagcctgggactttggcagcatcgggggagttttcacctccgtcggcaaactggtgcatcagatttttgggacagcttacggagtgctgttcagcggcgtctcttggaccatgaagatcgggattggcgtgctcctgacgtggcttggactcaattccagaagcacctctctctccatgacatgtatcgccgttggcctggtgaccctgtaccttggggtcatggtgcaggctgatagcggatgcgttattaactggaaaggccgcgaactcaagtgtgggtccggaatctttgtgacaaatgaggtccacacctggacagaacaatataagttccaggccgactctcctaaacggctgagcgcggccattggcaaggcttgggaggagggggtgtgcggcatcagatccgccacccgcctggaaaacatcatgtggaaacagatttctaacgagctcaatcatatcctgcttgaaaacgacatgaagctgacggttgtggtcggagatgtggctggcattctcgcccaggggaaaaagatgatccggccgcaacccatggagtacaaatatagctggaagtcctggggaaaggccaaaattatcggcgctgacgtgcagaatacaacctttatcattgatgggcctaacacccccgaatgtcctgacgatcagagagcgtggaatatctgggaggtcgaggactacggattcggcatttttacaaccaacatctggctgaagctgcgcgatagctatacgcaggtttgcgaccaccggcttatgtctgccgctattaaagattccaaggccgtgcacgccgacatgggctactggatcgaaagcgagaaaaatgaaacatggaagctcgctagagcctctttcatcgaggtgaagacctgtatttggcccaaatcccatacactgtggagcaacggggtcctggaatctgagatgatcattccgaagatctatggaggccctattagccaacacaattaccgccccgggtacttcacccagacagcgggaccttggcatctcggcaaactggagcttgattttgacctgtgcgaagggaccacggtggttgtggatgagcactgcggaaaccggggcccctccctcagaaccacaaccgtcacaggcaagatcatccacgaatggtgttgccggagctgtaccctgcctcccctgcgcttcaaaggggaggacggatgctggtatggcatggagattagaccggtgaaggaaaaggaggaaaatcttgttaaatctatggtgtccgctgggagcggagaggtcgactccttttctctcggcctgctgtgtatcagcattatgatcgaagaggtgatgcggtccagatggtctcgcaagatgctcatgacggggacactggccgttttctttcttctgattatgggacagctcacctggaacgatctgatccggctgtgcattatggtgggcgccaatgctagcgacagaatgggcatggggacaacctaccttgccctgatggcgaccttcaaaatgcgccctatgtttgctgtcggactcctgttcagacggctcacatcccgcgaggtgctgcttctgacgatcggcctctctctggtggccagcgtcgaactgcccaactcccttgaggaactgggggatggactcgccatgggcatcatgattctgaagctcctgaccgactttcaaagccatcagctttgggctacactgctctctctgaccttcatcagaacaaccttttccctgcactatgcctggaaaacgatggctatggttcttagcattgtgtctctgttccccctctgtctgtccacaaccagccagaagaccacatggctccctgtgctgcttgggtctctgggatgcaagccgctgaccatgtttctcatcgccgagaataaaatttggggccggaagtcctggcccctgaacgaaggcatcatggcggtcgggatcgtgagcattcttctgtccagcctcctgaaaaacgatgttcctctcgccggacccctgatcgctggcgggatgcttattgcctgttacgtgatctctggaagctccgctgacctgtctctggagaaggccgccgtcgtgagctgggaggaagaggctgaacattccggcgcgtctcacaatattctcgttgaggtgcaggatgacgggacaatgaaaatcaaggatgaagaaagagacgatacgctgaccatccttctgaaagccacactcctggctgtcagcggagtgtatcctctctccattcccgccaccctgttcgtctggtacttctggcaaaagaagaaacagagatctggcgtgctttgggacacaccttcccctcccgaggttgaacgggccgtgctggatgacggcatctatcgcattatgcagagagggctgctcggacggtcccaggtcggcgtgggggtttttcaagagaacgtgttccataccatgtggcacgtcacgcgcggagctgtgctgatgtaccagggcaagagacttgaacccagctgggcctctgtgaaaaaggacctgatctcctacgggggaggctggcggctccagggcagctggaataccggggaggaggttcaggtcattgcggtggaacccggcaagaatcctaagaatgtgcaaacagctcccggcacctttaagacatctgagggggaagtcggagccatcgccctggatttcaaaccgggcacctccgggagccctattgtgaacagagagggaaagatcgttggcctctatggcaatggggtggtcacaacgtccggaacctacgtgtctgctatcgcccaggcgaaagctagccaggaaggccccctgcctgagattgaggacgaagtttttcgcaagcggaaccttacaatcatggatctgcaccccgggtccggaaaaaccagacgctatctgcccgccattgtgcgggaggccatcaagagaaagctccgcaccctgattcttgctcctacacgggtcgtggccagcgaaatggctgaggccctgaaaggcatgccgatcagataccaaacgaccgcggttaagtctgaacatacagggaaagagatcgtggacctcatgtgccacgccaccttcacaatgcgcctgctgtcccccgtccgggtgcctaattataacatgattatcatggatgaggctcattttaccgaccccagctctattgccgctagaggctacatcagcacgcgggtgggaatgggcgaagccgccgctattttcatgacagcgacccctcccgggtccgtcgaggcctttcctcagtctaatgctgttatccaggatgaggaacgcgacatcccggaaagaagctggaactccggatatgagtggattaccgatttccccggcaagacagtgtggtttgtgccttctatcaaaagcgggaatgacattgccaactgtctccggaagaatggaaagcgcgtcatccagctttccagaaaaaccttcgatacagagtaccaaaagaccaaaaacaacgactgggactacgtggttacgacagatattagcgaaatgggcgccaatttccgggctgacagagtgatcgatccccgccggtgcctgaagcctgtcattctgaaagacgggcccgagagagtgatcctcgccggcccgatgcctgttaccgtggcgtctgctgcccagcgccggggaagaatcggccgcaaccacaataaggaaggggatcagtatatttacatgggacagcccctgaacaatgacgaggatcatgcccactggacagaggctaagatgcttctggacaacatcaatacccccgaaggcattatccctgccctctttgagcccgaacgggagaaatccgcggccattgatggggaatatagactgcgcggagaggctagaaagacgttcgtcgagctgatgcggcgcggcgacctccctgtgtggcttagctacaaagtcgcctccgaagggtttcaatattctgatagacggtggtgcttcgacggcgagcgcaacaatcaggtgctggaagagaacatggatgttgaaatctggaccaaggagggagagcgcaagaagctgcggccgagatggctcgacgctcgcacatacagcgaccccctggcccttcgggaatttaaagagttcgctgccggcagacgctccatctctggggatctgattctcgaaatcggaaagctgcctcagcacctgacccagcgggcgcaaaatgccctcgacaaccttgtgatgctgcataatagcgagcagggcgggagagcttatcggcacgccatggaggaactgcccgatacaattgagaccctcatgctgcttgctctgatcgccgtgctcacaggaggcgtcaccctgtttttcctgtccggccgcgggctcggaaagacgagcattggccttctgtgtgttatggcctcttccgtgctgctctggatggctagcgtggaacctcattggatcgcggcctctatcattctggagtttttccttatggtcctgctcatccccgaaccggacagacagcggacacctcaggataaccaactggcttacgtggttattgggctgctctttatgatccttaccgtggccgccaatgagatgggactgctggagaccaccaagaaggacctcggcattgggcacgtcgctgtggaaaaccaccatcacgccgcgatgctggatgtcgaccttcatcccgcctccgcttggaccctgtacgccgtggctacaacgatcattacccctatgatgcgccacacaatcgagaacaccacagccaatatcagcctcaccgcgattgccaaccaggctgccatcctgatgggactggataaaggctggcccatttctaagatggacatcggcgttcctctccttgctctggggtgctatagccaggtgaatcccctgacgctcaccgccgctgtcctgatgcttgtggcccattacgcgattatcggaccgggcctgcaagccaaagctacaagagaagcccagaagcggaccgctgccgggatcatgaagaaccctacagttgatggaattgtggccatcgacctcgatcccgtcgtgtatgacgcgaaattcgagaagcagctgggccagattatgctgctcatcctttgtacctcccaaattctgctgatgcgcacgacatgggctctctgcgaatctatcaccctggccacagggccccttaccaccctgtgggagggaagccctggcaaattttggaatacaacgatcgctgtgtccatggccaacattttcagaggcagctacctcgccggggctggactggccttctccctgatgaagtctctcggcgggggacggcgcggcaccggggcgcagggagagacacttggcgaaaaatggaagagacagctgaatcagctgagcaagtccgagtttaacacctataaacggtctggcatcatggaagttgacagaagcgaggccaaggaagggctcaaacgcggagagacaaccaagcacgctgtctcccggggcacggccaaactgagatggttcgtggagcgcaatcttgtgaagccggaagggaaggtcattgatctgggatgtggcagagggggatggtcttactattgcgctggcctcaaaaaggttacagaggtgaaaggctacaccaaagggggacccggccacgaggagcctatccccatggccacctacgggtggaacctggtgaaactgcatagcggaaaggacgtctttttcattcctcccgaaaaatgtgatacactcctttgcgacatcggcgagtccagccctaatccgaccattgaggaagggagaacactgcgcgtgctgaagatggttgagccctggctccggggaaaccaattttgtatcaagatcctgaatccttatatgccctctgtggtcgaaacgcttgagcagatgcagagaaaacacggcggcatgctggtgcgcaaccctctctcccggaatagcacccatgagatgtactgggtttcttgcgggacaggaaacattgtgtccgcggtcaatatgaccagcagaatgctgctgaaccgcttcacaatggcccaccggaagcccacctatgaaagagatgtggacctcggcgctgggacgcgccacgtggccgtcgagccggaagttgctaacctggatatcattggacagagaatcgagaatattaaacatgaacacaagtctacctggcattacgacgaggataacccttataaaacatgggcctaccacggctcctatgaggtgaagcccagcgggtccgctagctctatggtgaatggagtcgtgaaacttctgaccaaaccctgggacgttatccctatggtgacacaaatcgccatgaccgatacaaccccctttggccagcagcgggtcttcaaggaaaaagtggacacgcgcacacctaaggcgaaaagaggcaccgcccaaattatggaggttaccgctaagtggctctgggggtttctgagccggaacaagaaaccgagaatctgtacacgggaagagttcacgcgcaaggtgagatccaatgccgctattggagccgtctttgtggacgaaaaccagtggaactctgccaaagaggcggttgaggatgaacggttctgggaccttgtgcatcgcgagagagaactgcacaagcagggcaaatgcgctacctgcgtctacaacatgatggggaagcgggagaagaaactcggagaatttggcaaggccaaagggagccgcgccatctggtacatgtggctgggcgctagattcctggagttcgaggccctcggatttatgaatgaagatcactggttctcccgggagaactctctgagcggcgtggaaggggagggacttcataagctgggctatattctccgcgacatctccaaaatccccgggggaaatatgtacgctgatgacacagccggctgggataccagaattacagaggacgatctgcagaacgaagcgaagatcaccgacattatggagcctgaacacgcccttctggctaaatctatctttaagctcacatatcaaaataaggtcgtgcgggttcagcgccccgccaaaaacgggaccgtgatggatgtcattagcagacgggaccagcgcggctccggacaggtgggcacgtacgggctgaataccttcacaaacatggaggctcaactgatcagacagatggaaagcgagggaatcttttctccttccgagctcgaaacccccaacctggccggccgggtgcttgattggctggagaagcatggggttgaaagactcaaacgcatggcgattagcggagacgactgtgtggtcaagccgatcgatgaccggttcgccacagctctgaccgcccttaatgatatgggcaaagtgagaaaggacattcctcagtgggagccctctaaggggtggaacgattggcagcaagttcctttttgctcccaccacttccatcagctgatcatgaaagacggccgcgaaattgtggtcccctgtcggaatcaggatgagctcgtgggcagagctcgcgtcagccagggagccgggtggtccctgcgggagacggcttgcctgggaaagtcttatgcccaaatgtggcagctcatgtactttcacagacgcgacctgcggcttgcggccaacgctatctgtagcgccgtgcctgttgattgggtgcccacatccagaaccacatggagcattcatgcccaccatcagtggatgaccacggaagacatgctgtctgtctggaatcgcgtgtggatcgaggaaaacccgtggatggaggataaaacccacatctccagctggggcgacgttccttatctcgggaagcgggaagaccaatggtgcggatctctgattggccttacagctagagccacctgggcgacaaatatccaggtggctattaaccaggtccggagactgctcgggaatgagaactacctggattacatgaccagcatgaaacgcttcaagaatgagtccgaccccgaaggcgccctgtggtga

SEQ ID NO: 19231 - RNA, 9879 nt, synthetic construct
  misc_feature 1..9879: note = derived and/or modified CDS sequence (opt5) from DENV-1__GU131796__SS-prME
  source 1..9879: mol_type = other RNA
agcgtgaccatgctgctcatgctgatgcccacggctcttgctttccacctgacgaccagaggcggggaacctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccagaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcgtggaagcgaagatttccaacaccacgacagacagcagatgtccgacccaaggagaggccacccttgtggaagaacaagatgctaattttgtctgccggcgcacattcgtggacagaggctggggcaacgggtgtggactgtttggcaaagggtctctcatgacctgcgccaagttcaagtgcgttacaaaactggagggaaagatcgtgcagtacgaaaatcttaaatattccgtcattgtgacggttcacaccggcgaccagcatcaagtggggaacgagagcacagaacacggaaccacagctaccatcacgccccaggccccttctaccgagatccagctgacagattacggcgccctcaccctggactgtagcccccggacaggcctggattttaatgaaatggtcctcctgaccatgaaggagaaaagctggcttgtgcataagcagtggttcctggacctccctctgccctggacgtccggggcttctacaagccaagagacctggaaccgcaaagatcttctggtcacatttaagaccgcgcacgccaagaaacaggaagtggttgtgctcggatcccaggagggcgctatgcacaccgccctgacaggggccacggaaattcaaaccagcggaacaaccacaatcttcgctggccatctgaagtgcagactcaaaatggacaagctgacccttaaagggatgtcttatgtcatgtgtacgggctccttcaagctggagaaggaagtggccgagacacagcacggaaccgttctcgtgcagattaaatacgagggcaccgatgcgccgtgcaagatcccttttagcacacaggacgaaaaaggggtcacccaaaatggacggctgattacagctaaccccatcgtgacggataaggagaaacctgtgaatatcgaagccgagccgcccttcggcgagtcttatattgttatcggggccggagaaaaggctctgaaacttagctggtttaaaaagggctcctctattgggaaaatgttcgaggccaccgctagaggcgcccgccggatggcgatcctcggagacacagcctgggattttggcagcattgggggagtcttcacctccgtgggcaagctggtgcatcagatctttgggacagcttacggagtcctgttcagcggcgtgtcttggaccatgaaaatcgggattggcgttctcctgacgtggcttggactgaactccagaagcacctctctctccatgacatgtatcgccgtgggcctggtcaccctgtaccttggggtgatggttcaggctgacagcggatgcgtgattaattggaagggccgcgaactcaagtgtgggtccggaatctttgtcacaaacgaggtgcacacctggacagaacagtataaattccaagccgactctcctaagcggctgagcgcggccattggcaaggcttgggaggagggggtttgcggcatcagatccgccacccgcctggaaaatattatgtggaagcagatctctaacgagctcaaccatatcctgcttgaaaatgatatgaaactgacggtggtcgtgggagacgtggctggcattctcgcccaggggaagaaaatgatccggccgcagcccatggagtacaagtatagctggaagtcctggggaaaagccaagattatcggcgctgatgtccaaaacacaacctttattatcgacgggcctaatacccccgaatgtcctgatgaccagagagcgtggaacatctgggaggttgaggattacggattcggcatttttacaaccaatatctggctgaaactgcgcgacagctatacacaggtgtgcgatcaccggcttatgtctgccgctattaaggactccaaagccgtgcacgccgatatgggctactggatcgaaagcgagaagaacgaaacatggaagctcgctagagcctctttcattgaggtcaaaacctgtatctggcccaagtcccatacactgtggagcaatggggtgctggaatctgagatgatcattccgaaaatctatggaggccctattagccagcacaactaccgccccgggtacttcacccaaacagcgggaccttggcatctcggcaagctggagcttgactttgatctgtgcgaagggaccacggttgtggtcgacgagcactgcggaaatcggggcccctccctcagaaccacaaccgtgacaggcaaaatcattcacgaatggtgttgccggagctgtaccctgcctcccctgcgcttcaagggggaggacggatgctggtatggcatggagatcagaccggttaaggaaaaagaggaaaaccttgtgaagtctatggtctccgctgggagcggagaggtggattccttttctctcggcctgctgtgtatcagcattatgatcgaagaggttatgcggtccagatggtctcgcaaaatgctcatgacggggacactggccgtgttctttcttctgattatgggacagctcacctggaatgacctgatccggctgtgcattatggtcggcgccaacgctagcgatagaatgggcatggggacaacctaccttgccctgatggcgaccttcaagatgcgccctatgtttgctgtgggactcctgttcagacggctcacatcccgcgaggtgctgcttctgacgatcggcctctctctggtcgccagcgttgaactgcccaattcccttgaggaactgggggacggactcgccatgggcattatgatcctgaaactcctgaccgattttcagagccatcaactttgggctacactgctctctctgaccttcatcaagacaacctccagcctgcactatgcctggaagacgatggctatggtgctttctattgtgtccctgtttcccctctgtctgagcacaacctctcagaaaaccacatggctccctgtcctgcttgggtccctgggatgcaagccgctgaccatgttcctcatcgccgagaacaaaatttggggcagaaagagctggcccctgaatgaaggcatcatggcggtggggattgtttccatccttctgagcgccctcctgaaaaacgacgtgcctctcgctggacccctgatcgccggcgggatgcttattgcttgttacgtcatctctggaagctccgccgatctgtctctggagaaggccgctgaggtgagctgggaagaggaagcggagcattccggcgcctctcacaacattctcgttgaagtgcaggacgatgggacaatgaaaatcaaggacgaggagcgggatgacacgctgaccattcttctgaaggctacactcctggccgtcagcggagtgtatcctctctccatccccgccaccctgtttgtctggtacttctggcagaaaaagaaacaacgctctggcgtgctttgggatacaccttcccctcccgaagttgagagagctgtgctggacgacggcatctatcggattatgcagcgcgggctgctcggaagatcccaggtcggcgtgggggttttccaggaaaatgtgtttcataccatgtggcacgtcacgcggggagccgtgctgatgtaccaaggcaagcgccttgagcccagctgggcgtctgtgaaaaaggatctgatctcctacgggggaggctggagactccagggcagctggaacaccggggaggaagttcaggtcattgctgtggagcccggaaagaatcctaaaaacgtgcagacagcccccggcaccttcaagacatctgaaggggaggtcggagccatcgctctggactttaaaccgggcacctccgggagccctattgtgaatcgggaaggaaagatcgttggcctctatggcaacggggtggtcacaacgtccggaacctacgtgtctgccattgcgcaagctaaagccagccaggagggccccctgcctgagatcgaagatgaggttttcagaaagcgcaatcttacaatcatggacctgcaccccgggtccggaaagacccggagatatctgcccgccattgtgcgcgaagctatcaaacggaagctcagaaccctgattcttgcccctacacgcgtcgtggctagcgagatggccgaagcgctgaaaggcatgccgatccggtaccagacgaccgccgttaagtctgagcatacagggaaagagattgtggatctcatgtgccacgctacctttacaatgagactgctgtcccccgtccgcgtgcctaactataatatgatcatcatggacgaagcccatttcaccgatcccagctctattgctgcccggggctacatcagcacgagagtgggaatgggcgaggccgctgcgatttttatgacagccacccctcccgggtccgtcgaggctttccctcaatctaacgccgttatccaggacgaagaacgggatattccggagcgcagctggaactccggatatgagtggatcaccgactttcccggcaagacagtgtggttcgtgccttctatcaagagcgggaacgatattgccaattgtctccgcaagaatggaaagcgggtcatccagctttcccgcaaaacctttgacacagaataccagaagaccaaaaataacgactgggattacgtggttacgacagacattagcgagatgggcgctaacttcagagccgatcgggtgatcgaccccagacgctgcctgaagcctgtcattctgaaggatgggcccgaacgggtgatcctcgcgggcccgatgcctgttaccgtggcttctgccgcccaaagacgcggacggattggcagaaatcacaacaaagagggggaccagtatatctacatgggacagcccctgaataacgatgaggaccatgctcactggacagaagccaagatgcttctggataatatcaacacccccgagggcattatccctgccctgttcgaacccgagcgcgaaaaatccgccgctattgacggggagtatcggctgagaggagaggcccgcaagacgtttgtcgaactgatgagacggggcgatctccctgtgtggcttagctacaaagtcgcttccgaggggttccagtattctgaccgcagatggtgctttgatggcgaacggaataaccaagtgctggaggaaaatatggacgttgagatctggaccaaggagggagaacgcaaaaagctgagaccgcggtggctcgacgccagaacatacagcgatcccctggctcttagagagttcaaggaatttgccgcgggccggagatccgtgtctggggacctgattctcgagatcggaaaactgcctcagcacctgacccagcgcgcccagaacgctctcgataatcttgtgatgctgcataacagcgaacaaggcgggcgggcctatagacacgctatggaggagctgcccgacacaatcgaaaccctcatgctgcttgccctgattgccgtcctcacaggaggcgttaccctgttctttctgtccggccgggggctcggaaagacgagcatcggccttctgtgtgtgatggcttcttccgtgctgctctggatggcgagcgtcgagcctcattggattgccgcttctatcattctggagttctttcttatggtgctgctcatccccgagccggatcgccagagaacacctcaggacaatcagctggcctacgttgtgatcgggctcctcttcatgattcttaccgtcgccgctaacgagatgggactgctggaaaccaccaagaaggatctcggcatcgggcacgtggccgtcgagaatcaccatcacgcggccatgctggacgtggatcttcatcccgcttccgcctggaccctgtacgctgttgccacaacgattatcacccctatgatgcggcacacaattgaaaacaccacagcgaacatcagcctcaccgccattgctaatcaagccgctatcctgatgggactggacaaaggctggcccatctctaagatggatattggcgtgcctctccttgccctggggtgctatagccaggtcaaccccctgacgctcaccgctgccgtgctgatgcttgttgcgcattacgccatcattggaccgggcctgcaggctaaggccacacgcgaggctcagaaaagaaccgccgccgggatcatgaagaatcctacagtggacggaattgtcgcgatcgatctcgaccccgtggtgtatgacgctaaatttgaaaagcagctgggccagatcatgctgctcattctttgtacctcccagatcctgctgatgcggacgacatgggccctctgcgagtctattaccctggctacagggccccttaccaccctgtgggagggaagccctggcaaattctggaacacaacgatcgccgtttccatggccaatatttttcgcggcagctacctcgctggggccggactggcgttctccctgatgaagtctctcggcgggggaagacggggcaccggggcccaaggagaaacacttggcgagaagtggaaacgccagctgaaccagctgagcaagtccgagttcaatacctataaaagatctggcatcatggaggtcgatcggagcgaagctaaggaggggctcaaaagaggagagacaaccaagcacgccgtgtcccgcggcacggctaagctgcggtggtttgtggaaagaaaccttgtcaaaccggaggggaaggttatcgacctgggatgtggccgcgggggatggtcttactattgcgccggcctcaaaaaggtgacagaagtgaaaggctacaccaaagggggacccggccacgaggaacctattcccatggcgacctacgggtggaatctggtcaaactgcatagcggaaaggatgtgttctttatccctcccgagaagtgtgacacactcctttgcgatattggcgagtccagccctaacccgaccatcgaagaggggcggacactgagagttctgaaaatggtggaaccctggctccgcggaaatcagttctgtattaagatcctgaacccttatatgccctctgtcgtggagacgcttgagcaaatgcagcggaaacacggcggcatgctggttagaaatcctctctcccgcaacagcacccatgaaatgtactgggtgtcttgcgggacaggaaatattgtctccgccgtgaacatgaccagccggatgctgctgaatagatttacaatggctcaccgcaagcccacctatgagcgggacgtggatctcggcgccgggacgagacacgtcgctgttgaaccggaggtggccaacctggacatcatcggacagcgcattgaaaacatcaaacatgagcacaagtctacctggcattacgatgaggacaatccttataagacatgggcttaccacggctcctatgaagtgaaacccagcgggtccgccagctctatggtcaacggagtggttaaacttctgaccaaaccctgggatgtgattcctatggtcacacagatcgcgatgaccgacacaacccccttcggccaacagagagtgtttaaggagaaagttgacacgcggacacctaaggccaagcgcggcaccgctcagattatggaagtgaccgccaaatggctctgggggttcctgagcagaaataagaaaccgcggatctgtacaagagaggaatttacgcggaaggtccgctccaacgctgccatcggagccgtgttcgttgatgagaatcaatggaactctgcgaaagaggctgtggaagacgagagattttgggatcttgtccatcgggaacgcgagctgcacaagcagggcaagtgcgcgacatgcgtgtacaatatgatggggaaaagagaaaagaaactcggagagttcggcaaggccaaagggagccgggctatttggtacatgtggctgggcgcccgctttctggagttcgaagctctcggattcatgaacgaggaccactggttttccagagaaaattctctgagcggcgtcgagggggagggacttcataagctgggctatatcctccgggatatttccaaaatccccgggggaaacatgtacgccgacgatacagcgggctgggacacccgcattacagaagatgacctgcagaatgaggccaagatcaccgatatcatggaacctgagcacgcccttctggccaagtctattttcaaactcacatatcagaacaaggtggttagagtgcaacggcccgctaaaaatgggaccgtcatggacgtgatcagccgcagagatcagcggggctccggacaggtgggcacgtacgggctgaacacctttacaaatatggaagcccagctgattcgccaaatggagagcgagggaatcttctctccttccgaactcgagacccccaacctggcgggcagagttcttgactggctggaaaagcatggggtggagcggctcaaaagaatggccattagcggagacgattgtgtcgtgaagccgatcgacgatcgctttgctgccgctctgacagcccttaacgacatgggcaaggttcggaaagatatccctcagtgggaaccctctaaggggtggaatgactggcaacaggtgcctttctgctcccaccactttcatcaactgattatgaaagatggcagagagatcgtcgtgccctgtcgcaaccaggacgagctcgtcggacgggctagagtgagccagggcgccgggtggtccctgcgcgaaaccgcgtgcctgggaaagtcttatgcccagatgtggcaactcatgtacttccaccggagagatctgcgccttgctgccaatgccatttgtagcgctgttcctgtggactgggtccccacgtcccggacaacctggagcatccatgcccaccatcagtggatgacaaccgaggatatgctgtctgtgtggaacagagtttggattgaagagaatccgtggatggaagacaaaacgcacatctccagctggggcgacgtgccttatctcgggaagcgcgaggatcagtggtgcggatctctgattggccttaccgcgcgggctacatgggccaccaacatccaagtcgccatcaatcaggtgagacggctgattgggaacgagaattacctcgactacatgacaagcatgaagagatttaaaaacgaatccgatcccgagggcgctctgtggtga

SEQ ID NO: 19232 - RNA, 9879 nt, synthetic construct
  misc_feature 1..9879: note = derived and/or modified CDS sequence (opt5) from DENV-1__GU131797__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagacagaggtcaccaaccctgctgttctgcgcaaactttgcattgaagccaagatctccaatacgacaaccgatagcagatgtccgacccaaggagaggcgacactggtggaagagcaggacgccaacttcgtgtgccggcgcacctttgtcgatagaggctggggcaatgggtgtggactcttcggcaaagggtctctgattacatgcgctaagtttaagtgcgtgacgaaacttgagggaaagatcgttcagtacgaaaacctgaaatattccgtgatcgtcaccgtgcacacaggcgaccagcatcaagttgggaatgagagcaccgaacacggaacaaccgccacgattaccccccaggctcctacaaccgagatccagctcacagactacggcgccctgaccctggattgttctccccggacgggcctcgacttcaacgaaatggtgctgcttacaatgaaggagaaatcctggctggtccataagcagtggtttctcgatctgcctcttccctggaccagcggggcctccacatctcaagagacctggaatcgccaggacctgctcgtgaccttcaaaacagctcacgcgaagaagcaggaagtcgtggttctgggaagccaagagggcgccatgcacacggctctgaccggggccacagaaattcagacctccggaacaaccacgatctttgccggccatctcaaatgcagactgaagatggataaacttacactgcgggggatgagctatgtgatgtgtaccggctctttcaagctcgagaaagaagtcgctgagacccagcacggaacagtgctggttcagattaagtacgagggcaccgacgccccgtgcaagatccctttctccacacaagatgaaaaaggggtgacgcagaacggaagactgatcaccgcgaatcccattgtcacagacaaggagaaacctgtgaacatcgaagctgagcccccctttggcgagagctatattgtgatcggggccggagaaaaggcccttaaactctcttggttcaagaagggcagctccattgggaaaatgtttgaggctaccgcccgcggcgctcggagaatggccatcctgggagatacagcgtgggacttcggctctatcgggggagtttttaccagcgtcggcaagctggtgcatcagattttcgggacggcctacggagtgctcttttccggcgtcagctggaccatgaaaatcgggattggcgtgctgcttacatggctgggactcaattctcgctccaccagcctgtctatgacatgtatcgctgttggcctggtgaccctttacctcggggtcatggtgcaggccgattccggatgcgttattaactggaagggccgggaactgaaatgtgggagcggaatcttcgtgacaaatgaggtccacacctggacggaacaatataagtttcaggctgactcccctaagagactgtctgccgcgattggcaaagcctgggaggagggggtgtgcggcatccgcagcgctacacggctcgaaaacatcatgtggaagcagatttccaacgagctgaatcatatccttctggaaaacgacatgaaattcaccgttgtggtcggagatgtggccggcattctcgctcaggggaagaaaatgatcagaccgcaacccatggagtacaagtattcttggaaaagctggggaaaggccaagattatcggcgccgacgtgcagaataccacatttatcattgatgggcctaacacccccgaatgtcctgacgatcagcgcgcttggaatatctgggaggtcgaggactacggattcggcatttttacgacaaacatctggctgaaactgcgggattcctatacccaggtttgcgaccacagacttatgagcgcggccattaaggattctaaagctgtgcacgccgacatgggctactggatcgaatccgagaagaatgaaacatggaaactcgcccgcgctagcttcatcgaggtgaagacctgtatttggcccaagtctcatacactgtggtccaacggggtcctggaaagcgagatgatcattccgaaaatctatggaggccctatttctcaacacaattaccggcccgggtacttcacccagacggccggaccttggcatctcggcaagctggagcttgattttgacctgtgcgaagggaccacagtggttgtggatgagcactgcggaaacagaggccccagcctccggaccacaaccgtcacgggcaaaatcatccacgaatggtgttgccgctcctgtacactgcctcccctgagattccggggggaggacggatgctggtatggcatggagattagaccggtgaaggaaaaagaggaaaatcttgttaagagcatggtgtctgcggggtccggagaggtcgacagcttttccctcggcctgctgtgtatctctattatgatcgaagaggtgatgcgcagccggtggtccagaaagatgctcatgaccgggacactggctgttttctttcttctgattatgggacagctcacctggaacgatctgatccgcctgtgcattatggtgggcgccaatgcctctgacagaatgggcatggggaccacataccttgctctgatggccacgttcaaaatgcggcctatgtttgcggtcggactcctgttccgcagactcaccagccgggaggtgctgcttctgacaatcggcctctccctggtggcttctgtcgaactgcccaacagccttgaggaactgggggatggactcgccatgggcatcatgattctgaagctcctgaccgactttcaatcccatcagctttgggccacactgctcagcctgaccttcatcaaaacgacattttctctgcactgtgcttggaagaccatggccatggttctttccattgtgagcctgttccccctctgcctgtctaccacatcccagaaaaccacatggctccctgtgctgcttgggagcctgggatgtaagccgctgacgatgtttctcatcgctgagaataagatttggggccgcagatcttggcccctgaacgaaggcatcatggccgtcgggatcgtgtccattcttctgagctccctcctgaaaaacgatgttcctctcgcgggacccctgatcgccggcgggatgcttattgcttgctatgtgatcagcggatctagcgccgacctgtccctggagaaggctgccgaggtctcttgggaagaggaagccgagcatagcggcgcttcccacaatattctcgtggaagttcaggatgacgggaccatgaaaatcaaggatgaggagcgggacgatacactgaccatccttctgaaagcgacactcctggccgtgtctggagtctaccctctcagcattcccgctaccctgttcgtgtggtatttctggcaaaagaaaaagcagcgctccggcgtcctttgggacacgccttctcccccggaagtggagagagccgttctggatgacggcatctaccggattatgcagcgcgggctgctcggaagaagccaggtgggcgtcggggtgtttcaagaaaacgttttccataccatgtggcacgtgacacggggagccgtcctgatgtatcagggcaagagacttgagccttcctgggctagcgtgaaaaaggacctgatctcttacgggggaggctggcgcctccagggctcctggaataccggggaggaagtgcaggttattgccgtcgagcccggaaaaaaccctaagaatgtgcaaacagcgcccggcacctttaaaacaccggaaggggaggtgggagctatcgccctggatttcaagcctggcacgagcgggtctcccattgtcaaccgggaaggaaagatcgtgggcctctacggcaatggggttgtgaccacatccggaacctatgtcagcgccatcgctcaggccaaagcgtcccaggagggccctctgcccgagattgaagacgaggtgtttagaaagcgcaaccttaccatcatggatctgcaccccgggtctggaaaaacacggagatacctgcctgctattgttcgcgaagccatcaagcggaaactcagaacgctgattcttgccccgacccgcgtggtcgctagcgagatggccgaagctctgaagggcatgcccatccggtatcaaacaaccgccgtgaagtccgagcatacagggaaagagatcgttgacctcatgtgtcacgcgaccttcacgatgagactgctgagccctgtgcgggtccccaattacaacatgattatcatggatgaagcccattttacagacccttcttccattgctgcccgcggctatatcagcaccagagtgggaatgggcgaggctgccgccattttcatgaccgctacaccccctgggtctgtggaagcgtttccgcagagcaatgccgtcatccaggatgaggaacgggacatccccgagcgctcctggaactctggatacgagtggattaccgatttccctggcaagacagtttggtttgtgcccagcatcaaatccgggaatgacattgctaactgcctcagaaagaatggaaaacgggtgatccagctttctagaaagaccttcgatacggaatatcaaaagacaaaaaacaacgactgggactacgtcgtgaccacagatattagcgagatgggcgccaatttccgcgccgaccgggttatcgatcctagacgctgcctgaagcccgtgattctgaaagacgggccggaacgggtcatcctcgctggccctatgcccgtgaccgttgcctccgcggctcagagacgcggacggatcggcagaaaccacaataaggagggggatcagtacatttatatgggacagcccctgaacaatgacgaggatcatgcccactggacggaagccaaaatgcttctggacaacatcaatacccctgagggcattatccccgctctctttgaacctgagcgcgaaaagagcgccgcgattgatggggagtacagactgcggggagaggcccgcaagacattcgtggaactgatgagacggggcgacctcccggtctggctttcttataaagtggcttccgaggggtttcaatacagcgatcgcagatggtgtttcgacggcgaacggaacaatcaggtcctggaggaaaacatggatgtggagatctggaccaaggagggagaaagaaaaaagctgcgcccccggtggctcgacgccagaacatattccgaccctctggctcttcgcgagtttaaagaattcgccgctggccggagatctgttagcggggatctgatcctcgagattggaaagctgccccagcacctgacccagcgggcccaaaatgcgctcgacaaccttgtgatgctgcataattccgaacagggcgggcgcgcctacagacacgctatggaggagctgcctgatacaatcgaaaccctcatgctgcttgccctgattgctgtgctcacgggaggcgtcacactgtttttcctgtctggccgggggctcggaaaaaccagcatcggccttctgtgcgttatggcctccagcgtgctgctctggatggcctctgtggagccccattggattgctgcgtccatcatcctggaatttttccttatggtcctgctcattccggagcctgacaagcagcgcaccccccaggataaccaactggcctatgtggttatcgggctgctctttatgattcttacagtggctgccaatgagatgggactgctggaaaccacaaagaaagacctcggcatcgggcacgtcgccgtggagaaccaccatcacgctgccatgctggatgtcgaccttcatcctgcgagcgcctggacgctgtacgctgtggccaccacaattatcacccccatgatgagacacacaattgaaaacaccacggctaatatctctctcaccgccatcgcgaaccaggccgctattctgatgggactggataagggctggcctatctccaaaatggacattggcgttcccctccttgccctggggtgttacagccaggtgaatccgctgacactcaccgctgccgtcctgatgcttgtggctcattatgccatcattggacctggcctgcaagcgaaggccacacgggaggctcagaaacgcaccgccgctgggatcatgaagaaccccacggttgatggaatcgtggccattgacctcgatcccgtcgtgtacgacgccaagttcgaaaaacagctgggccagatcatgctgctcattctttgcacatctcaaatcctgctgatgagaaccacatgggcgctctgtgagagcattaccctggctaccgggcctcttacaacgctgtgggagggatccccgggcaagttttggaataccacaatcgccgtgtctatggctaacatcttccggggcagctatctcgccggggccggactggctttctccctgatgaaaagcctcggcgggggacgcagaggcaccggggcccagggagaaacacttggcgagaagtggaaacggcagctgaatcagctgtccaagtctgaatttaacacctacaagagaagcggcattatggaggttgaccgctccgaagcgaaagaggggctcaagcggggagagacgacaaaacacgccgtctctagaggcaccgctaagctgcgctggttcgtggaacggaatcttgtgaaacccgaggggaaggtcatcgatctgggatgcggcagagggggatggagctattactgtgccggcctcaagaaagttaccgaagtgaagggctatacaaaagggggacctggccacgaggaacccattcctatggctacctacgggtggaacctggtgaagctgcattccggaaaagacgtctttttcatcccccctgagaagtgcgatacactcctttgtgacattggcgagtctagcccgaatcccacgatcgaagaggggcgcaccctgcgggtgctgaaaatggttgaaccttggctcagaggaaaccaattttgcattaagatcctgaatccctacatgccttccgtggtcgagacacttgagcagatgcagcgcaagcacggcggcatgctggtgcggaaccccctcagcagaaattctacccatgaaatgtattgggtttcctgtgggacaggaaacatcgtgagcgccgtcaatatgacctctcgcatgctgctgaaccggttcacgatggcgcacagaaaaccgacctacgagcgcgatgtggacctcggcgccgggacaagacacgtggctgtcgaacctgaggttgccaacctggatattatcggacagcggattgaaaatatcaagcatgagcacaaatccacctggcattatgacgaggataacccctacaagacatgggcttatcacggcagctacgaagtgaaaccctctgggtccgccagctccatggtgaatggagtcgtgaagcttctgaccaagccttgggacgttattcccatggtgacacaaatcgctatgaccgatacgacaccttttggccagcagcgcgtcttcaaagagaaggtggacaccagaaccccgaaagccaagcggggcacagcgcaaatcatggaagttacggccaaatggctctgggggtttctgagcagaaacaagaagccccggatttgcacccgcgaggaattcacaagaaaagtgcggtctaatgctgccatcggagctgtctttgtggacgagaaccagtggaatagcgccaaggaggccgttgaagatgagcgcttctgggaccttgtgcatagagaacgggagctgcacaaacagggcaagtgcgcgacctgtgtctataacatgatggggaaacgcgaaaagaagctcggagagtttggcaaagctaaggggtccagagccatttggtacatgtggctgggcgcccggttcctggagttcgaagctctcggatttatgaatgaggatcactggttctctcgcgaaaacagcctgtccggcgtggagggggagggacttcataaactgggctacatcctcagagacatttctaagatccctgggggaaatatgtatgccgatgacacagctggctgggatacccggatcacagaagacgatctgcagaacgaggcccgcattaccgacatcatggaacccgagcacgcgcttctggccaaaagcatttttaagctcacgtaccaaaataaagtcgtgagagttcagcggcctgctaagaacgggaccgtgatggatgtcatctcccgcagagaccagcggggctctggacaggtgggcacatatgggctgaataccttcacaaacatggaagcccaactgattagacagatggagagcgagggaatcttttcccccagcgaactcgagaccccgaacctggctgaacgcgtgcttgattggctggagaagtacggcgttgaacggctcaaaagaatggccatctctggggacgactgcgtggtcaagcctattgatgaccgcttcgcgacggccctgacagctcttaatgatatgggaaaagtgcggaaggacatcccccagtgggagccttccaaaggctggaacgattggcagcaagttcccttttgtagccatcacttccaccagctgattatgaaggacgggagagagatcgtggtcccttgccgcaatcaggatgaactcgtgggccgggccagagtctctcagggagctggctggtccctgcgcgagaccgcctgtctggggaagagctatgctcaaatgtggcagctcatgtactttcatcggagagacctgcgccttgccgcgaacgccatttgctccgctgtgcccgttgattggatcccgacatctcggaccacgtggagcattcacgcccatcaccagtggatgaccacagaagacatgctgtccgtgtggaatagagtctggatcgaggaaaacccttggatggaggataaaacccatatcagctcttggggagacgtgccctatctcggcaagcgggaggaccaatggtgtgggtccctgattggacttacagccagagctacctgggccacaaatatccaggttgcgattaaccaggtgcgccggctgatcggcaatgaaaactacctcgattacatgaccagcatgaaaagattcaagaatgagtctgaccccgaaggggctctgtggtga

SEQ ID NO: 19233 - RNA, 9879 nt, synthetic construct
  misc_feature 1..9879: note = derived and/or modified CDS sequence (opt5) from DENV-1__GU131801__SS-prME
  source 1..9879: mol_type = other RNA
agcgtgaccatgctgctcatgctgatgcccacggcccttgctttccacctgacgaccagaggaggggagcctcatatgatcgtgtccaagcaggaacggggaaaatctctcctgtttaagaccagcgccggagttaacatgtgcacccttattgcgatggacctgggggagctctgtgaagatacaatgacctacaaatgcccgcgcatcacagaggctgaacccgacgatgtggactgttggtgcaatgccaccgatacgtgggtgacctatggaacatgttcccagaccggcgagcacagacgggagaagcgctctgtcgccctggctcctcatgtggggctgggactcgaaacaagaaccgagacgtggatgagctccgaaggcgcctggaaacagattcagcgggttgagacatgggctctgcgccaccccggcttcaccgtgatcgccctttttctggcgcatgccattgggacatctatcacccagaagggaatcattttcatcctcctgatgcttgtcacccctagcatggctatgagatgcgtgggcattgggtcccgggactttgttgagggactgagcggcgccacatgggtggatgtcgtgctcgaacacgggtcttgtgtgacgaccatggctaaggacaaacccacactggatatcgagctgctcaagaccgaagtcacaaaccctgccgttctgcgcaaactttgcattgaggcgaagatctccaataccacgacagacagcagatgtccgacccagggagaagccaccctggtggaggagcaggatgctaacttcgtgtgccggcgcacatttgtcgacagaggctggggcaatgggtgtggactcttcggcaaagggtctctgcttacctgcgccaagtttaagtgcgtgacaaaactggaaggaaagattgttcagtacgagaacctcaaatattccgtgatcgtcacggtgcacaccggcgatcagcatcaagttgggaatgaaagcacagagcacggaaccacagctaccatcacgccccaggcccctaccacagaaattcagctgaccgactacggcgccctgacactcgactgttctccccggaccggcctggatttcaacgagatggtgcttctgacgatgaaggagaaatcctggctcgtccataagcagtggtttctggaccttcctctgccctggacaagcggggcttccacctctcaagaaacatggaatcgccaggatctcctggtgaccttcaaaaccgcgcacgccaagaagcaggaggtcgtggttctgggaagccaagaaggcgctatgcacacagccctcacgggggccaccgagatccagacatccggaaccacaaccatttttgctggccatctgaaatgcagacttaagatggacaaactgacgctcaaggggatgagctatgtgatgtgtacaggctctttcaaactggaaaaggaggtcgccgagacccagcacggaaccgtgctggttcagatcaagtacgaaggcacagatgcgccgtgcaaaattcctttctccacccaagacgagaagggggtgacacagaacggacggcttatcacggctaatcccatcgtcaccgataaagaaaagcctgtgaacattgaggccgagccgccctttggcgaaagctatatcgggattggagccggcgagaaagctctcaagctgtcttgggtgaagaaagggagctccatcggcaagatggttgaagccacagctagaggagcccgccggatggcgattctgggcgacaccgcctgggatttcgggtctatcggaggcgtctttacaagcgtggggaaactcgtgcatcagatcttcggaaccgcttacggcgtcctgttttccggggtgagctggacgatgaagattggcatcggagttcttctgacctggctcggcctcaattctagatccacaagcctgtctatgacctgtattgccgtggggcttgtcacactctacctgggagtgatggttcaggctgactccggctgcgtgatcaactggaaagggcgcgagctgaagtgtggaagcggcattttcgtcaccaatgaagtgcacacatggaccgagcaatataagtttcaggccgattcccctaaacggctctctgcggccatcgggaaggcttgggaggaaggcgtttgcggaattagaagcgccacgcgcctggagaacatcatgtggaaacagatctccaacgaacttaatcatattctgctcgagaacgacatgaagttcacagtggtcgtgggcgacgtggctgggatcctggtccagggcaagaagatgattcggccgcaacccatggaatacaaatattcttggaaaagctggggcaaggccaaaatcattggggccgatgttcaaaattccacctttatcatcgacggacctaacacccccgagtgtcctgatgaccagagagcttggaatatttgggaggtggaagattacggcttcggcatctttacaaccaacatttggctgaaacttcgcgacagctatacacaggtgtgcgatcaccggctcatgtctgcggccatcaaagactccaaggctgtccacgccgatatggggtactggattgagagcgagaagaatgagacatggaagctggccagagcttctttcatcgaagtgaagacctgtatctggcccaaatcccatacactgtggagcaacggagttctcgagtctgagatgattatcccgaagattcacggcgggcctatcagccaacataattatcgccccggatactttacccagacagccggcccttggcacctggggaaacttgaactggacttcgatctctgcgagggaaccacggtggtcgtggacgaacactgcggcaaccggggcccctccctgagaaccacaaccgttacagggaagattatccatgagtggtgttgccggagctgtaccctgcctccccttcgcttcagaggagaggatggctgctggtacgggatggaaatccggccggtgaaagagaaggaagagaatctcgtcaagtctatggtgtccgcgggaagcggcgaagttgactccttttctctggggctgctctgtattagcatcatgattgaggaggtgatgagatcccgctggtctcggaaaatgctgatgacgggaacacttgctgtcttctttctgctcatcatgggccagctgacctggaacgacctgattagactttgcatcatggtgggcgccaatgccagcgatcgcatggggatgggaacaacctatctggctctcatggccaccttcaagatgagacctatgtttgcggtgggcctgctgttccggcgcctgacatccagagaagtccttctgctcacgattgggctgtctctggttgctagcgtggagcttcccaactccctggaagaactgggagacggcctggccatggggatcatgatcctcaaactgcttaccgattttcaaagctaccagctgtgggccacactcctgtctctgaccttcattaagacaaccttttcccttcactatgcttggaaaacgatggccatggtgctgagcatcgtctctctcttccccctgtgtctctccacaaccagccagaagaccacatggctgcctgtgcttctgggatctctgggctgcaagccgctcaccatgtttctgattgctgaaaataaaatctggggccggaagtcctggccccttaacgaggggattatggccgttggaatcgtgagcatcctgctctccagcctgctcaaaaacgacgtccctctggcgggcccccttattgccgggggaatgctgatcgcttgttacgtgatttctggcagctccgccgatctgtctctcgagaaggctgccgaagttagctgggaggaagaggccgaacattccggggcttctcacaatatcctggtggaggtccaggacgatggaacaatgaaaattaaggacgaggaacgcgatgacacgcttaccatcctgctcaaagcgacactgctcgccgtgagcggcgtctatcctctgtccatccccgctacccttttcgtgtggcatttttggcaaaagaagaaacagagatctggcgttctgtgggatacacctagccctcccgaggtggaacgggccgtcctggacgatgggatttaccgcatcatgcagagaggactcctgggccggtcccaggtgggggttggagtgttccaagagaacgtcttccacaccatgtggcacgtgacgcgcggcgccgtgcttatgtatcaggggaagagactggagcccagctgggcttctgttaaaaaggacctcatttcctacggaggcggctggcggtttcaggggagctggaataccggagaagaggtccaggtgatcgccgtggaacccggcaaaaaccctaagaatgtccaaacagcgcccgggaccttcaagacaccggagggagaagtgggcgctattgccctggactttaaacctgggacctctggatcccccatcgttaacagagagggcaagattgtgggcctctacgggaatggagtcgtgacaacgagcggcacctatgtttccgccatcgctcaggccaaagcgtctcaggaggggcctctgcccgaaatcgaggatgaagtgttccgcaagcggaaccttacaattatggacctgcatcccggaagcggcaaaaccagacgctacctgcctgctatcgtccgggaggccattaagagaaagctccgcaccctgatccttgccccgacacgggtggttgcttccgaaatggccgaggctctgaaagggatgcccattagatatcaaacgaccgccgtcaagagcgagcacacaggcaaagaaatcgtcgatctcatgtgccatgcgacctttacaatgcgcctgctgtctcctgtgcgggtgcccaattacaacatgatcattatggacgaggcccacttcaccgatccttccagcatcgctgccagaggatatatttctacgcgggtcggcatgggggaagctgccgccatctttatgacagctacaccccctggaagcatggaggcgttcccgcagtccaatgccgttattcaggacgaagaaagagatatccccgagagatcttggaacagcggctacgaatggatcaccgactttcctgggaagacagtgtggttcgtgccctccattaaagctggaaatgatatcgccaactgtctccggaagaatggcaagcgcgtcattcagctttctagaaaaacctttgacacagagtatcaaaagaccaaaaacaacgattgggactacgtggttacgacagacatcagcgaaatgggggccaatttccgggctgatagagtgattgaccctcgccggtgcctgaagcccgtcatcctgaaagatggcccggagagagtgattctcgccggacctatgcccgttaccgtggcgtccgctgcccagcgccggggcagaatcgggcgcaaccataataaggagggagaccagtacatctatatgggccagcccctgaacaatgatgaagaccacgcccactggacagaggctaagatgcttctggataacattaatacccctgaagggatcattcccgccctcttcgagcctgaacgggagaaaagcgcggccatcgacggagagtacagactgcgcggcgaagctagaaagacgtttgtcgagctgatgcggcgcggggatctcccggtgtggctttcttataaagtcgcctccgaaggcttccaatacagcgacagacggtggtgctttgatggagagcgcaacaatcaggtgctggaagagaacatggacgttgagatttggaccaaggaaggcgagcgcaaaaagctgcggcccagatggctcgatgctcgcacatattccgaccctctggcccttcgggagttcaaagagtttgctgccgggagacgctctgtgagcggagacctgatcctcgaaatcggcaagctgccccagcatctgacccagcgggcgcaaaatgccctcgataaccttgtgatgctgcacaattccgagcaagggggcagagcttaccggcatgccatggaggaactgcctgacacaattgagaccctcatgctgcttgctctgatcgccgtcctcacaggcggcgttaccctgttctttctgtctgggaagggactcggcaaaacgagcattgggcttctgtgtgtgatggcctccagcgtgctgctctggatggcttctgtcgaaccccactggatcgcggcctccattatcctggagttctttcttatggtgctgctcatcccggagcctgatcgccagagaacaccccaggacaaccaactggcttatgttgtgattggactcctcttcatgatccttaccgtcgccgccaatgaaatgggcctgctggagaccacaaagaaagatctcgggattggacacgtggctgtcgaaaaccatcaccatgccgcgatgctggacgtggatcttcaccctgccagcgcttggaccctgtacgccgttgctacaacgatcattacccccatgatgcggcatacaatcgagaacaccacagccaatatttctctcaccgcgatcgccaaccaggctgccatcctgatgggcctggacaagggctggcctatttccaaaatggatatcggggtgcccctccttgctctgggatgctacagccaggtcaatccgctgacgctcaccgccgctgtgctgatgcttgttgcccactatgcgattatcggccctgggctgcaagccaaggctacacgcgaagcccagaagagaaccgctgccggaattatgaaaaaccccacaatcgacggcatcgtggccattgatctcgaccccgtcgtgtacgatgcgaagtttgagaaacagctggggcagatcatgctgctcattctttgtacctctcaaatcctgctgatgcggacgacatgggctctctgcgagagcattaccctggccacaggacctcttaccaccctgtgggaaggctccccgggcaagttctggaatacaacgatcgctgtgtctatggccaacatctttcgcgggagctatctcgccggagctggcctggccttctccctgatgaaaagcctcgggggaggcagacgggggaccggagcgcagggcgagacacttggcgaaaagtggaagcgccagctgaatcagctgtccaaatctgagttcaacacctacaagagaagcgggattatggaagttgaccggtccgaggccaaagagggactcaagagaggcgaaacaaccaaacacgctgtctctcgcgggacggccaagctgcggtggtttgtggagagaaatcttgtgaagcccgaaggaaaagtcatcgacctgggctgtgggcgcggaggctggagctattactgcgctggcctcaagaaagttacagaggtgaaggggtataccaaaggaggccctgggcatgaggaacccattcctatggccacctacggatggaacctggtgaagctgcactccggcaaagatgtcttctttattccccctgagaagtgtgacacactcctttgcgatatcggggaatctagcccgaatcccaccatcgaggaaggacggacactgagagtgctgaagatggttgagccttggctccgcggcaaccaattctgtattaaaatcctgaatccctacatgccttccgtggtcgagacgcttgaacagatgcagcggaagcatggcgggatgctggtgagaaaccccctcagccgcaattctacccacgagatgtattgggtttcctgcggaacaggcaacatcgtgagcgcggtcaatatgacctctcggatgctgctgaacagatttacaatggcccaccgcaaaccgacctacgaacgggacgtggatctcggggctggaacgagacatgtggccgtcgagcctgaagttgctaacctggacattatcggccagcgcattgagaatatcaagcacgagcataaatccacctggcactatgatgaagacaacccctacaagacatgggcctatcatgggagctacgaggtgaagccctctggatccgctagctccatggtgaatggcgtcgtgaaacttctgaccaagccttgggatgttattcccatggtgacacaaatcgccatgaccgacacaacccctttcggccagcagagagtctttaaagaaaaggtggatacgcggacaccgaaagcgaagcgcgggaccgcccaaatcatggaggttaccgctagatggctctggggattcctgagccggaacaagaaacccagaatttgtacacgggaagagtttacgcgcaaggtgagatctaatgccgctatcggcgccgtcttcgtggacgagaaccagtggaatagcgccaaagaagcggttgaggacgatcggttttgggaccttgtgcaccgcgaaagagagctgcacaagcaggggaaatgcgctacctgcgtctataacatgatgggaaagcgggaaaagaaactcggcgagttcgggaaggccaaaggctcccgcgccatttggtacatgtggctgggagctagatttctggagttcgaagccctcggcttcatgaatgaggatcattggttttctcgggaaaacagcctgtccggggtggagggagagggccttcacaagctggggtacatcctccgcgacatttctaaaatccctggaggcaatatgtatgctgatgacacagccgggtgggataccagaatcacagaagacgatctgcagaacgaggcgaagattaccgacatcatggaacccgagcatgcccttctggctaaaagcattttcaagctcacataccaaaataaggtcgtgcgggttcagcgccctgccaaaaacggcaccgtgatggatgtcatctccagacgggaccagcgcggatctggccaggtggggacgtatggactgaatacctttacaaacatggaagctcaactgattagacagatggagagcgagggcatcttcctccccaacgaactggagaccccgaatcttgccgggcgggtgctggattggctcgaaaagtacggagttgagagactgaaacgcatggcgatctccggcgacgactgtgtggtcaagcctattgatgaccggtttgccacagctcttaccgccctgaacgatatggggaaagtgagaaaggacatcccccagtgggaacctagcaagggctggaatgattggcagcaagttcccttctgctctcaccactttcatcagctcattatgaaagacggacgcgagatcgtggtcccttgtcggaaccaggatgagctggtgggcagagctcgcgtctcccagggggccggatggagcctgcgggaaacggcttgcctcggcaagtcttatgcccaaatgtggcagctgatgtacttccacagacgcgaccttcggctggcggccaatgctatttgttccgccgtgcccgttgattgggtgccgacaagcagaaccacatggtccatccatgcccaccatcagtggatgaccacggaggacatgctctctgtctggaaccgcgtgtggattgaagagaatccttggatggaagataaaacccggatcagctcctgggaggacgttccctatctggggaagagagaggaccaatggtgcggaagccttatcggcctgacagctcgggccacctgggcgacaaacattcaggtggctatcaatcaggtcagacgcctcattgggaacgaaaattactctgattacatgacctccatgaaacggtttaagaacgagagcgaacccgagggcgccctgtggtga

SEQ ID NO: 19234 - RNA, 9879 nt, synthetic construct
  misc_feature 1..9879: note = derived and/or modified CDS sequence (opt5) from DENV-1__GU131804__SS-prME
  source 1..9879: mol_type = other RNA
agcgtgaccatgttcctgatgctcatgcccaccgccctggcttttcaccttacgaccagaggcggggaacctcatatgatcgtgtccaagcaggaacggggaaaatctctcctgttcaagacaagcgccggcgttaacatgtgcaccctgatcgcgatggaccttggggaactgtgtgaagatacaatgacctacaaatgcccccgcatcacagagaccgaacccgacgatgtggactgttggtgcaatgctacggatacctgggtgacatatggaacctgttcccaaacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggtgacacctagcatggccatgagatgcgtgggcattgggtcccgggatttcgttgagggacttagcggcgctacgtgggtggacgtggtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctacaaccgagatccagctgacagactacggcgccctcaccctggattgttctccccggacgggcctggactttaacgaaatggtgctcctgacaatgaaggagaaatcctggcttgtccataagcagtggttcctggatctccctctgccctggaccagcggggcctccacatctcaagagacctggaatcgccaggaccttctggtgacctttaaaacagctcacgcgaagaagcaggaagtcgtggttctcggaagccaagagggcgccatgcacacggctctgaccggggccacagaaattcagacctccggaacaaccacgatcttcgccggccatctgaaatgcagactcaagatggataaactgacacttaaggggatgagctatgtgatgtgtaccggctctttcaaactggagaaggaactcgctgagacccagcacggaacagtcctggtgcagattaagtacgagggcaccgacgccccgtgcaaaatccctttttccacacaagatgaaaagggggttacgcagaacggacggctgatcaccgcgaatcccattgtgacagacaaagagaagcctgtcaacatcgaagctgagccgcccttcggcgagagctatattgtgatcggggccggagaaaaagcccttaagctctcttggtttaagaaaggcagctccattgggaagatgttcgaggctaccgccagaggcgctcgccggatggccatcctgggagatacagcgtgggactttggctctatcgggggagtgttcaccagcgttggcaaactggtccatcagatttttgggacggcctacggagtcctgttctccggcgtgagctggaccatgaagatcgggattggcgtcctgcttacatggctgggactcaattctagatccaccagcctgtctatgacatgtatcgctgtgggcctggttaccctttacctcggggtgatggtccaggccgattccggatgcgtgattaactggaaaggccgcgaactgaagtgtgggagcggaatctttgttacaaatgaggtgcacacctggacggaacaatataagttccaggctgactcccctaaacggctgtctgccgcgattggcaaggcctgggaggagggggtctgcggcatcagaagcgctacacgcctcgaaaacatcatgtggaaacagatttccaacgagctgaatcatatccttctggaaaacgacatgaagtttaccgtggttgtgggagatgtcgccggcattctcgctcaggggaaaaagatgatccggccgcaacccatggagtacaaatattcttggaaaagctggggaaaggccaagattatcggcgccgacgtgcagaataccacattcatcattgatgggcctaacacccccgaatgtcctgacgatcagagagcttggaatatctgggaggtggaggactacggatttggcattttcacgacaaacatctggctgaagctgcgcgattcctatacccaggtctgcgaccaccggcttatgagcgcggccattaaagattctaaggctgttcacgccgacatgggctactggatcgaatccgagaaaaatgaaacatggaagctcgccagagctagcttcatcgaggtgaagacctgtatttggcccaaatctcatacactgtggtccaacggggtgctggaaagcgagatgatcattccgaagatctatggaggccctatttctcaacacaattaccgccccgggtactttacccagacggccggaccttggcatctcggcaaactggagcttgatttcgacctgtgcgaagggaccacagtcgtggttgatgagcactgcggaaaccggggccccagcctcagaaccacaaccgtgacgggcaagatcatccacgaatggtgttgccggtcctgtacactgcctcccctgcgctttagaggggaggacggatgctggtatggcatggagattcggccggtcaaagaaaaggaggaaaatcttgtcaagagcatggtttctgcggggtccggagaggtggacagcttctccctcggcctgctgtgtatctctattatgatcgaagaggtcatgagaagccgctggtcccggaaaatgctcatgaccgggacactggctgtgtttttccttctgattatgggacagctcacctggaacgatctgatcagactgtgcattatggttggcgccaatgcctctgaccgcatgggcatggggaccacataccttgctctgatggccacgtttaagatgagacctatgttcgcggtgggactcctgtttcggcgcctcaccagcagagaggtcctgcttctgacaatcggcctctccctggtggcttctgtggaactgcccaacagccttgaggaactgggggatggactcgccatgggcatcatgattctgaaactcctgaccgacttccaatcccatcagctttgggccacactgctcagcctgacctttatcaagacgacattctctctgcactatgcttggaaaaccatggccatggtcctttccattgttagcctgtttcccctctgtctgtctaccacatcccagaagaccacatggctccctgtgctgcttgggagcctgggatgcaagccgctgacgatgttcctcatcgctgagaataaaatttggggccggcgctcttggcccctgaacgaaggcatcatggccgtggggatcgtctccattcttctgagctccctcctgaagaacgatgtgcctctcgcgggacccctgatcgccggcgggatgcttattgcttgttacgttatcagcggatctagcgccgacctgtccctggagaaagctgccgaggtgtcttgggaagaggaagccgagcatagcggcgcttcccacaatattctcgtcgaagtgcaggatgacgggaccatgaagatcaaagatgaggagagagacgatacactgaccatccttctgaaggcgacactcctggccgtttctggagtgtatcctctcagcattcccgctaccctgttcgtctggtacttttggcagaagaagaagcagcggtccggcgtgctttgggacacgccttctcccccggaagtcgagcgcgccgtgctggatgacggcatctatagaattatgcagcgggggctgctcggacgcagccaggttggcgtgggggtcttccaagaaaacgtgtttcataccatgtggcacgttacaagaggagccgtgctgatgtaccagggcaaacggcttgagccttcctgggctagcgtcaagaaagacctgatctcttacgggggaggctggagactccagggctcctggaataccggggaggaagtccaggtgattgccgttgagcccggaaagaaccctaaaaatgtccaaacagcgcccggcaccttcaagacaccggaaggggaggtgggagctatcgccctggattttaagcctggcacgagcgggtctcccattgtgaaccgcgaaggaaaaatcgtcggcctctatggcaatggggtggttaccacatccggaacctacgtgagcgccatcgctcaggcccgggcgtcccaggagggccctctgcccgagattgaagacgaggtcttcagaaagcgcaaccttaccatcatggatctgcaccccgggtctggaaaaacacggagatatctgcctgctattgtgcgcgaagccatcaagcggaaactcagaacgctgattcttgccccgacccgcgttgtggctagcgagatggccgaagctctgaagggcatgcccatccggtaccaaacaaccgccgtcaagtccgagcatacagggaaagagatcgtggacctcatgtgccacgcgacctttacgatgagactgctgagccctgttcgggtgcccaattataacatgattatcatggatgaagcccatttcacagacccttcttccattgctgcccgcggctacatcagcaccagagtcggaatgggcgaggctgccgccatttttatgaccgctacaccccctgggtctgtggaagcgttcccgcagagcaatgccgtgatccaggatgaggaacgggacatccccgagcgctcctggaactctggatatgagtggattaccgattttcctggcaagacagtctggttcgttcccagcatcaaatccgggaatgacattgctaactgtctcagaaagaatggaaaacgggtgatccagctttctagaaagaccttcgatacggaataccaaaagaccaagaacaacgactgggactacgtggtcaccacagatattagcgagatgggcgccaattttcgcgccgaccgggtgatcgatcctagacgctgcctgaagcccgttattctgaaagacgggccggaacgggtgatcctcgctggccctatgcccgtcaccgtggcctccgcggctcagagacgcggacggatcggcagaaaccacaataaggagggggatcagtatatttacatgggacagcccctgaacaatgacgaggatcatgcccactggacggaagccaaaatgcttctggacaacatcaatacccctgagggcattatccccgctctcttcgaacctgagcgcgaaaagagcgccgcgattgatggggagtatagactgcggggagaggcccgcaagacatttgttgaactgatgagacggggcgacctcccggtgtggctttcttacaaagtcgcttccgaggggttccaatatagcgatcgcagatggtgctttgacggcgaacggaacaatcaggtgctggaggaaaacatggatgtcgagatctggaccaaggagggagaacgcaagaagctgcgcccccggtggctcgacgccagaacatactccgaccctctggctcttagagagttcaaagaatttgccgctggccggagatctgtgagcggggatctgatcctcgagattggaaagctgccccagcacctgacccagcgggcccaaaatgcgctcgacaaccttgttatgctgcataattccgaacagggcgggcgcgcctatagacacgctatggaggagctgcctgatacaatcgaaaccctcatgctgcttgccctgattgctgtgctcacgggaggcgtgacactgttctttctgtctggccgggggctcggaaaaaccagcatcggccttctgtgtgtcatggcctccagcgttctgctctggatggcctctgtggagccccattggattgctgcgtccatcatcctggagttctttcttatggtgctgctcattccggagcctgaccgccagagaacaccccaggataaccaactggcctacgtcgtgatcgggctcctcttcatgattcttacagttgctgccaatgagatgggactgctggaaaccacaaagaaggacctcggcatcgggcacgccgctgtggagaaccaccatcacgccgcgatgctggatgtcgaccttcatcctgccagcgcttggacgctgtacgccgtggctaccacaattatcacccccatgatgcggcacacaattgaaaacaccacggccaatatctctctcaccgcgatcgccaaccaggctgccattctgatgggactggataaaggctggcctatctccaagatggacattggcgtccccctccttgctctggggtgctatagccaggtgaatccgctgacactcaccgccgctgttctgatgcttgtggcccattacgcgatcattggacctggcctgcaagccaaagctacacgcgaggcccagaagagaaccgctgccgggatcatgaaaaaccccacggtcgatggaatcgtggccattgacctcgatcccgttgtgtatgacgcgaagtttgaaaagcagctgggccagatcatgctgctcattctttgtacatctcaaatcctgctgatgcggaccacatgggctctctgcgagagcattaccctggccaccgggcctcttacaacgctgtgggagggatccccgggcaaattctggaataccacaatcgctgtctctatggccaacatcttccgcggcagctacctcgccggggctggactggccttttccctgatgaaaagcctcggcgggggaagacggggcaccggggcgcagggagaaacacttggcgagaaatggaagagacagctgaatcagctgtccaaatctgagttcaacacctataagcgcagcggcattatggaggtggaccggtccgaagccaaggaggggctcaaaagaggagagacgacaaagcacgctgtgtctcgcggcaccgccaaactgcggtggtttgttgaaagaaatcttgtcaagcccgaggggaaagtgatcgatctgggatgtggccgcgggggatggagctactattgcgctggcctcaagaaggtgaccgaagtcaaaggctacacaaaaggcgggcctgggcacgaggaacccattcctatggccacctacgggtggaacctggttaaactgcattccggaaaggacgtgttctttattccccctgagaaatgtgatacactcctttgcgacattggcgagtctagcccgaatcccacgatcgaagaggggcggaccctgagagtgctgaagatggtcgaaccttggctccgcggaaaccaattctgtattaaaatcctgaatccctatatgccttccgtggttgagacacttgagcagatgcagcggaagcacggcggcatgctggtgagaaaccccctcagccgcaattctacccatgaaatgtactgggtctcctgcgggacaggaaacatcgtgagcgcggttaatatgacctctcggatgctgctgaacagatttacgatggcccaccgcaagccgacctatgagagagatgtggacctcggcgctgggacacggcacgtcgccgtggaacctgaggtggctaacattgatatcattggacagcgcatcgaaaatattaaacatgagcacaagtccacctggcattacgacgaggataacccctataaaacatgggcctaccacggcagctatgaagtcaagccctctgggtccgctagctccatggttaatggagtggtgaaactgcttaccaagccttgggacgtcatccccatggtgacacaaatcgccatgaccgatacgacacctttcggccagcagagagtttttaaggagaaagtggacacccggaccccgaaggcgaaaagaggcacagcccaaattatggaagtcacggctaagtggctgtgggggttcctcagccggaacaaaaagccccgcatctgtaccagagaggaatttacacggaaggtgcgctctaatgccgctattggagccgttttcgtggacgagaaccagtggaatagcgccaaagaggcggtcgaagatgagagattttgggacctggtgcatcgggaacgcgagcttcacaagcagggcaaatgcgctacctgcgtttacaacatgatggggaagagagagaaaaagctgggagagttcggcaaggccaaagggtcccgggccatctggtacatgtggctcggcgctcgcttcctggagtttgaagccctgggattcatgaatgaggatcactggttttctagagaaaacagcctctccggcgtggagggggagggactgcataaacttggctatattctgcgggacatctctaaaatccctgggggaaatatgtacgctgatgacacagccggctgggatacccgcattacagaagacgatctccagaacgaggcgagaatcaccgacattatggaacccgagcacgccctgcttgctaagagcatcttcaaactgacgtatcaaaataaggtcgtgcgggtccagcgccctgccaaaaacgggaccgtgatggatgttatttccagacgggaccagagaggctctggacaggtgggcacatacgggctcaatacctttacaaacatggaagctcaactgatccgccagatggagagcgagggaatcttctcccccagcgaactggagaccccgaacctcgccgaacgggtcctggattggcttgagaagtatggcgtggaaagactgaagcgcatggcgatttctggggacgactgtgtggttaaacctatcgatgaccggtttgccacggctctcacagccctgaatgatatgggaaaggtgagaaaagacattccccagtgggagccttccaagggctggaacgattggcagcaagtccccttctgcagccatcactttcaccagcttatcatgaaagacgggcgcgagattgtggttccttgtcggaatcaggatgaactggtgggcagagctcgcgtctctcagggagccggctggtccctccgggagaccgcttgcctgggaaagagctacgcccaaatgtggcagctgatgtatttccatagacgcgacctccggctggcggccaacgctatctgttccgccgtgcccgtcgattggattccgacatctagaaccacgtggagcatccacgcccatcaccagtggatgaccacagaagacatgctttccgtgtggaatcgggtttggatcgaggaaaacccttggatggaggataagacccatattagctcttggggagacgtgccctacctgggcaaaagagaggaccaatggtgcgggtccctcatcggactgacagctcgcgccacctgggcgacaaatattcaggtcgctatcaaccaggtgcggagacttattggcaatgaaaactacctggattatatgaccagcatgaagcgctttaaaaatgagtctgaccccgaaggggccctctggtga

SEQ ID NO: 19235 - RNA, 9879 nt, synthetic construct
  misc_feature 1..9879: note = derived and/or modified CDS sequence (opt5) from DENV-1__GU131805__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagttctgtgaagatacaatgacctacaaatgcccgcgcatcacagaggctgaacccgacgatgtggactgttggtgcaatgccaccgatacgtgggtgacctatggaacatgttcccaaaccggcgagcacagacgggacaagcgctctgtcgccctcgctcctcatgtggggctgggactggagacaagaaccgaaacgtggatgagctccgagggcgcctggaaacagattcagcgggttgaaacatgggctctccgccaccccggctttaccgtgatcgccctgttccttgcgcatgccattgggacatctatcacccagaagggaatcatttttatcctgctcatgctggtcacccctagcatggctatgagatgcgtgggcattgggtcccgggatttcgttgagggacttagcggcgccacatgggtggacgtcgtgctggagcacgggtcttgtgtgacgaccatggctaaggataaacccacactcgacatcgaactgctgaagaccgaggtcacagatcctgccgttctccgcaaactgtgcattgaagcgaagatctccaacaccacgacagacagcagatgtccgacccaaggagaggccacccttgtggaagagcaggatgctaattttgtgtgccggcgcacattcgtcgacagaggctggggcaacgggtgtggactgtttggcaaagggtctctcatgacctgcgccaagttcaagtgcgtgacaaaactggagggaaagattgttcagtacgaaaatcttaaatattccgtgatcgtcacggtgcacaccggcgaccagcatcaagttgggaacgagagcacagaacacggaaccacagctaccatcacgccccaggccccttctcccgagattcagctgcctgattacggcgccctcaccctggactgttccccccggccgggcctggattttaatgaaatggtgctcctgcctatgaaggagaaaagctggcttgtccataagcagtggttcctggacctccccctgccttggacatccggggcttctaccagccaagagacatggaaccgcaaagatcttctgggaacctttaagacggcgcacgccaaggaacaggaggtggtcgtgctcggctcccaggaaggggctatgcacacagccctgaccggagccacagagatccaaaccagcggcaccacaacgattttcgctgggcatctgaaatgcagactcaagatggacaaactgacccttaagggcatgtcttatgttatgtgtacaggatccttcaaactggaaaaggaggtggccgagacccagcacggcacagtcctcgtgcagatcaagtacgaagggaccgatgcgccctgcaaaattccctttagcacgcaggacgagaagggagttacacaaaatggccggctgatcaccgctaaccctatcgtgaccgataaagaaaagccggtcaatattgaggccgagcccgccttcggggaatcttatatcgtgattggagctggcgagaaagccctgaagcttagctgggtgaagaaagggtcctctatcggcaagatgtttgaagctacagccagaggagcgcgccggatggccattctcggcgacaccgcttgggatttcgggagcatcggaggcgtttttacatccgtcgggaaactggtgcatcagatcttcggaacggcctacggcgtgctgtttagcggggtctcttggaccatgaagattggcatcggagtgctcctgacatggcttggcctgaactccagaagcacctctctctccatgacatgtattgctgttgggctggtgaccctgtaccttggagtcatggtgcaggccgacagcggctgcgttatcaattggaaagggcgcgagctcaagtgtggatccggcattttcgggacgaacgaagtgcacacctggacagagcagtataagtttcaagcggactctcctaaacggctgagcgccgctatcggcaaggcctgggaggaaggagtctgcggcattagatccgctacccgcctggagaatatcatgtggaaacagatctctaacgaactcaaccatattctgcttgagaatgccatgaagctgacagtggttgtgggggatgtcgccggaatcctcgctcagggcaaaaagatgattcggccccagcctatggaatacaaatatagctggaagtcctgggggaaggcgaaaatcattggagccgacgtgcaaaacaccacattcatcatcgatggccccaataccccggagtgtcctgacgatcagagagcttggaacatttgggaggtggaagactacggctttgggatcttcacgacaaatatttggctgaagctgcgcgatagctatacccaggtctgcgaccaccggcttatgtctgccgccatcaaagattccaaggctgttcacgccgacatgggatactggattgagagcgaaaaaaacgagccctggaagctcgcgagagcttcttttatcgaagtgaagacctgtatctggcctaaatcccatacactgtggagcaatggcgtgctggagtctgagatgattatccccaagatttatgggggacctatcagccagcacaactaccgccccggctacttcacccaaacggccgggccgtggcatctcggaaaactggaacttgatttcgacctgtgcgagggcacaaccgtcgtggttgatgaacactgcggcaatcgggggccttccctcagaacaaccacagtgcccggaaagattatccacgagtggtgttgccggagctgtaccctgccccctctgcgctttaaaggcgaggacgggtgctggtatggaatggaaatctctccggtcaaggagaaggaagagaaccttgtgaaatccatggttagcgccggctccggggaagtggactctttcagcctcggactgctgtgtatttccatcatgattgaggaggtcatgagatctcggtggagcagaaagatgctcatgacgggccccctgcctgtgtttttccttctgatcatgggccagctcccctggaatgatctgattcgcctgtgcatcatggttggggctaacgcctccgaccggatgggaatgggcaccccttaccttgcgctgatggctacatttaaaatgagacccatgttcgccgtggggctcctgtttcgcagactcacctctcgggaaggactgcttctgacaattggcctcagcctggtcgcctccgtggagctgcctaatagccttgaagagctgggggatggactcgctatgggcatcatgatcctgaagctcctgaccgacttccagtctcatcaactttgggccacgctgctcgctctgacatttattaaaaccacattctccctggattatgcctggaagaccatggcgatggtgcttagcatcgtctctctgtttcccctctgtctgtccaccacaagccagaagacgacctggctcccggttctgcttggctctctggggtgcaaacctctgacaatgttcctcattgccgaaaacaagatctggggacgcaaatcctggcccctgaatgagggcattatggctgtggggatcgtgagcatccttctgtccgccctcctgaagaacgacgtccctctcgctggacccctgattgccggcgggatgcttatcgcctgttacgtgattagcggatctagcgctgatctgtccctggagaaagcggccgaagtttcttgggaggaagaggctgaacacagcggcggctcccataacatcctcgtggaggtccaggacgatgggaccatgaagattaaagacgaggaaagagatgccacactgaccatccttctgaaggccacgctcctggctgtgtctggagtttatccgctcagcatccctgccacactgtttgtgtggtacttctggcagaagaaaaagcaacggtccggcgtcctttgggacaccccctctcctcccgaggtggaacgcgcggtcctggatgacgggatttatagaatcatgcagcggggactgctcggccgcagccaggtgggggttggagtgttccaggagaatgtctttcacaccatgtggcatgtgacaagaggcgctgttctgatgtaccaaggcaaacggcttgagccctcctgggccagcgtgaagaaagacctgatttcttacgggggaggctggcgcctccaggggtcctggaacaccggagaagaggtccaggtgatcgccgtggaacctggcaagaatccgaagaacgttcagacagctcccgggacgttcaaaaccagcgagggagaagtcggcgccattgcgctggattttaagcctggcacatctgggtcccccatcgtgaatagagagggaaaaattgtgggcctctatgggaacggagtcgtgaccacaagcggcacctacgtttccgctatcgcccaagccaaggcttctcaggaggggcctctgcccgaaatcgaggacgaagtgttccggaaaagaaatcttacgattatggatctgcaccctggcagcggaaagacccgccggtatctgccggccatcgtcagagaggctattaagcgcaaactccggacactgatccttgcccccaccagagtggttgcgtccgaaatggccgaggctctgaagggcatgcctattcgctaccagacaaccgccgtgaaaagcgagcacacagggaaggaaatcgtcgacctcatgtgccatgctacgtttaccatgcggctgctgtctcccgtgagagttcctaactataatatgatcattatggatgaggcccacttcacagacccctccagcatcgccgctcgcggatacatttctacccgggtgggcatgggggaagcggccgctatctttatgaccgccacaccgcctggaagcgtcgaggccttcccccaatccaacgctgtgattcaggatgaagagagagacatccccgagcggtcttggaatagcggctatgaatggatcacggattttcctgggaaaaccgtgtggttcgtcccctccattaagtctggcaacgacatcgccaattgtctccgcaagaacggaaaaagagttattcagcttagccggaagacatttgataccgagtaccagaaaacaaagaataacgactgggactacgtggtgaccacggatatctccgaaatgggcgcgaacttccgcgctgacagagtcattgatcctcggagatgcctgaaaccggtgatcctgaaggacgggcccgagcgcgttattctcgccggacctatgcccgtgacagtcgccagcgctgcccaacggagaggccgcatcgggcggaatcataacaaggagggagatcagtatatctacatgggccagcctctgaataacgacgaagatcacgcgcattggaccgaggccaaaatgcttctggacaatattaacacccccgaagggatcattccggctctcttcgagcctgaaagagagaagtctgccgctatcgatggcgagtatcgcctgcggggagaagccagaaaaacatttgtggagctgatgcgcagaggcgacctccccgtttggctttcctacaaggtggctagcgaagggttccagtattccgatcggcgctggtgctttgacggagagagaaataaccaagtcctggaagagaatatggatgtggagatttggaccaaagaaggcgagcggaagaaactgcgccctagatggctcgacgcccggacatactctgaccccctggcgcttagagaattcaaggagtttgccgctgggcgccggagcgtctccggagatctgatcctcgaaatcggcaagctgcctcagcacctgacccagagagcccagaacgctctcgacaatcttgtgatgctgcacaactctgagcaaggcgggcgcgcctatcggcatgccatggaggaactgcccgatacgattgagacactcatgctgcttgctctgatcgcggttctcaccggaggcgtgacactgttctttctgagcgggagaggactcggcaaaacctccattgggcttctgtgtgtgatggccagctctgtcctgctctggatggcttccgttgaaccgcactggatcgccgccagcattatcctggagttctttcttatggtgctgctcatccctgagcccgaccggcagcgcacgccccaggataatcagctggcttacgtggtcattggactgctcttcatgatccttaccgtggccgcgaacgaaatgggcctgctggagacaaccaagaaagacctcggcattgggcatgttgccgtggaaaatcaccaccatgctgccatgctggatgtcgaccttcaccctgcttctgcctggacactgtacgcggtggccaccacaatcattaccccgatgatgagacatacgatcgagaacacaaccgctaacatttccctcaccgccatcgctaatcaagccgctatcctgatgggactggataagggctggcccattagcaaaatggacatcggggtccctctccttgccctgggatgctattctcaggtgaaccccctgacactcaccgcggccgttctgatgcttgtggctcactacgccattatcggccctgggctgcaggctaaggccacacgggaagcccaaaagcgcacggcggctggaattatgaaaaatcccaccgtcgatggcatcgtggccatcgacctcgatcctgttgtgtatgacgctaagtttgagaaacagctgggccagattatgctgctcatcctttgtacaagccagattctgctgatgagaaccacatgggccctctgcgagtccatcaccctggccacggggccgcttaccacactgtgggaaggatctcccggcaagttctggaacaccacaattgctgtcagcatggccaatatctttcgggggtcctacctcgcgggagccggcctggctttcagcctgatgaaatccctcgggggaggccgcagaggcaccggggcccaaggagagacgcttggcgaaaagtggaagcggcagctgaaccagctgtctaaaagcgagttcaatacatataagcgctccgggatcatggaagtggacagatctgaggctaaagagggactcaagcggggcgaaaccacaaaacatgccgtgagcagagggaccgcgaagctgcgctggtttgttgagcggaaccttgtcaagcctgaaggaaaagtgattgatctgggctgtggcagagggggatggtcctactattgcgccggcctcaagaaagtgaccgaggtcaaggggtacacaaaaggaggccccgggcacgaagagcctatccccatggctacgtacggatggaatctggttaagctgcactctggcaaagacgtgttctttattccgcctgagaagtgtgataccctcctttgcgacatcggcgaaagctcccccaaccccacaattgaggaagggcgcaccctgcgggtgctgaagatggtcgagccttggctcagaggaaatcagttctgtatcaaaattctgaacccctatatgcctagcgtggttgagacacttgaacaaatgcagcgcaagcatggcgggatgctggtgcggaatccgctctctagaaactccacccacgagatgtactgggtcagctgcggaacgggcaatatcgtgtctgccgttaacatgacatcccgcatgctgctgaatcggtttaccatggctcatagaaaacccacctatgaacgcgatgtggacctcggggccggaacacggcacgtcgctgtggagcctgaagtggccaacctggatatcattggccagagaatcgagaacattaagcacgagcataaaagcacctggcactacgacgaagataatccctataagacatgggcgtaccatggctcttatgaggtcaagccttccgggagcgcctccagcatggttaacggagtggtgaaacttctgacgaagccctgggacgtcatcccgatggtgacccagattgctatgacagataccacacctttcggccaacagcgcgtttttaaagaaaaggtggacaccagaacgcccaaagccaagcgggggaccgctcagatcatggaggtcacagccaagtggctctggggattcctgtctcgcaataaaaagcctagaatctgtacccgggaagagtttacaagaaaagtgcggagcaacgccgcgattggcgctgttttcgtggacgagaatcaatggaactccgccaaggaagccgtcgaggatgaacgcttttgggaccttgtgcacagagagcgggaactgcataaacaggggaagtgcgctacctgcgtttacaatatgatgggcaagcgcgagaaaaagctcggagagttcggcaaagccaaggggtctagagctatctggtacatgtggctgggagcccggtttctggaattcgaggcgctcggcttcatgaacgaagatcactggtttagccgcgagaattccctgtctggggtggagggagaaggccttcacaaactggggtatattctcagagacatcagcaagattcccggcggaaacatgtacgccgatgacacagctggctgggatacccggatcacggaggacgatctgcagaatgaagccaaaatcacagacattatggagcctgaacatgctcttctggccaagtccatcttcaagctcacctatcagaacaaagtcgtgcgcgtccaaagacccgcgaagaatgggaccgtgatggatgttatttctcggcgcgaccagagaggaagcggccaggtggggacatacggactgaacacgtttaccaatatggaggcccagctgatccggcaaatggagtccgaaggcattttcagcccgtctgagctcgaaacacctaacctggctgggcgcgtccttgattggctggagaaacacggcgtggaaagactcaagcggatggccatctccggagacgactgtgtggttaaacccatcgatgacagatttgctgccgctctgaccgcccttaacgatatgggcaaggtgcgcaaggacattccccagtgggagcctagcaaagggtggaatgattggcagcaggtcccgttctgctctcatcactttcaccaactgatcatgaaggacggacgggagattgtggttccctgtagaaaccaggatgaactcgtgggccgcgcgcgggtctcccagggggccggatggagcctgagagagacagcttgcctgggcaaatcctatgcccagatgtggcaactcatgtacttccatcgccgggacctgagacttgccgctaatgccatctgttctgcggtgcctgtcgattgggtgcccaccagccgcacaacctggtccattcacgctcatcaccagtggatgacgaccgaagacatgctgagcgtttggaaccgggtgtggatcgaggaaaatccttggatggaggataagacacatatttcttcctggggggacgtcccctatctcggcaaaagagaggaccagtggtgcggaagcctgatcggccttaccgcccgcgccacatgggctaccaacatccaagtggccattaatcaggttcggagactgatcgggaacgaaaattacctcgattacatgacgtctatgaagcggtttaagaacgagagcgaccctgaaggagctctgtggtga

SEQ ID NO: 19236 - RNA, 9879 nt, synthetic construct
  misc_feature 1..9879: note = derived and/or modified CDS sequence (opt5) from DENV-1__GU131806__SS-prME
  source 1..9879: mol_type = other RNA
agcgtgaccatgttcctgatgctcatgcccacagcgctggcttttcaccttacgaccagaggaggggaacctcatatgatcgtctccaagcaggaacggggaaaatctctcctgttcaagacaagcgccggcgttaacatgtgcaccctgattgcgatggaccttggggaactgtgtgaagatacaatgacctacaaatgcccgagaatcacagagaccgaacccgacgatgtggactgttggtgcaatgctacggatacctgggtgacatatggaacctgttcccagacaggcgagcacagacgggacaagcgctctgtcgccctcgcccctcatgtggggctgggactggagaccagaacggaaacatggatgagctccgagggcgcttggaaacagattcagcgggttgaaacctgggccctccgccaccccggctttacagtgatcgctctgttccttgcccatgcgattgggacctctatcacccagaagggaatcatttttatcctgctcatgctggttacacctagcatggccatgagatgcgtgggcattgggtcccgggatttcgttgagggacttagcggcgctacgtgggtggacgtcgtgctggagcacgggtcttgtgtgaccacaatggccaaggataaacccaccctcgacatcgaactgctgaagacagaggtcaccaaccctgctgttctccgcaaactgtgcattgaagccaagatctccaatacgacaaccgatagcagatgtccgacccaaggagaggcgacacttgtggaagaacaggacgccaactttgtgtgccggcgcaccttcgtcgatagaggctggggcaatgggtgtggactgtttggcaaagggtctctcattacatgcgctaagttcaagtgcgtgacgaaactggagggaaagatcgttcagtacgaaaaccttaaatattccgtgatcgtcaccgtgcacacaggcgaccagcatcaagttgggaatgagagcaccgaacacggaacaaccgccacgattacaccccaagctcctaccaccgagatccagctgacagactacggcgccctcaccctggattgttctccccggacgggcctggactttaacgaaatggtgctcctgacaatgaaggagaaatcctggcttgtccataagcagtggttcctggatctccctctggcctggaccagcgggggatccacatctcaagagacctggaatcgccaggaccttgtggtcacctttaaaacagctcacggcaagaagcaggaagtggttgtgctggggagccaagagggagcgatgcacacggccctcaccggcgctacagaaattcagacctccgggacaaccacgatcttcgccggccatctgaaatgcagactgaagatggataaactcacactgaagggaatgagctatgtcatgtgtaccggctctttcaaacttgagaaggaactggccgagacccagcacgggacagtgctcgttcagattaagtacgagggaaccgacgctccctgcaaaatcccgttttccacacaagatgaaaagggcgtgacgcagaacgggcggctgatcaccgccaatcctattgtcacagacaaagagaagcccgtgaacatcgaagcggagcctcccttcggagagagctatattgtgatcggcgctggggaaaaagccctgaaactttcttggtttaagaaaggcagctccattggaaagatgttcgaggccaccgctagaggcgcccgccggatggctatcctcggggatacagcctgggactttggatctatcggcggggttttcaccagcgtcggaaaactggtgcatcagatttttggcacggcgtacggggtgctgttctccggcgtcagctggaccatgaagatcggaattggcgtgctcctgacatggcttgggctcaattctagatccaccagcctctctatgacatgtatcgccgttggactggtgaccctgtaccttggcgtcatggtgcaggctgattccgggtgcgttattaactggaaaggacgcgaactcaagtgtggcagcgggatctttgtgacaaatgaggtccacacctggacggaacaatataagttccaggccgactcccccaaacggctgtctgctgccattggcaaggcgtgggaggagggagtgtgcggcatcagaagcgccacacgcctggaaaacatcatgtggaaacagatttccaacgagctcaatcatatcctgcttgaaaacgacatgaagtttaccgttgtggtcggggatgtggctggcattctggcccagggcaaaaagatgatccggcctcaaccgatggagtacaaatattcttggaaaagctgggggaaggctaagattatcggagccgacgtgcagaataccacattcatcattgatggccccaacacccctgaatgtcccgacgatcagagagcctggaatatctgggaggtcgaggactacggctttgggattttcacgacaaacatctggctcaagctgcgcgattcctatacccaggtttgcgaccaccggctgatgagcgctgcgattaaagattctaaggccgtgcacgctgacatgggatactggatcgaatccgagaaaaatgaaacatggaaacttgccagagccagcttcatcgaggtgaagacctgtatttggcctaaatctcatacactctggtccaacggcgtcctggaaagcgagatgatcattcccaagatctatgggggaccgatttctcaacacaattaccgccctggctactttacccagacggctgggccctggcatctggccaaactcgagctggatttcgacctttgcgaaggaaccacagtggttgtggatgagcactgcggcaaccggggccctagcctgagaaccacaaccgtcacggggaagatcatccacgaatggtgttgccggtcctgtacactgccccctctgcgctttagaggagaggacggctgctggtatgggatggagattcggcccgtgaaagaaaaggaggaaaatctggttaagagcatggtgtctgcgggatccggcgaggtcgacagcttctcccttgggctcctgtgtatctctattatgatcgaagaggtgatgagaagccgctggtcccggaaaatgctgatgaccggaacactcgctgtctttttcctgcttattatgggccagctgacctggaacgatctcatcagactgtgcattatggtgggcgccaatgcctctgaccgcatggggatgggaaccacatacctggctcttatggccacgtttaagatgagaccgatgttcgcggtcggcctgctctttcggcgcctgaccagcagagaggtgctcctgcttacaatcgggctgtccctcgtggcttctgtcgaactgcctaacagcctggaggaacttggagatggcctggccatggggatcatgattctcaaactgctcaccgacttccaatcccatcagctgtgggccacacttctgagcctcacctttatcaagacgacattctctctgcactatgcttggaaaaccatggccatggttctgtccattgtgagcctttttcccctgtgtctctctaccacatcccagaagaccacatggctgcccgtgctcctgggaagccttggctgcaagcctctgacgatgttcctgatcgctgagaataaaatttggggccggcgctcttggccgctcaacgaagggatcatggccgtcggaatcgtgtccattctgcttagctccctgctcaagaacgatgttcccctggcgggccctctcatcgccgggggaatgctgattgcttgttacgtgatcagcggctctagcgccgacctttccctggagaaagctgccgaggtctcttgggaagaggaagccgagcatagcgggccctcccacaatattctggtggaagttcaggatgacggacctatgaagatcaaagatgaggagagagacgataccctcacaatcctgcttaaggctaccctgctcgcggtgtctggcgtctatcccctgagcattcctgccacactcttcgtgtggtacttttggcagaagaagaagcagcggtccggcgtcctgtgggacaccccctctccgcctgaagtggagcgcgctgttcttgatgacgggatctatagaattatgcagcggggactgctgggccgcagccaggtgggggtcggagtgttccaagaaaacgtttttcatacgatgtggcacgtgaccagaggcgccgtcctcatgtaccaggggaaacggctggagccctcctgggccagcgtgaagaaagaccttatctcttacggaggcggctggagactgcaggggtcctggaatacaggagaggaagtgcaggttattgctgtcgagcctggcaagaaccccaaaaatgtgcaaaccgccccggggacattcaagacccctgaaggagaggtgggcgcgatcgctctcgattttaagcccgggacaagcggatctcctattgtcaaccgcgaaggcaaaatcctgggcctctatgggaatggagtggttacgacctccggcacatacgtgagcgccatcgcccaggctcgggcctcccaggaggggcccctgcccgagattgaagacgaggtcttcagaaagcgcaaccttaccatcatggatctgcaccctggatctggcaaaacccggagatatctgccggcgattgtgcgcgaagctatcaagcggaaactcagaacactgattcttgcccccacgcgcgttgtggccagcgagatggctgaagccctgaaggggatgcctatccggtaccaaaccacagctgtcaagtccgagcataccggcaaagagatcgtggacctcatgtgccacgccacatttaccatgagactgctgagccccgttcgggtgcctaattataacatgattatcatggatgaagcgcatttcacggacccctcttccattgccgctcgcggatacatcagcacaagagtcggcatgggggaggccgctgccatttttatgaccgccacccctccgggatctgtggaggctttcccccagagcaatgcggtgatccaggatgaagaacgggacatccctgagcgctcctggaactctggctatgagtggattacagattttcccgggaagaccgtctggttcgttcctagcatcaaatccggaaatgacattgccaactgtctcagaaagaatggcaaacgggtgatccagctttctagaaagacattcgataccgaataccaaaagacgaaaaacaacgactgggactacgtggtcacaaccgatattagcgagatgggggctaattttcgcgccgaccgggtgatcgatcccagacgctgcctgaagccggttattctgaaagacggccctgaacgggtgatcctcgccggacccatgcccgtcacagtggcttccgccgcgcagagacgcggccggatcgggagaaaccacaataaggagggagatcagtatatttacatgggccagcctctgaacaatgacgaggatcatgctcactggaccgaagccaaaatgcttctggacaacatcaatacgcccgaggggattatccctgccctcttcgaaccggagcgcgaaaagagcgctgccattgatggagagtatagactgcggggcgaggcgcgcaagacctttgttgaactgatgagaagaggggacctccccgtgtggctttcttacaaagtcgcctccgagggcttccaatatagcgatcgcagatggtgctttgacggagaacggaacaatcaggtgctggaggaaaacatggatgtcgagatctggacaaaggagggcgaacgcaagaagctgcgccctcggtggctcgacgctagaacctactccgaccccctggcccttcgcgagttcaaagaatttgctgccgggcggagatctgtgagcggagatctgatcctcgagattggcaagctgcctcagcacctgacacagcgggctcaaaatgccctcgacaaccttgttatgctgcataattccgaacaagggggacgcgcgtatagacacgccatggaggagctgcccgataccatcgaaacactcatgctgcttgctctgattgccgtgctcaccggcggcgtgacgctgttctttctgtctgggcggggactcggcaaaacaagcatcgggcttctgtgtgtcatggcttccagcgttctgctctggatggcctctgtggagccgcattggattgccgcttccatcatcctggagttctttcttatggtgctgctcattcctgagcccgaccgccagagaacccctcaggataaccaactggcgtacgtcgtgatcggactcctgttcatgattcttaccgttgccgctaatgagatgggcctgctggaaacaaccaagaaggacctcgggatcggacacgtggccgtcgagaaccaccatcacgccgctatgctggatgtggaccttcatcccgccagcgcgtggacactgtacgccgtcgctacgaccattatcacacctatgatgcggcacaccattgaaaacacaaccgccaatatctctctcacggctatcgccaaccaggcggccattctgatgggcctggataaaggctggcccatctccaagatggacattggggtgccgctccttgctctgggatgctatagccaggttaatcctctgaccctcacagccgctgtgctgatgcttgtcgcccattacgctatcattggccccgggctgcaagccaaagcgacccgcgaggcccagaagagaacagctgccggaatcatgaaaaaccccaccgtggatggcatcgttgctattgacctcgatcctgtggtctatgacgccaagtttgaaaagcagctggggcagatcatgctgctcattctttgtacgtctcaaatcctgctgatgcggacaacctgggccctctgcgagagcattacactggcgaccggaccgcttaccacactgtgggagggctcccccggcaaattctggaatacgaccatcgctgtgtctatggccaacatcttccgcgggagctacctcgctggagccggcctggccttttccctgatgaaaagcctcgggggaggcagacgggggacaggagctcagggcgaaacccttggcgagaaatggaagagacagctgaatcagctgtccaaatctgagttcaacacatataagcgcagcgggattatggaggtggaccggtccgaagccaaggagggactcaaaagaggcgagaccacgaagcacgcggtttctcgcgggacagccaaactgcggtggtttgtcgaaagaaatcttgtgaagcctgagggaaaagtgatcgatctgggctgtgggcgcggaggctggagctactattgcgctggcctcaagaaggtcaccgaagttaaagggtacaccaagggaggccccgggcacgaggaacctattcccatggccacatacggatggaacctggtgaaactgcattccggcaaggacgtgttctttatccctccggagaaatgtgataccctcctttgcgacattggggagtctagccccaatcctacaatcgaagagggacggacgctgagagtcctgaagatggtggaaccctggctccgcggcaaccaattctgtattaaaatcctgaatccttatatgccctccgttgtggagacccttgagcagatgcagcggaagcacggcgggatgctggtcagaaacccgctcagccgcaattctacacatgaaatgtactgggtgtcctgcggaaccggcaacatcgttagcgctgtgaatatgacatctcggatgctgctgaacagatttaccatggcccaccgcaagcctacgtatgagagagatgtcgacctcggggcgggaacccggcacgtggccgtggaacccgaggtcgctaacctggatattatcggccagcgcattgaaaatatcaaacatgagcacaagtccacatggcattacgacgaggataacccctataaaacctgggcctaccacgggagctatgaagttaagccttctggatccgctagctccatggtgaatggcgtggtcaaacttctgacaaagccctgggacgtgattcctatggttacccaaatcgccatgacagataccacgccgttcggccagcagagagtgtttaaggagaaagtcgacacacggacccccaaggctaaaagagggaccgcccaaatcatggaagtgacagcgaagtggctctggggattcctgagccggaacaaaaagcctcgcatttgtacgagagaggaatttacccggaaggttcgctctaatgccgctatcggcgccgtgttcgtcgacgagaaccagtggaatagcgctaaagaggccgtggaagatgagagattttgggaccttgttcatcgggaacgcgagctgcacaagcaggggaaatgcgccacatgcgtgtacaacatgatgggaaagagagagaagaagctcggcgagttcgggaaggcgaaaggctcccgggctatttggtacatgtggctgggagcccgcttcctggagtttgaagccctcggcttcatgaatgaggatcactggttttctagagaaaacagcctgtccggggtcgagggagagggccttcataagctggggtatatcctccgggacatttctaaaatccccggaggcaatatgtacgctgatgacaccgccgggtgggatacacgcatcaccgaagacgatctgcagaacgaggctagaattacagacatcatggaacctgagcacgcccttctggccaagagcattttcaaactcacctatcaaaataaggtggtccgggtgcagcgccccgccaaaaacggcacggttatggatgtgatctccagacgggaccagagaggatctggccaggtcgggacctacggactgaatacatttaccaacatggaagctcaactgattcgccagatggagagcgagggcatcttctccccgagcgaactcgagacacctaacctggccgaacgggtgcttgattggctggagaagtatggggtggaaagactcaagcgcatggctatctctggagacgactgtgttgtgaaacccattgatgaccggtttgccaccgcgctgacggcccttaatgatatgggcaaggtcagaaaagacatccctcagtgggagccctccaaggggtggaacgattggcagcaagtgcctttctgcagccatcactttcaccagctgattatgaaagacggccgcgagatcgttgtgccctgtcggaatcaggatgaactcgtcggacgggctcgcgtgtctcagggcgccgggtggtccctgcgggagacagcttgcctgggaaagagctacgcccaaatgtggcagctcatgtatttccatagacgcgacctgcggcttgctgccaacgcgatttgttccgccgtcccggtggattggatccctacctctagaacaacctggagcattcacgctcatcaccagtggatgacgaccgaagacatgctgtccgtttggaatcgggtgtggatcgaggaaaacccctggatggaggataagacacatatcagctcttggggcgacgtcccctacctcgggaaaagagaggaccaatggtgcggatccctgattggccttaccgcccgcgccacatgggctaccaatatccaggtggccattaaccaggttcggagactgatcgggaatgaaaactacctcgattatatgacaagcatgaagcgctttaaaaatgagtctgaccctgaaggcgcgctgtggtga

SEQ ID NO: 19237 - RNA, 9879 nt, synthetic construct
  misc_feature 1..9879: note = derived and/or modified CDS sequence (opt5) from DENV-1__GU131807__SS-prME
  source 1..9879: mol_type = other RNA
agcgtgaccatgctgctcatgctgatgcccacagcccttgctttccacctgacgaccagaggcggggagcctcatatgatcgtctccaagcaggaacggggaaaatctctcctgtttaagacaagcgccggcgttaacatgtgcacccttattgcgatggacctgggggagctctgtgaagatacaatgacctacaaatgcccgcgcatcacagagaccgaacccgacgatgtggactgttggtgcaatgctacggatacctgggtgacatatggaacctgttcccaaacaggcgagcacagacgggacaagcgctctgtcgccctggcccctcatgtggggctgggactcgagaccagaacggaaacatggatgagctccgagggcgcttggaaacagattcagcgggttgaaacctgggccctgcgccaccccggcttcacagtgatcgctctttttctggcccatgcgattgggacctctatcacccagaagggaatcattttcatcctcctgatgcttgtcacacctagcatggccatgagatgcgtgggcattgggtcccgggattttgttgagggactgagcggcgctacgtgggtggacgtcgtgctcgagcacgggtcttgtgtgaccacaatggccaaggataaacccaccctggacatcgaactgctcaagcctgaggtcacaaacccggctgttctgcgcaaactttgcattgaagccaagatctccaataccacgacagatagcagatgtcccacccaaggagaggcgaccctggtggaagagcaggacgccaacttcgtgtgccggcgcacatttgtcgatagaggctggggcaatgggtgtggactcttcggcaaagggtctctgattacctgcgctaagtttaagtgcgtgacaaaacttgagggaaagatcgttcagtacgaaaacctgaaatattccgtgatcgtcacggtgcacaccggcgaccagcatcaagttgggaatgagagcacagaacacggaaccacagccaccattacgcctcaggctcccaccacagagatccagctcaccgactacggcgccctgacactggattgttctcctcggaccggcctcgacttcaacgaaatggtgctggtcacgatgaaggagaaatcctggcttgtgcataagcagtggtttctggatctccccctgccgtggacaagcggggcctccacctctcaagagacatggaatcgccaggaccttctggtcaccttcaaaaccgctcacgcgaagaagcaggaagtggttgtgctcggaagccaagagggcgccatgcacacagctctgacgggggccaccgaaattcagacatccggaaccacaaccatctttgccggccatctgaaatgcagactcaagatggataaactgacgcttcgggggatgagctatgtcatgtgtacaggctctttcaagctggagaaagaagtggctgagacccagcacggaaccgttctcgtgcagattaagtacgagggcacagacgccccttgcaagatccccttctccacccaagatgaaaaaggggtcacacagaacggaagactgatcacggcgaatcctattgtgaccgacaaggagaaacccgtgaacatcgaagctgagcccccttttggcgagagctatattgttatcggggccggagaaaaggccctgaaactttcttggttcaagaagggcagctccattgggaaaatgtttgaggctacagcccgcggcgctcggagaatggccatcctcggagataccgcgtgggacttcggctctatcgggggagtctttacaagcgtgggcaagctggtgcatcagattttcgggccggcctacggagtcctgttttccggcgtgagctggcccatgaaaatcgggattggcgttctcctgacctggcttggactgaattctcgctccacgagcctctctatgacctgtatcgctgtgggcctggtcacactgtaccttggggtgatggttcaggccgattccggatgcgtgattaactggaagggccgggaactcaaatgtgggagcggaatcttcgtcaccaatgaggtgcacacatggaccgaacaatataagtttcaggctgactcccctaagagactgtctgccgcgattggcaaagcctgggaggagggggtttgcggcatccgcagcgctacacggctggaaaacatcatgtggaagcagatttccaacgagctcaatcatatcctgcttgaaaacgacatgaaattcaccgtggtcgtgggagatgtggccggcattctggctcaggggaagaaaatgatcagaccccaacctatggagtacaagtattcttggaaaagctggggaaaggccaagattatcggcgccgacgtccagaatacgacatttatcattgatgggcccaacaccccggaatgtcctgacgatcagcgcgcttggaatatctgggaggttgaggactacggattcggcatttttaccacaaacatctggctcaaactgcgggattcctatacccaggtgtgcgaccacagactgatgagcgcggccattaaggattctaaagctgtgcacgccgacatgggctactggatcgaatccgagaagaatgaaacgtggaaacttgcccgcgctagcttcatcgaggtcaagacatgtatttggcccaagtctcataccctctggtccaacggggtgctggaaagcgagatgatcattcctaaaatctatggaggccccatttctcaacacaattaccggcctgggtacttcacacagaccgccggaccctggcatctgggcaagctcgagctggattttgacctttgcgaagggacaaccgttgtggtcgatgaccactgcggaaacagaggcccgagcctgcggacgaccacagtgaccggcaaaatcatccacgagtggtgttgccgctcctgtacactccctcccctgagattccggggggaagacggatgctggtatggcatggagattagacccgttaaggagaaagaagagaatctggtgaagagcatggtctctgcggggtccggagaagtggatagcttttcccttggcctcctgtgtatctctattatgatcgaggaagttatgcgcagccggtggtccagaaagatgctgatgaccgggacgctcgctgtgttctttctgcttattatgggacagctgacatggaacgacctcatccgcctgtgcattatggtcggcgccaatgcctctgatagaatgggcatggggaccacatacctggctcttatggccaccttcaaaatccggcctatgtttgcggtgggactgctcttccgcagactgaccagccgggaggtgctcctgcttacaatcggcctgtccctcgtcgcttctgttgagctgccgaacagcctggaagagcttggggacggactggccatgggcattatgatcctcaagctgctcacggattttcaatcccatcagctgtgggccacccttctgagcctcacattcattaaaaccacattttctctgcactgtgcttggaagaccatggccatggtgctgtccatcgtgagccttttccccctgtgcctctctacgacatcccagaaaaccacctggctgcctgtcctcctggggagccttggatgtaagcccctgacaatgtttctgattgctgaaaataagatctggggccgcagatcttggcctctcaacgagggcatcatggccgtggggattgtttccatcctgcttagctccctgctcaaaaacgacgtgcccctggcgggacctctcattgccggcgggatgctgatcgcttgctatgtcattagcggatctagcgccgatctttccctggaaaaggctgccgaggtgtcttgggaggaagaggccgaacatagcggcgcttcccacaatatcctggttgaggtgcaggacgatgggaccatgaaaatcaaggacgaagagcgggatgacacactcacgattctgcttaaagcgaccctgctcgccgtctctggagtgtaccccctgagcatcccggctacactcttcgtctggtatttctggcaaaagaaaaagcagcgctccggcgtgctgtgggataccccttctccccctgaggttgaaagagccgtgcttgacgacggcatttaccggatcatgcagcgcgggctgctgggaagaagccaggtcggcgtgggggtttttcaagagaacgtgttccatacaatgtggcacgtcacccggggagccgtgctcatgtatcagggcaagagactggaaccctcctgggctagcgtgaaaaaggatcttatttcttacgggggaggctggcgcctgcagggctcctggaatacgggggaggaggttcaggtcatcgccgtggaaccgggaaaaaaccctaagaatgtgcaaaccgcgcccggcacatttaaaacccctgagggggaagtcggagctattgccctcgacttcaagcccggcacaagcgggtctcccatcgtgaaccgggagggaaagatcgttggcctgtacggcaatggggtggtcaccacatccggaacgtatgtgagcgccattgctcaggccaaagcgtcccaggaaggccctctcccggagatcgaggatgaagtttttagaaagcgcaacctgaccattatggaccttcaccccgggtctggaaaaacacggagatacctgcctgctatcgtgcgcgaggccattaagcggaaactgagaaccctcatcctggcccccacccgcgtcgtggctagcgaaatggccgaggctcttaagggcatgcctatccggtatcaaacaacggccgttaagtccgaacataccgggaaagagattgtggatctgatgtgtcacgcgacattcaccatgagactcctgagccccgtccgggtgcctaattacaacatgatcattatggacgaggcccattttacagatccgtcttccatcgctgcccgcggctatattagcaccagagtgggaatgggcgaagctgccgccatcttcatgacggctacaccccctgggtctgtcgaggcgtttccccagagcaatgccgttatccaggacgaagagcgggatattcctgaacgctcctggaactctggatacgagtggatcaccgacttccccggcaagaccgtgtggtttgtgccgagcattaaatccgggaatgatatcgctaactgcctgagaaagaatggaaaacgggtcattcagctctctagaaagacattcgacaccgagtatcaaaagacaaaaaacaacgactgggattacgtggttaccacggacatcagcgaaatgggcgccaatttccgcgccgatcgggtgattgaccctagacgctgccttaagcccgtcatcctgaaagatgggcccgagcgggtgatcctggctggccctatgcccgttacagtggcctccgcggctcagagacgcggacggattggcagaaaccacaataaggaaggggaccagtacatctatatgggacagcctctcaacaatgatgaggaccatgcccactggaccgaggccaaaatgctgcttgataacattaatacaccggaaggcatcattcccgctctgtttgagcctgaacgcgagaagagcgccgcgatcgacggggaatacagactccggggagaggcccgcaagaccttcgtcgagctgatgagacggggcgatctgcccgtgtggctctcttataaagtcgcttccgaagggtttcaatacagcgaccgcagatggtgtttcgatggcgagaagaacaatcaggtgcttgaagagaacatggacgttgaaatctggacgaaagagggagagcggaagaaactgagacctcgctggctggacgcccggacctattccgatcccctcgctctgagagaatttaaggagttcgccgctggccgccggtctgtgagcggggaccttattctggaaatcggaaaactcccgcagcacctgacacagagagcccaaaatgcgctggataacctcgtgatgcttcataattccgagcagggcgggcgggcctaccgccacgctatggaagagctgcctgacaccattgagacactgatgctcctggcccttatcgctgtcctgaccggaggcgttacactctttttcctgtctggcagagggctgggaaagaccagcattggcctcctttgcgtgatggcctccagcgtgctgctgtggatggcctctgtcgaaccccattggatcgctgcgtccatcattctcgagtttttcctgatggtgcttctgatccctgaacccgataagcagcggacgcctcaggacaaccaactcgcctatgttgtgattgggctgctgtttatgatcctcacagtcgctgccaatgagatgggacttctggagaccaccaaaaaggatctgggcattgggcacgtggccgtcgaaaaccaccatcacgctgccatgctcgacgtggatctgcatcccgcgagcgcctggacactttacgctgttgccaccacaatcattacgccgatgatgcgccacaccatcgagaacacaaccgctaatatctctctgacagccattgcgaaccaggccgctatcctcatgggactggacaaaggctggcctatttccaagatggatatcggcgtgcccctgctcgcccttgggtgttacagccaggtcaatcccctgaccctgacggctgccgtgctcatgctggttgctcattatgccattatcggacctggccttcaagcgaaagccaccagagaagctcagaagcggacagccgctgggatcatgaagaacccgaccgtggacggaattgtcgccatcgatctggaccccgtggtgtacgacgccaaattcgagaagcagctcggccagattatgctgctgatcctctgcacatctcaaattcttctgatgcgcaccacgtgggcgctgtgtgaaagcatcacactcgctaccgggcctctgacaaccctttgggagggatcccccggcaaattttggaataccacaatcgccgtttctatggctaacattttcagaggcagctatctggccggggccggactcgctttctccctgatgaagagcctgggcgggggacggcgcggcacgggggcccagggagagaccctcggcgaaaaatggaagagacagcttaatcagctgtccaagtctgagtttaacacatacaaacggagcggcatcatggaagtcgatagatccgaggcgaaggaagggctgaaacgcggagagaccacaaagcacgccgtgtctcggggcaccgctaaactcagatggttcgtggagcgcaatctggtcaagcctgaagggaaggttattgaccttggatgcggccgggggggatggagctattactgtgccggcctgaaaaaggtgacggaggtgaaaggctatacaaaggggggacccggccacgaagagcctatcccgatggctacctacgggtggaacctcgtcaaactgcattccggaaaggatgtgtttttcattccccctgaaaaatgcgacaccctgctctgtgatatcggcgagtctagccccaatcctacaattgaggaagggagaacccttcgcgttctgaagatggtggagccctggctgcggggaaaccaattttgcatcaagatcctcaatccgtacatgccttccgtcgtggaaacactggagcagatgcagagaaaacacggcggcatgcttgttcgcaaccccctgagccggaattctacgcatgagatgtattgggtgtcctgtgggaccggaaacattgtcagcgccgtgaatatgacatctagaatgctcctgaaccgcttcaccatggcgcaccggaagcccacatacgaaagagacgtggatctgggcgccgggacccgccacgtcgctgttgagcctgaagtggccaacctcgacatcattggacagagaatcgagaatattaaacatgaacacaagtccacgtggcattatgatgaggacaacccctacaaaacctgggcttatcacggcagctacgaggtgaagccttctgggtccgccagctccatggtcaatggagtggttaagctgcttacaaaaccgtgggatgtgatccccatggtcacccaaatcgctatgacagacaccacaccttttggccagcagcgggtgttcaaggaaaaagttgacacccgcacgcccaaggccaaaagaggcacagcgcaaattatggaggtgaccgccaagtggctgtgggggtttctcagccggaacaagaaacctagaatctgcacccgggaagagttcacacgcaaggtcagatctaatgctgccattggagctgtgtttgttgatgaaaaccagtggaatagcgccaaagaggccgtggaggacgaacggttctgggatctggtccatcgcgagagagaacttcacaagcagggcaaatgcgcgacgtgtgtgtataacatgatggggaagcgggagaagaaactgggagaatttggcaaggctaaagggtcccgcgccatctggtacatgtggctcggcgccagattcctggagttcgaggctctgggatttatgaatgaagaccactggttctctcgggagaacagcctctccggcgtcgaaggggagggactgcataagcttggctacattctgcgcgatatctctaaaatccccgggggaaatatgtatgccgacgataccgctggctgggacacaagaattaccgaggatgacctccagaacgaagcccggatcacagatattatggagccggaacacgcgctgcttgccaagagcatctttaaactgacctaccaaaataaggtggttcgcgtgcagagacctgctaagaacgggacagtcatggacgtgatttcccggcgcgatcagagaggctctggacaggtgggcacctatgggctcaatacgttcaccaacatggaggcccaactgatccggcagatggaaagcgagggaatcttttcccccagcgagctggaaacacctaacctcgctgagagagttctggactggcttgaaaaatacggcgtggagcgcctgaagcggatggccatttctggggacgattgcgtcgtgaaacccatcgacgatagattcgcgaccgccctcacagctctgaatgacatgggaaaggttcgcaaagatattcctcagtgggaaccctccaagggctggaacgactggcagcaagtgccgttttgtagccatcacttccaccagcttatcatgaaggatgggcgggagattgtcgtgccttgcagaaatcaggacgagctggtcggccgcgcccgggtgtctcagggagctggctggtccctcagagaaaccgcctgtctggggaaaagctatgctcaaatgtggcagctgatgtactttcatcgccgggatctcagactggccgcgaacgccatctgctccgctgttcccgtggactggattcccacgtctcgcacaacctggagcatccacgcccatcaccagtggatgacaaccgaggatatgctttccgtctggaatcgggtgtggatcgaagagaacccttggatggaagacaagacgcatattagctcttggggagacgttccgtatctgggcaaaagagaggatcaatggtgtgggtccctcatcggactgaccgcccgggctacatgggccaccaatattcaggtggcgatcaaccaggtcagacgccttattggcaatgagaactacctggactacatgacaagcatgaagcggttcaaaaatgaatctgatcccgagggggctctctggtga

SEQ ID NO: 19238 - RNA, 9879 nt, synthetic construct
  misc_feature 1..9879: note = derived and/or modified CDS sequence (opt5) from DENV-1__GU131811__SS-prME
  source 1..9879: mol_type = other RNA
agcgtgaccatgctgctgatgctgatgcccacggcccttgctttccacctgacgacccggggaggggagcctcatatgatcgtctccaagcaggaacggggaaaatctctcctgtttaagacaagcgccggcgttaacatgtgcacccttattgccatggacctgggggagttctgtgaagatacaatgacctacaaatgcccgcgcatcacagaggctgaacccgacgatgtggactgttggtgcaatgccaccgatacgtgggtgacctatggaacatgttcccaaattggcgagcacagacgggacaagcgctctgtcgccctcgctcctcatgtggggctgggactggagaccagaacagaaacctggatgagctccgagggcgcctggaaacagatccagcgggttgaaacgtgggctctccgccaccccggctttacagtgattgccctgttccttgcgcatgccatcgggacctctatcacacagaagggaattatctttattctgctcatgctggtcacccctagcatggctatgagatgcgtgggcatcgggtcccgggatttcgttgagggacttagcggcgccacctgggtggacgtcgtgctggagcacgggtcttgtgtgacaacgatggctaaggataaacccaccctcgacattgaactgctgaagacagaggtcaccaaccctgccgttctccgcaaactgtgcatcgaagcgaagatttccaatacaaccacggatagcagatgtccgacacaaggagaggccacccttgtggaggaacaggacgctaactttgtgtgccggcgcaccttcgtcgatagaggctggggcaatgggtgtggactgtttggcaaagggtctctcatcacatgcgccaagttcaagtgcgtgaccaaactggagggaaagatcgttcagtacgaaaaccttaaatattccgtgattgtcacagtgcacacgggcgaccagcatcaagttgggaatgagagcaccgaacacggaacaaccgctacaatcacaccccaggccccttctacggagattcagctgaccgactacggcgccctcacactggattgtagcccccggaccggcctggactttaacgaaatggtgctcctgacaatgaaggagaaaagctggcttgtccataagcagtggttcctggatctccctctgccctggacctccggggcttctacgagccaagagacatggaatcgccaggaccttctggtgacctttaaaacagcgcacgccaagaagcaggaagtcgtggttctcggatcccaagagggcgctatgcacaccgccctgaccggggccacagaaatccagacgagcggaaccacaaccattttcgctggccatctgaaatgcagactcaagatggataaactgacacttaaggggatgtcttatgtgatgtgtaccggctccttcaaactggagaaggaagtcgccgagacgcagcacggaacagtgctcgttcagatcaagtacgagggcaccgacgcgccgtgcaaaatcccttttagcacccaagatgaaaagggggtgacacagaacggacggctgattaccgctaatcccatcgtcacagacaaagagaagcctgtgaacattgaagccgagccgcccttcggcgagtcttatatcgtgattggggttggagaaaaagccctgaaacttagctggtttaagaaaggctcctctatcgggaagatgttcgagacgaccgctagaggcgcccgccggatggctatcctcggagatacagcctgggactttggcagcattgggggagtcttcacctccgtgggcaaactggtgcatcagatctttgggacagcgtacggagtcctgttcagcggcgtgtcttggaccatgaagattgggatcggcgttctcctgacgtggcttggactcaattccagaagcacctctctctccatgacatgtattgccgtgggcctggtcaccctgtaccttggggtgatggttcaggctgatagcggatgcgtgatcaactggaaaggccgcgaactcaagtgtgggtccggaatttttgtcacaaatgaggtgcacacctggacagaacaatataagttccaggccgactctcctaaacggctgagcgctgccatcggcaaggcgtgggaggagggggtttgcggcatcagatccgccacccgcctggaaaacattatgtggaaacagatctctaacgagctcaatcatattctgcttgaaaacgacatgaagctgacggtggtcgtgggagatgtggctggcatcctcgcccaggggaaaaagatgattcggccgcaacccatggagtacaaatatagctggaagtcctggggaaaggctaaaatcatcggcgccgacgtccagaatacaacctttattatcgatgggcctaacacccccgaatgtcctgacgatcagagagcctggaatatttgggaggttgaggactacggattcggcatctttacaaccaacatttggctgaagctgcgcgatagctatacacaggtgtgcgaccaccggcttatgtctgctgcgatcaaagattccaaggccgtgcacgctgacatgggctactggatcgaaagcgagaaaaatgaaacatggaagctcgccagagcctctttcattgaggtcaagacctgtatctggcccaaatcccatacactgtggagcaacggggtgctggaatctgagatgattatcccgaagatttatggaggccctatcagccaacacaattaccgccccgggtacttcacccagacagctggaccttggcatctcggcaaactggagcttgattttgacctgtgcgaagggaccacggttgtggtcgatgagcactgcggaaaccggggcccctccctcagaaccacaaccgtgacaggcaagatcattcacgaatggtgttgccggagctgtaccctgcctcccctgcgcttcaaaggggaggacggatgctggtatggcatggagatcagaccggttaaggaaaaggaggaaaatcttgtgaaatctatggtctccgccgggagcggagaggtggactccttttctctcggcctgctgtgtattagcatcatgattgaagaggttatgcggtccagatggtctcgcaagatgctcatgacggggacactggcggtgttctttcttctgatcatgggacagctcacctggaacgatctgattcggctgtgcatcatggtcggcgctaatgccagcgacagaatgggcatggggacaacctaccttgccctgatggctaccttcaaaatgcgccctatgtttgccgtgggactcctgttcagacggctcacatcccgcgaggtgctgcttctgacgatcggcctctctctggtcgcgagcgttgaactgcccaactcccttgaggaactgggggatggactcgctatgggcattatgatcctgaagctcctgaccgactttcaaagccatcagctttgggccacactgctctctatgaccttcattagaacaaccttttccctgcactatgcctggaaaacgatggctatggtgctgagcatcgtgtctcttttccccctgtgtctctccacaaccagccagaagaccacatggctgcctgtcctcctggggtctcttggatgcaagccgctgaccatgtttctgattgccgagaataaaatctggggccggaagtcctggcccctcaacgaaggcatcatggctgtggggattgttagcatcctgctttccagcctgctcaaaaacgatgtgcctctggccggacccctcattgcgggcgggatgctgatcgcctgttacgtcatttctggaagctccgctgacctttctctggagaaggccgctgtggttagctgggaggaagaggccgaacattccggcgcctctcacaatatcctggtggaggtccaggatgacgggacaatgaaaatcaaggatgaagaaagagacgatacgctcaccattctgcttaaagctacactgctcgcggtgagcggagtctatcctctgtccatccccgccaccctcttcgtgtggtacttctggcaaaagaagaaacagagatctggcgttctgtgggacacaccttcccctcccgaggtggaacgggctgtccttgatgacggcatttatcgcatcatgcagagagggctgctgggacggtcccaggtgggcgttggggtgtttcaagagaacgtcttccataccatgtggcacgtgacgcgcggagccgtgctcatgtaccagggcaagagactggaacccagctgggcctctgttaaaaaggaccttatttcctacgggggaggctggcggctgcagggcagctggaataccggggaggaggtccaggtgatcgctgtggaacccggcaagaatcctaagaatgtccaaacagcccccggcacctttaagacatctgagggggaagtgggagcgattgctctcgatttcaaaccgggcacctccgggagccctatcgttaacagagagggaaaggtggtcggcctgtatggcaatggggtggttacaacgtccggaacctacgtgtctgccatcgcccaggctaaagccagccaggaaggccccctccctgagattgaggacgaagtctttcgcaagcggaacctgacaatcatggatcttcaccccgggtccggaaaaaccagacgctatctgcccgcgattgtgcgggaggctatcaagagaaagctgcgcaccctcattctggcccctacacgggttgtggccagcgaaatggctgaggcccttaaaggcatgccgatcagataccaaacgaccgctgtcaagtctgaacatacagggaaagagatcgtggacctgatgtgccacgccaccttcacaatgcgcctcctgtcccccgtgcgggtccctaattataacatgattatcatggatgaggcgcattttaccgaccccagctctattgccgctagaggctacatcagcacgcgggttggaatgggcgaagccgctgccattttcatgacagccacccctcccgggtccgtggaggcttttcctcagtctaatgcggtgatccaggatgaggaacgcgacatcccggaaagaagctggaactccggatatgagtggattaccgatttccccggcaagacagtctggtttgtgccttctatcaaaagcgggaatgacattgccaactgtctgcggaagaatggaaagcgcgttatccagctctccagaaaaaccttcgatacagagtaccaaaagaccaaaaacaacgactgggactacgtggtcacgacagatattagcgaaatgggcgctaatttccgggccgacagagtgatcgatccccgccggtgccttaagcctgttattctgaaagacgggcccgagagagtgatcctggccggcccgatgcctgtcaccgtggcttctgccgcgcagcgccggggaagaatcggccgcaaccacaataaggaaggggatcagtatatttacatgggacagcccctcaacaatgacgaggatcatgctcactggacagaggccaagatgctgcttgacaacatcaatacccccgaaggcattatccctgccctgtttgagcccgaacgggagaaatccgctgccattgatggggaatatagactccgcggagaggcgagaaagacgttcgtcgagctgatgcggcgcggcgacctgcctgtgtggctcagctacaaagttgcctccgaagggtttcaatattctgatagacggtggtgcttcgacggcgagcgcaacaatcaggtgcttgaagagaacatggatgtggaaatctggaccaaggagggagagcgcaagaagctgcggccgagatggctggacgctcgcacatacagcgaccccctcgccctgcgggaatttaaagagttcgctgccggcagacgctccgtctctggggatcttatcctggaaattggaaagctccctcagcacctgacccagcgggctcaaaatgccctggacaacctcgttatgcttcataatagcgagcagggcgggagagcgtatcggcacgccatggaggaactgcccgatacaatcgagaccctgatgctcctggctcttattgccgtgctgacaggaggcgtgaccctctttttcctgtccggccgcgggctgggaaagacgagcatcggcctcctttgtgtcatggcttcttccgtgctgctgtggatggccagcgttgaacctcattggattgccgcttctatcatcctcgagtttttcctgatggtgcttctgattcccgaaccggacagacagcggacacctcaggataaccaactcgcgtacgtcgtgatcgggctgctgtttatgattctcaccgtcgccgctaatgagatgggacttctggagaccaccaagaaggacctgggcatcgggcacgtggccgttgaaaaccaccatcacgccgctatgctcgatgtggacctgcatcccgcctccgcgtggaccctttacgccgtcgctacaacgattatcacccctatgatgcgccacacaattgagaacaccacagccaatatcagcctgaccgctatcgccaaccaggcggccattctcatgggactggataaaggctggcccatctctaagatggacattggcgtgcctctgctcgctcttgggtgctatagccaggttaatcccctgacgctgaccgccgctgtgctcatgctggtcgcccattacgctatcattggaccgggccttcaagccaaagcgacaagagaagcccagaagcggaccgctgccgggatcatgaagaaccctacagtggatggaatcgtggctattgacctggatcccgttgtctatgacgccaaattcgagaagcagctcggccagatcatgctgctgattctctgtacctcccaaatccttctgatgcgcacgacatgggccctgtgcgaatctattaccctcgcgacagggcccctgaccaccctttgggagggaagccctggcaaattttggaatacaacgatcgctgtgtccatggccaacatcttcagaggcagctacctggctggggccggactcgccttctccctgatgaagtctctgggcgggggacggcgcggcaccggggctcagggagagacactcggcgaaaaatggaagagacagcttaatcagctgagcaagtccgagtttaacacctataaacggtctggcattatggaagtggacagaagcgaggccaaggaagggctgaaacgcggagagacaaccaagcacgcggtctcccggggcacggccaaactcagatggttcgttgagcgcaatctggtgaagccggaagggaaggtgatcgatcttggatgtggcagagggggatggtcttactattgcgctggcctgaaaaaggtcacagaggtgaaaggctacaccaaagggggacccggccacgaggagcctattcccatggccacctacgggtggaacctcgttaaactgcatagcggaaaggacgtgtttttcatccctcccgaaaaatgtgatacactgctctgcgacattggcgagtccagccctaatccgaccatcgaggaagggagaacacttcgcgtcctgaagatggtggagccctggctgcggggaaaccaattttgtattaagatcctcaatccttatatgccctctgttgtggaaacgctggagcagatgcagagaaaacacggcggcatgcttgtccgcaaccctctgtcccggaatagcacccatgagatgtactgggtgtcttgcgggacaggaaacatcgtgtccgctgtcaatatgaccagcagaatgctcctgaaccgcttcacaatggcccaccggaagcccacctatgaaagagatgttgacctgggcgcggggacgcgccacgtggccgtggagccggaagtcgctaacctcgatattatcggacagagaattgagaatatcaaacatgaacacaagtctacctggcattacgacgaggataacccttataaaacatgggcctaccacggctcctatgaggtgaagcccagcgggtccgctagctctatggttaatggagtggtcaagctgcttaccaaaccctgggacgtgattcctatggttacacaaatcgccatgaccgatacaaccccctttggccagcagcgggtgttcaaggaaaaagtcgacacgcgcacacctaaggctaaaagaggcaccgcccaaatcatggaggtgaccgcgaagtggctgtgggggtttctcagccggaacaagaaaccgagaatttgtacacgggaagagttcacgcgcaaggttagatccaatgccgctatcggagccgtgtttgtcgacgaaaaccagtggaactctgctaaagaggccgtggaggatgaacggttctgggacctggtccatcgcgagagagaacttcacaagcagggcaaatgcgcgacctgcgtgtacaacatgatggggaagcgggagaagaaactgggagaatttggcaaggcgaaagggagccgcgctatttggtacatgtggctcggcgccagattcctggagttcgaggccctgggatttatgaatgaagatcactggttctcccgggagaactctctcagcggcgttgaaggggagggactgcataaacttggctatatcctgcgcgacatttccaaaatccccgggggaaatatgtacgctgatgacacagccggctgggataccagaatcacagaggacgatctccagaacgaagctaagattaccgacatcatggagcctgaacacgccctgcttgcgaaatctatttttaagctgacatatcaaaataaggtggtccgggtgcagcgccccgccaaaaacgggaccgtgatggatgttatcagcagacgggaccagcgcggctccggacaggtgggcacgtacgggctcaataccttcacaaacatggaggctcaactgattagacagatggaaagcgagggaatcttttctccttccgagctggaaacccccaacctcgccggccgggctctggattggcttgagaagcatggggtcgaaagactgaaacgcatggccatcagcggagacgactgtgtggttaagccgattgatgaccggttcgcgacagccctcaccgctctgaatgatatgggcaaagtgagaaaggacatccctcagtgggagccctctaaggggtggaacgattggcagcaagtccctttttgctcccaccacttccatcagcttattatgaaagacggccgcgaaatcgtggtcccctgtcggaatcaggatgagctggtgggcagagcccgcgttagccagggagctgggtggtccctccgggagacggcctgcctgggaaagtcttatgctcaaatgtggcagctgatgtactttcacagacgcgacctccggctggccgcgaacgccatttgtagcgctgtgcctgtcgattgggtgcccacatccagaaccacatggagcatccatgcccaccatcagtggatgaccacggaagacatgctttctgtttggaatcgcgtgtggattgaggaaaacccgtggatggaggataaaacccacatctccagctggggcgacgtcccttatctggggaagcgggaagaccaatggtgcggatctctcatcggcctgacagccagagctacctgggccacaaatattcaggtggcgatcaaccaggtgcggagacttctggggaatgagaactacctcgattacatgaccagcatgaaacgcttcaagaatgagtccgaccccgaaggcgctctgtggtga
